United States Patent 9,328,346 (POLYCOMB-ASSOCIATED NON-CODING RNAS) - sequence listing, part 156

SEQ ID NO: 192771 - RNA, 47599 nt, Homo sapiens
ggugcugcggcccgcgccgccaucuuggauuuuacucuccauuuuucucuggaauuauuuuuggugauuaauuuucugggggggacugggacgcggggcccggcggcgcggccccgcaucgcagcggccgggcagcggggccugggacgcgccccgaggaggagcggggcggcgcaggcggugagucgggggaggggcgggcgccggcgagggugugcggggggcggccucggugacggggcgggcagggacgugggggaccgcgggcccaggccggucgcagggcuccggggccagggcggguggggccggggccgggcgcaagcggccgggcgcggggggcggggcugcggccgggccggugcggggccggcgcggggccugcagugguggccgcggccggaagggagcgguagcggccgccgggcagcgucggggccgggcccgcggccgcacgaggggagcagccccgccgcucgcgauugggggacucuguuuucccuuuucuccaaugggcagccgugaaccgucucgcccaaucugcucccacugccgcgcugaacuuuuuguuuuuguuuuggcccgagcgcauuucggagcccucccgagcucguccugcagcccacccuccuccccgacggcgccccuggccguggcccggcgaccccgcggccgcugcguccccuuugugcuuuauccgcucucccugcguccccuggugugugucuguccuuccacguauucgcggaugaugugcaccguugucaccuccgccuuggaaggaggaacaaugacaacucgaugcaacuugcuggauuaagauagaaacaaguugggugcugagaaauucagucuauuuggguuuauuggacccgggucuggaacaguaacuuaacgauuuauuaagugguggaacuuucggaauacuggggaggugaacauguguucuuugaaguuaauuuuuaagaauuugccaaaugaaauuuaccuggaguggggggaguuuuccuuagaauagagggcaggugaauuaauuugauugauugugguucuuugugauguggaccuuuuucgauuuaaaccaguuugauauaaaguguaguugaggauggccauacaggucugaacuuugcuguguaggaucuuuagaggaagcaguugccagcuauaacuuuuuuccuuuagucuuuaauauugagaacacgccuauaauauugauaauuaguaguaaaaagaaguauuuucaaaagaggaggaaaccauuuuuaccugaaauaauuacagauaaugugugcauguugaaauacauaaauugccgcuugcuguaaauacagauuuauuguguaucugaagguuuagcaauuugaaccagagguguggcccugucccucuuggagcgccuuauauucccagguuagaguccacaaacgcucuaaucccggcuugugugggaacuccagcccauuuuucacuuuguaaucucuaaacauucgacauucuggucccucucccaagcucuggcuccaauagcuucccauaccuggucccugucggccgugcccugcccggcauuccuccaccccuuuucuccaccccguacacucuuguccuucagaaaggccccgugagaauguugcuuccuggugaaaccuucacacacacagccguuggggugguuacucgugaguuuuugagucucuuguuaucucguccgcccacgggcagguacagaguaggugcucauagacccuuaaugaauggguuaauuuauuaaucuccaaguugucaagcuuaauaguuuguauuaguuuuucaaaauaaauccacuuuaauguuguuuacaaacauaauuauauuuuaaaaacugagcuggagagugaagggaauaugguagauauuucuucaauaagagaguaggguagggcuugauucuuuauccaugaucauuuccaagugcucucgcgccuuuauuuucaucugcuuucccaaacacccugaacugcucaugcagugaacuuuuuauucucgcagcaaaugccaggggacaguaguggggaagguggagguggauggaggguagcggacucugacagggagagacgcgugugaaggaagugucccggugucugcgugucuuucagcagagaauuuagugggugggggauguuggugauuuuucucuuggguuauuuaaaaaggagguugaaucugauuuuccuuuaccugauuaucaguuuguggguuuauagggccuggguucguggccagguugugugauaaagagauuuguguguguggcaucuaagcagcucccuguccacaggaaugcccuucccauggcuuacagagcaaauccuuucagauaaaucgccguggucccauuauuucguguuucuguguaccauguaugagcuuuacauuggcaaaucucuccauuggcaaaauccuucuccguggucaggaguuccccgacuaugucagccuuagaacgcucugaugguuaagaaucuuccucacacuuuugacgauagggaccauguguccucccuccgcuccaucacccuguuagcuacaauacugcauguuaaguaaaugcagggggugauccauuaugugucuggaugggguugauuuggggcuagccggucuccgaaugagacagacuugaacaccaggccaucuucuagggccguaugucaaaugaugacugcuguauagaaguguaauuuuaggaauaguugaaggaccauggaauaagaaucaauucuuauuccauucucugcucuaucacuguuuguauaagucauugauagggccuagacuccgucuacaaaacgacucugaggucacuuccaauccaaaauuguauuaaugcuucaucuuuuacacuucacugccauccuauuuucuccuaauaauuauuuuaaucauauuuugacaucucucuaaucaccuuaguucaucugcauguuucauguaguuuuaccuccuuuuuuugaaaugucauuaugagauaguuaaucaguuggguuuuagaauugagagacuaggguaucaguguccccccccccaaagcuugauugggggccuguaugacuccuacaaugccaguugcauuucuauaagcugucuuaguuugucuguuguaauagcacacuaaagaaaacaguaccggccggguacgguggcucacgccuguaaucccagcacuuugggaggccgaggcggguggaucacgaggucaggaauugagaucaucuuggcuaacacggugaaaccccgucucuacuaaaaauacaaaaauuagccuguagucccagcuacuccggagguugaggcaggagaauggugugaacccgggaguuggagguugcagugagcagagauggcuccacugcacuccagccugggcgacagagcaagacuccgucucuuaaaaaaaaaaaaaaagggggaaagaaaacaguaccuagauccggggaucauuugcuggugauaaaccucuaggugguacacguggcucaagcacuggaguaaaccccagacugcaguuuaaagaugaagguuuuagacccacccuuaccacuuaguagcacuuugaguuuaggaaagcaauuuguuucugagcuuuagccuccuuguuguagugcuaauaccuguuucaccugauaggguugcugagcuagcgaaucccgaguccugcauguuaggggaaccaguagaaaccgaauguguguguugugacaccuguguuucuaccuugugccaccuuuauaggaaugccuggucagcacaucucuaauggcacucggcuugcuucucaggccuuacgcaaaaggcccauucagugaagggucauucugcuuccuagucuguacuuuucuacccuguuaacuuuuuuuccccuuaugcaucuguuugguuuucuucccugacucaacgacugauuuuccugaaaguagaagcucucauacgcccucuaguguucccuggacaugaccaguauuccagcaccacgaacagugccuggcagcucugggagguucuucauaaguuuguugaacugaguggauucuaggucggcccgaugaauuguuuugccugucugauuuguauaacacgguugaaauguaugauacauuuuaauggucucugaggaguauuuuuauuuucgaggcaauguuuauguugcaucauauggagaaauagauauuuuuaguaagaaaaccaaucugauuuuaggaagcugcagcuuuccucacugagaaguaaaagggggcuugauccuucagccagugagccaguggcaccauaggaaaccccccuucacuuucccccuuggaaaggaaacaaaaccagacgucauucaggguccuggaggguuuaaagcaaauauuuguuuggugcauauaaauaaguaccaggagggcuuuugacccaaaaaagguauuuuuuguuuguuuguuuuugagacagggucuuguagccucccaggcuggagagcaguggcauaaucccaguucacugcagccuuagucuccugggcccaagcaaucaucucgccuuggccucccaaagugcugggauuauaggaugagcugccaugucuggucuuguuuuuauauuuacaauuuugauuuauauuucccugaucaucccaucucaaguccauucuuacauuagucucucuccuaacauccuguuuguuuuucuuacagcucgcaucagauugauaaccacauacuuacuuacaucucuucccauaguaugcucugaccucuaugcagucaggaacgaugucuauuuugcucuagaguuuuacucuucaaauauggggcacagugguuuuuuuguuuguuuguuuggagacagagucucacucuguugcccaggcuggagugcaguggcgcgaucuuggcucauugcaaccuccaccucccaggucccgguucaugcaauucuccugccucagccucccgaguagcugggauuacagccacaugccaccacgccuagcuaacuuuuguauuuuuaguagagacgggguuucaccauguuggccaggcuggucuugaacuccugaccucgugacccucccgccucggccuccuaaagugcugggauuacaggcgugagccaccgugccuggcuugggcgaaguguguuuaaaaauuuguuuggggccaggcgugauggcucacgccuguaaccucagcacuuugggaggccgagacaggugaaucacguggucaggaguucaagaccauccuggccaacauggugaaacgcugucucuacugaaaauacaaaaauuagcugggcgugguggugggcaccuguaauuccugcuacucgggaggcugagacagagaauuccuugaaccugggaggcagagguugcagugagcagagaucgugccacugcacuccagccugggcaauagagcgagacagcgucuaaaaaaauaaaaaauuuguuugggucauuauucuguguuguuuuuugguuuguuuuuuuuuuuuuuuugagauggagucucacucuguugcccaagcuggagugcaguggcacgaucuugguucaccacaaccucugccuccuggguucaagcgauucuccugccucagccucccgaguagcugggacuacgggcaggugccaccaugccuggcuaauuuuuguauuuuuaguagaaauggauuuucacuauguucgccaggcuggucucgaauucuugaccucgugauccgcccaccucggccucccaaagugcugggauuacaggcgugagccaccgugccuggccuguguugcuuuuuugugugauauuaacaguacacagucucucagccuggacuucacuucaguuuuuuuucuaauucucugaguuuuguucucauuuguaaaauggggaugauaguauugaguguguguuaaagggcagugauguuuguaucuucuuuuauagggugugaaaauaaucuguuugaccagguacaccacaaacuaaacuguguuguaagaagcucuguaguccagucuguggucccucugaauguuuaggaugggagauguagcuuggcaugauuuuuuuuuuuuuuuugaaacggagucucgcucugucgccgaggcuggagugcaguggcgcaaucuuggcucacugcaagcuccgccucccagguucacaccauucuccugccucagccgccaccaugcccggcuaauuuuuuguauuuuuaguggagacgggguuucaccguguuagccaggauggucucgaucuccugaccucgugauccgcccgccucagccucccaaagugcugggauuacagacgugagccacugugcccugcugcuuggcaugauuuuuaaucaugcguguugcagccagaaguuacauuccuucucuuugggaacuguagggaaagcagaacuggugcucagccuugugucauaauuauucuuuugcacauuuguucuuuuuuaaaugggugaggugaugagauuuuuuuuuucaugugugaguuaugguggggaauagaagggaaauuucuacuugauuaaaguuuugugaagaauguuucuggccugcuuuacuuuugccuuaguuacuuggaaggggagaccuuaauuuguuagcaguuugugcucauuuaaaauaucuugugccaaaccuagggaggccuucuuuucauuguacugguggggcaucggugaaguuaaauaacucgucugcucacacugcugggguaaggaugaagcuagggugggacaggugcuuugacugcagagccacauccuuaaucccugugcgggcugccucugcaaagcccaccagcuggcaaacucaaaguggccucuaacguccagcccaagaaccaccuuuuggaagcuuuuccucacacuuguccuugcccaguaaaaaucuuugauguacuucuuguaacuucugacagaaacugugggcuguaaaggcuguacuuacagucauuugacacuagguggcaucuguuucuagaaccgugaauggcuguuugaguccuagagaaaacaguaacaaagaaagcauccuugauuuuauuucuaggcacugcuagguaagcagauggaucaaauguggagagaugggggaagcaggcauuuuuuguuuucuucuggaaguuuuuuugaggacuuucccucaacaaccccaucagugaaaaccuuuguuuuaaaauaacuacugagaugaagacaugaagucuuucuuacaugacaucccucgucguaaauacguauugaaugugauauuuaagaaugaagcaguauuuucugugauaaggcaauuaggaguuucuuacaugucuggcuguagaucaguagccaaauaaguaagucuaagaauugcgaacgucuggccgggcgcgguggcucacgccuguaaucccagcacuuugggaggccgagguggguggaucucgaggucaggagauugagaccauccugccuaacacggugaaacccugucuguacuaaaaauacaaaaaguuagcuaauugugguggcgggugucuguagucccagguacucaggaggcugaggcaggagaauggcuugaacccgggagguggagcuugcagugagcugagaucaugccacugcacuccagccugguggacagagugagacuccgucugaaaaaaaaaaaaaaagaauugcgaaugucugaucauaaacuuaccaguaguggauaguuugcuccuuaaaauguuuugcucaaugagaaauucuaauaguuucaguuuuuauuguaaguuuuaauauaaauagaaaaauguucaauuacaaugcuauucaggaagaucaugguuaucuggccuagcaagugugugaguaaucagagguguaauuaagaggcuggcucuauuuucaaaaucuauauaacucaguagcugcauuuuauaccuucaguugaaggauaguguaugauuuaaacuuuuuauuuauuuauguuuuuaaaggugaggucucacucugucacccaggcuggagugcaguggcaugaucauagcucacugcagccucuaccuccuggacucccaugauccuucagccucagccuccugaguagcagggacugaaguugcgcagcagcacaacuggcuacuuguuuuuuuuguuuuuuuuuuugguagagaugagggucucacuuuguugcccagucuuuuaaaacuuguuuuaaauacacuguuuuaaaaguuguuuaaaaucuuuuuuccugugacauguuggaauuuuauguauuuuuggagugugguaacuguaaagcguuucuacuuugguuuaguuuuucauaaucucuguuauguggucacuguaacaaauuccauaaacuuagcggcuuaaaacaacagaaaugggcugggcacgguggcucacaccuguaaucccagcacuuugggaggccaaggugggcggaucacuugaggucaagaguucgagaccauccuggccaacauggcgaaaccccaucucuacuaaaaauacaaaaauuagccuggcguggcagcaggugccuauaaucccagcuacucaggaggcugaggcaggagaaauugcuggaaucugggagguggagguuacagugagcugagaucgcaccacugccuccagccuaggcaacaugugagacucugugucaaaaaaaaaaaaaaaaaaaaaaaaccggaaauuuauucucucacgguuuucgaggccagaaguucaacaucaguuucacugggccaaagucaaggcguuggcagggcuguggagggaagcugcucuuugcuucuuccagccucuggugggcugcagcauucccucaccuguggccacaucacuccagucugcuucaccuucuguacuuugugaggugucaaaucucccucugccucuuauaaagucauuugaguggcauuuaaggcuuacccagauaaucuaggauaaucucuuuuaucucaaaauuuuuuauaacaucuucaaagaccauuuuccuuauaagguagcauucacaggcuccagagauuaggagccgaugucuuugggggccguuuuccaccauacuacagucugcuuuagagcuguuagcucaacaaguuuagucuuuuucaaaacuuagugauggugucuguggccaucguuuuauucugaaagggcagugggugaagcauucuaccuuggugguagguaaacugcucagcuucagacgcuauucucuugguggccugagugagggcauuaccaccugaggguacuugggaaagcuguugaauugggugaagcaaaaugcauccaagcuugacccuaugaaagcuagagaaggaaaguaggaaugauaauaucauggacauuuguaauuauuuuaggaguauagagacguauucuuugcuauggaguugaugguucuagauaccugauuaccauuugaauuagcgugacagcucuaauuuuaaaguaaaggcucugccuuagguagaagcauaauugugaauucagggaaaugaaaacccugaggccuuucucuuuucauaauacuaacaccccguugaacuacucugacaagucaccuagcuucucaggugagacaacaauguuuauaggagcaaguuuuaagguuacagguaugaacgugaauucgugguaguuuucuaacaaauuagcaacugagaaauugcccugucaagcaguguuaaugguguuaugauggaauauuggucacaaaugcuucugauagcuuugcagggcuucuuuuauuggccucaucgcugggauugauaccauaggauuccguggagccuuaguuauugcaauauugauugcagacggcuuuggaauagccauugauaaagaccgauuuggaauucuuugaugucaaguccuuuugugauuucacauuuaggagaaaacuaaaaaccgauucugcuuauguguagcaguugguuugagaauagaaagggaaggugauaugaauggaccuaugucuggucuugugcuggauucuaaugauaugaaaguguauggggccgggugcggugccucacgccuguaaucccagcacuuugggaggccgaggcaggcagaucacgaggucaggaguucgagaccagccugaccaacauggugaaaccucgucucuccuaaaaauacaaaaauuagcugggugugauggcacacaccuguaaucccagcuacucaggaggcugaggcaggagaaucccuggaacccaggaggcggagguugcagugagcugagaucgugccacugcacuacagccugggugacagagcaagacuccaucuaaaaagaaaaaguuuagcauagaauuaccauaugacccggcaauucuacuucuggguauaucgucaaaagaauuaaagcggguacucaaacagguauuuuguacacccacguucacagcaggauuauucggccaaaacauggaaauaaagccaggugcaguggcuuacgccuguaaucccaguacuuugggaggccgaggugggcaaaucacgaggucaagaguucaagaccagcccaaccaacauggugaaaccccgugucuacuaaaaauacaaaaauuagccgggcauaguggugcgcgccuguaaucccagcuacucaggaggcugaggcaggagaaucgcuugaacccgggaggcagggguugcagugagcugagauugagccacugcacuccagccugggcaacagagugagaguuugucucaaaaaaaaaaaaaaaaaaaagugugucuuagcuaguagggaaggcagguguuaccagauaauuacacagaguagugaguaugguuguaauaagcaccaugcugagaaacguuaaggguuaaaauguauaacaaggaaaucuauauagcuggagaagugggguugggcagggacugaggagcaguguggcggcaccccaagugcaaaggcccuguggugggaagcugccaagcuguuucccuuuccuuuguguaaguaucuuuaauauuuuguuacaaaagucacagauguuuauuuugaaaaguugaacauguagcagguaaauauugcuugugaugucauucuccauuguaaucucacucacuguuaaccagugguguacuggauuguuuucuuaccaaauuauaacuaaaucacuugaaaaauguuuucuuugccuuucuaaauaaagauuuaugaaaguccucuaacaggcuagaaccugcuuuuuauuauuucuuugagacagagucuugcucuaucaccuaggcuagagugcaguggugcaaucuccuggacucaagccauccucccaccucagccuccugaguaccugggacuacaagcacgcaccaccacacccgacuaauuuuuuuuuuuuuuuuuuuuugguagagacuggggucugaccauguugcccaggcuggucuugaacuccugggcucaaggaauccaccugcuucggccucccuaaguguugggauuacaggcgugagccaccacacccagccagaaccuacuuuuuaaaaauguguauugacuuuucuuuuucaaccacuuggggauuguuucccugccacuggauaauuucucuaagauaaacuguuugcagacaaguucagcaugucaacuggcuagaggguucucgguaaugucacaggaauuacguuaacauucuuucuagucauucagaaucaguguuuuaacuuuuuugacagauuuuuuuuuuaaucuuaguuuguuuuuaggauauuaagcaaaaaaugccuguguuuaaguaaaaauggauuggaaucagaguucucaaauuggacacaauuucucaaaagucacucaacaauuuauaaucucauaaagagccuggaaagagaagggcauugacauuuguugaggggccaucacuggcauagaacaggcaugguuaugugaacguagcccauuuucuaugaaucaaugcugcuuucuuuugaaauguguuaaaguauuaagguuuucaguuuuuuucugauuauaaguaaauagguucacuguaaacguuuggggaaaaaauacuuuugaaaguuauccuuccccccagcaacgguagcacuggugauuuggaaugcauugugguggugcuggugguggugggugucgcgcuucucaccuuaguggcaucguguuaugauuaggaguuuccgcuuuaaauacaacuggaaaucauucuugaaaucuuuuccccuuuaaauacauuucuuauuuuagcaguuuuccaguauguuuuaucuugaucauaaauuguccccucaccccccaccuccuuauuuauguuugguaccagaaucuguaguaagugcuucuuuucccauguguugauccagugaaaccacauaaggugacucuuccuguugauuucagugcuggguaaaucccuuggggaagugaugcugcccaucuuggagcagaaucccaauuccauuuucucagagccugauugcaucauuucugugaauacucacgaaaguagaaggcacaaagccuugcacaguaguccucaggaauuccacuucguuuuccuacucagaucaucuguauuacucccauccagagauuuaaccaaucuauuaguuuaaaaaaauuuuuuuaacacagauccuauaagcgcucugaaggcuugccuucucaaauuaacuaaccuauucccaucaccucccacuccauaauuuuaacuuacauuugucuuuucuggccugcgagucagucucucucucucucguuccugauauugcccucugccaucuguuucuuaaagcaaagccccgucuuccucacaagugcguguuuuaagacauuguguccauuuagaaguucucuguuguuucugagcaaggcucacagaucagcaauagcccauccuuuccacgaguuuagacucauaaaauaaaaguauuugcuuacugggcaccuauaguccuugccugaguugguaacucccuccacagaguggucccugucaugccuggcucugcuucucacuuguugcuccuuuugugauccugugcugcuucuccuccucuugaccuauacauguuaaagugcccccgacacccaguccuuggacuucauugaucugcacugaguccuagauuucaucugauuccauggcuugaaaugccauuaauacuuugauuuuauuugaagauaaaaauaccagauuuuuaucuucagcuuggagcuggacuccagacccugguauccagcugccaacuccaguuggaucuguagugggcaucucaaaagugacuaaaaccaaaaaagacccccaaaaaggaagaaaaaaugaccaaaaccaaauucccacaccgcaguccuugcggaagccaaucuuccuauagucuuugucacaucccuaaauauuaauuccauucuucauuugcagguauuuuugaguccucuuucuccuacaccugcauucaaucugucagcaguucccgacuaucagcggaaccuucagaaaagaucucgaagccaaccacuucuugccaccucugcugcugcagccacuaguucuccucuggcuagcaguagucaguuaguaaauagacuacuacuacuaauaacgucucccugcauucucuuguccuagaaauuauuaguagcuucauuagaacugcuuuuuuaaaguaccauguagcaagcugccagcaugguccuuuaaaacuguggguuggaucgugucacuccucugcuuucccucucacugggaguaaaggcccaagucucagcaguggcuuugaagcccuucuucccuguggcagccucucugaccucauccucccacucuuccuccauauuugccccagccacgccagccucugggccuuguguuugcccuucccuuugucuacugcaugcuucuugccugaugccuggcugucccuucacaucccuugcugucuuagaaaacagccacuaucacccuccuucuccaccugaaacacucccugccaccauaaauggcuuauuccccccaaaaggugccgacauucauucguuaauuuauuauuuccuagugcuuuuuuccauuagaauauaagcacagaugagggcagaagccuuauuuuguuccaugcuguauucucagugccugcaacagugucuggaauauaguggaugucuaauuuuccugacauuuuuauauugggaaaucagaacaggauuuguaacuaaaaaaaaaacaacgcaauuacuuuauuacuuuugcaccaagcuaauacaccauuuaagaaguggucaguaauggccgggcgugguggcucacgccuguaaucccagcacuaugggaggccaaggcgggcagaucacaaggucaggagauugagaccagccuggcuaacacggugaaaccccaucuuuacuagaaauacaaaaaaucagccgggugugauggcgugcaucugcaguuccagcuacucaggagguugaggcaggagaauggcuugaacccgggaagcggagguugcagugagccaagaucgugccacugcacuccagccugggcaacagagcgagacuccgucucaaaaaaaaaagaagcagucaguacuuucuugaaauguuuuuccuaacaauuugggacaaaauugaggcaauuuuuacuucuaaauguagucaguggcuaauuagcucagagugugucagccaaaccgugaccauggggacauuuccacgugagccagcuaugucccaugggagucugcacccuuguguguuuguugggagggggcaccucugugguagcuaugaagcauuuaggcuuugcuagccgcccugucuugucuugucuugucuugucuugucuugucuugucuugucuugucuugucuugucuuuuuuccuuuccuuuccuucaucuucuuuccucuucuuuucucuucuuuucuuuucacagucuugcugugucgcccaggcuggauggagugcaguggcacaaucuuggcucagugcaaccucugccuccuggguugaagcuauucuccugccucagccucccaaguagcugggauuacaggcaugugacaccacgccuggcuaauuuuuguauuuuuagcagggaugggguuucaccuuguuguccaggcuggucucgaacuccugaccucaggugaucugcccgccuuggccucccaaagugcugggauguuuucaaccccuauuugucuauacucuacuacaguaucgacuuguguuagcuuuuuaaaaucccaucgcuaccuuuaauguguaaacguguggucuuagaggaaagaucaugccagcaagaacagauuccacacuuaggagggcagaacaaaugaugaccugaucauuaguacaauauauauucauuuugagcugaaaauuuuuuuaaauagcccccaaauuauugauagcuucauuagaauuguuuuuacaaauguuucauuuaucaguuuaagaaagaucuuuugauagcuuuuaucauauggaccuguggagaaucucucucugcuaggcuacauccagacaugugcagugcauucauacuagugaaauuuagccauguucugugauugacagaaguaccuguuagauuaaauuaccuugaguucaaauaauaucaguugaucacaauauaaaugagaucugagggcacagauuuuuuccaguuuggaucauuaacccacauuuaauuuaaauuaugugcacauuagaguggaucucagucuguguuccaugaauugaaccaaaguuugcuauuacuaaagugauuuguuggugaauuuuccuaauucucagaaaaauguuugguugauauuauaauuuccuuaauuuuuuauuccauaauuuuucuuaaaauuuuguaucuauucuuugcccuaacaugauaaaaugaauaaguaaauuagagcgauugcucuuacacuggagcuugcaucaccuggaggucuuacuacaacacagauugcugggccucauccccaaauuuucugcuuucucucaaguagacaucuugguugggacuuaaagacuuuccauggccgggcgugguggcucacgccuguaauuccagcacuuugggaggccgagacaggcagaucaugaggucaggagaucgagacuauccuggccaacauggugaaaccccgugucuacuaaaauagcaaaaaaaaauuagccaggugugguggugcgcaccuguaguccuagcuacucgggaggcugagucaggagaaucgcuugaacccaggaagcagagguuguagugagccgaguuugggccacugcacucuaacuuggggacagugcgagacuccgucucaaaaaaagaaaaaaaaaaagacucuccauggauaaccuuucuauuccauauauuuuauuucuauuucauauaauuaugcuuuaugucuuauuuuugagguauauuaggacuccugagaagccuaaaaguacauuguuccaugauuauccauaaguuguguguuaaacacaggcauucuacagaugauuuccuaaaggaccaaaagcacuuuuccugguccugguucuuuuucucuggagggucaaggacuagggaguaaaccagaaaguauaauggcaagcaguagggaaguuaguggugguagcagcugugauuccugccuuguuucugucugugcaggagcuucucucacccccuuacacaccauggacauuuugagaaaggagaggauuugaagaggucaggaaguaucuuuaauuuacaguuuuuuuuaaugcagaaauauaguuucuaugaugcaguuuagaauacaaccuauuuauuucaucaguugagugccucuaggauguacugugugcuauacuagauacacaagggccagagauaagaaaaauagauucucaaccuuaggaacucucaauuaaggaagcagacacuuaaacaauauagucacauaagggcuuucacuuaaguuuuauagcauaaguauauaacuagauuuggcagugaaugucaaggaacacuuccuagaggaugugaacacugaacugggacuuaaggaauuaggcaaagagaugguguuauaacauuccaggcagacagaggagaaaggcauggugcauugcccuuccccacacccccaggaaaaaaaugcauuuuauuuuauuuuauuuuagacagggucuugcucugucacucaggcuggaguccaguggugcagucuuggcucacuucacccuccaucuccugggcucaagugauccuccugcuucagccuccugaguagcugggauuacaggcgcauaccaccacaccuagcuaauuuuuguauuuuugguagagacgggguuucaccauguuggcgaggcuggucucaaacuccuggauucaagugaucugcccaccugggccucccaaaguguugggauuacaggcaugagccaccacaccuggccaaaaauucauuuuauuuaaugaccaaguauacacacauuuacacauauauaacuaaaacaaaacuuacuaugugggaugcauugugaaauauucugcucuguguucuuucauuuaaaaaaaauuacuggucacaacauaguaaaaaaaauguugcaaaccauuaauauguuacaacccauaauugcccuagagcacuaugaaugcugagcuauaauuuuagggaaaguuacagucuugcuccuuagaauuagcccaugguaguauucuguguauucagaggaaaauaacauaaucuuguuaccauguaugugcccuggacaugguaggugcuuucugugugcuuaaaucaccuaccuucccaggcccuggagauaagagugugacuugcaacuauguaacaggacccuggaucuaucuguguuguaccuuuuauagaaacaacuuuuuuagguacauuauuucaugugauccucacaacagcccugugagguggauggggaaaauaugaucagcuucacuuucuggauaauggaaguuaagguucagagagguuaagugacuuuguugguuaccaacugccuaguaagagacagaggugggauaggagagggcuauuuucuguaaaccacauagcuucugagaguauaaucuaacuugaaauauaaaauacauuuauauaaauuuaccacuucaucauuuucuuuuuuuucacucugucacccaggcugcaguguaauggcauggucauggcucacuguguccgcaauuuccugggcugcagccauccucccacuucagccuccugaguguaacuacaggugcauaccaccauccuuggcuaauuuuuuaauuuuuauuuuuaguagcaaugaggucuugccguguugcccaggcuggucucgaacuccuggccucaagcaguccucuugccuuggucucccagagggcuaggauuauaggcauaagccaccaccuggcccauuugcuuguuguuaaugcagcuuuuuauaggauacaacaaaaaaccuaauucuaaauuuaucaugccaaguuuaugcaucuguaccaaugaaagcuuauagccacagaacaucuguuuuucagaaagugcuguuucuuuggcucuugucuuaaaggaacauaaguaauaugaaagacccuaggggucaaggaaauugaagaaaacugaggaagggauauaaaauggaauguagucacggauuuuagucccuuuaagcuuuuacuuuugugagauggcucaaugauggagagcuuuaaugcagaugaaccuugaagcuuuuaaagaucuaagucuugacgagguuauugaaauucaaaucuucaaugcauugugauaguaggcuauaauuuuugaacacuuggccgggcacaauggcucaugccuguaaucguagcacuuugggaggccgaggugggaggaucgcuuguggccaggaguucaagacuagccuggccaacauggugaaacucugucucuacuaaaaaauacaaaaauuaggcgggcaugguggugcacaccuguaauuccagcuacuuaggaggcugaggcaugagaauagcuugaaccugggagguggagguugcagugagccaagaucguggacacugcacuccagccugggugagggagcgauacucugucucaaaaaaaaaaaaaaaaaaacuugguacuugaugcucucccgaagugcuaggauuugaaugccacaauucauauuguuuuauguuuuuaucuauuacuguuccauggguuucuuuaaaugaaguccauuuuagaguccauaggcaaaacugcuggggauccaagauccaaggcucccaauggaccacccauugcucuuuuucucaagcuuucuuuguacuuuauaccucaaaaguacacugcucuuacugagugugguggcucaugcugguaauccuaacacuuugggaggcugagguggaggauugcuugagccuaggacuuugaggccacagugagccaucaucacaccacugcacuccaaccugggugacagagcaagacccugucucuuaaaaaaaaaaaaaaaaguauacugcuguucaauucuaugccuuuucuccuaaguguaagauauaugaucauuaaugagagguuuuaauguuaaauuugguaaaauuuaauaauugaaaaauccuuagcuuauaacugauguagaauagauagaagacuguuuagugaaaccuaugagaaaaaucaaaaggcacguuaaaaguuaaauacuauaaucgaauuuaaauaguaagggaaccagaaaaaaaauucauguuagaaaacaauuguaaaguugucuuuagcauugaucagauuuuuuuuuuuugccauuccccuaagcauacugcucacaugcacaucuuacccuccagugaacucacacagauacuccuguaacaugaaagagaccugagaucaaguaaaaauucauguuuuguguuuguguugaguaucauuaaagguauguccaggcaugucuuuuugugaauacuucgaaguaauuuaucauuuguacuuuucuauguguuuguggaaaggaaauugaccugcgucugguguaguugagaauuuguugggcagcagugcuggguucuacucgugagacugcugcagguggaucaugugguuuuaggcauguggccucaguuucauuugcaaauugaaggaguugcacugaugaucuuaaggcaucuuuggcucugaaguucuguauuuuugcccuuuaucguagggccuuuuuagucugacuuguacuaaugcauaauucgauaaugaggugguaucauggacauccuuuuucucauuccauuaguagugagugugauguauaauauccucauuuccaaaggucauuauaaauuacaagcaucccccacuauucagaucaaucgguucccaaauucagauaguaagagauacauuuacauuaccgaauacaguagcuucucaguuuuguugccauugugaaggaaugauaagguagacauuuccagaugggcacuacuuugauaucugaauauugguuucuuaaauaucuagaacagugaauugaaacuaacaacaacaaagagauaugaaguccuuuacuuuccuuacucuugucccucugcuaaauuuuguuuguggugaugaguagccagcacaacaguuaggagucucuuacugugauggacaaagcuuaguauagaugccuuuuccuaagcuugccuuggaacaaagagauaaauaacuuccuuguaguuuacucacccaguucagagcauuaccaaaacauguaguuugagcagauagaugagaaagcucuacuagauaucaguauaacaaggagcaaagaugguucuuacuguuuacugagagaaauauuuguugagcaccugcuguuugucaguacuguucuaaacacaagcaaggaacaagucagaaugagucccugccuucuguaguuuacauucuggccagucugggggcacuguauuccugagcaggcaucauaugauuggggagagccaagauugucuuuaaagaguggagacaucaguuauuaaaguauagucaugcauugcuuaaugacagggauaccacacauucugagaaaugugaguuuaggugauuuuguuaucgugcagauaucauagagugcacucauagagugugucucggacacauucuagaaaugugagguuaggugguuuuguugucaugcaguugucauagaguguacuuacacaaaccuagguagucuagccuacuacacaccugggccauugcuccuaggccacuaaccuguacagcuuguuacuguacugacuacuguagucacugguaacacaauauuauuuguuaucuaaacauauauaaacauaaagauacaguaaaaauacagaauaaaagauuuuaaaaugguacaccugugaagggcacuucccaugaauggaacuugcaggauuugaaguugcucuggaugagucagugagugaguggugaguaauugcguagaccuaguacauguauacuauuguagacuuuauuaacaccguacacuuaggcuacgcuaaauuuauuuugaaauguuucuucaauaauuaaccuuagcuuguaacuguuuuacuuuauaaaguuuuuuuuucuaaaaacuuuuugacucuuuuaugguaauacuuggcuuaaaauacaaacacauauagcuauacaaaaauacauucuggccacauacaguggcucacgccuauaaucccagcacuuucggaggccaaggcagguggaucacuugagguugggaguucgagaccagccuagccaacaugguaaaacccugucucuacuaaaaauacaaaaauuagcugggugugguggugcacgccuguaaucccaccuacucaggagacugaggcaggagaaucauuugaaccugggagguggagguugcaaugagaagagauggcaccacugcacucuagccggggcgacagagcaaggcccugucucaaauaaaugaauguauauucuuucuuagccaggcacaguggcucaugccuguaaucccagcacuuuuggaggccaagguggagggauugcuugaggccaggaguuugagaccagucugggcaacauagugagaccucgucucuacacacacacacacacacacacacacacacacacaaaguuuuaaaauuaacuggaugugguggcuccugccucuagucccagcuacuugggaggcugagugggaggauugguugagcccuggaauuugagguugcagugagccauaaucacaccacugcacuccagccugggccauagagugagacugucucaaaacacagacaaaaagacacaaaaauauauuauuauuuucuuuucuuuuuuggaagacaggguugcucugucacccaggcuggaguacaguguugcaaucauagcuucacugcaggcuugaccucccaucucagccucucaaguagcuggaaccacaggcucaugccacuaugccuggcucacuuuuuuauuuucuguagaggcagggucuugccauguugcccaggcuggucucaacuucugggcucaagcaguccgccugccauggccccccaaagugcugggauuacaggcaugagccacugugcucagcuauauucuuuuuaaaauaucuuuauucuauaaccuuuuccuacuuuuauuuuuuuaacuuuuuuauuaaaaacugagacacaggucacaaacauuagcuucagcccacacagggucgggauuauccauaucacugucuucucccucugcaucuugucccacuggagcgucuucaggggcaguagcaugcauggagcugucaucuccugugauaacagugccuuccucuggaauaucucuugaauaaccugccuggggcuguuuuauaguuaacuuaaaaaaaaguagaaggaauauacucuaaaauaacaguaaaaaguauaauauaguaaauacuaggcaauacgaauuuuaugaaguguauguccagcucuguuauaaucuuauggaaccaccguuguuuauguggucugucauugaccaaaacaucauuauacugugaaugacuguccuuuuaauauuauauaucuuucucaagggucuguuuagcaugaucuuucauguauuuaucuccccauuuuguuuuguuuuucauauuuuguuucuguuaggagagaacauugaaaguauucucuaagcuauuugaagagagugacuaaaugcaccugggucaggcugucuguggguaugaagugguugggagaauccaagaucaugguggugaauggcaggagaaauggaggcaaguugucuaaugaccaucagcagaaucaaucaaaauuacagcacacggggaaggacacccugaaggcuggcaaaaaugcagucgagaggaggucgaacagauguauguacacacuuaaaccuucaauguucugauugugauaugggguaguaauucuuuccaguuuguaauguguauucuguuuucuuuugucuuaaauaauuuuuugcauuuucauaauuaacaauauagucuuuuuacucucaaaguugugucaauuuuuauucucaucaaacuauauaaaacucaaguuuaaugcuucauauaauuauuuuaaucaugcuuuucugucuguuacuuuauauuuuguagaauuuaccugaaugguugauaugucuuacuaaauuuuuaaaauuuuaauugaacuucuuacagguuaaccuguauuuuuuuaauagauguaaguauagguauguacuucuuugcuaauuuccacaaauguuucauggaauaauaugaauaaugacgccaacuguaauuuacauaaguagaaugaggauagauagaacugacugcuuuagggcagccucacaaaucauagcaauuuauucuauuuauacaggguagacaguuguucauccugacagugaaacacugcugauaaguuacuuuauuuccucuauaccucuugauaggaaagaggcugcuuuuugagaguucaggaaguuguagauuuggugcguauuucauaguuccucuaaaaguaguaaaaugacugaggacaaguguauaccuaacuaggcagcuauauguccaaacguaugucauguuaaagaggacagcuuuucuucuuuuucuaacgugaaucuagccaccuuugaauauccuuaauucagauuggcauuggccuguuuccagggauuuggauuagccugggauuuucuguaguuucagauuguacaaguucugauagauuuccuucuuaccuuuuaggguuuaugcgauucauugggcccaggcuacccuuaaccuuuccauuucagaucaggucacuguugcuauagaaaaccagacagaauuccugcuugggacaagaguaggaagaggcaagacugaaugagugguccucugcauggacaccacucacuccugaggcugcuggcagcauguacccucauccugccucacuccuuagcagcuagugugaacgugaagaauugagaaauauagugaucacaucaguguguauucauucuggucagcaaacuaggcauaucuuaaguuuuuuaggaaaucacuguuggccuccuuuuguguaucauagugcaaaacaguuuuaauuaguugaauuauuauagauacacaagaauuuagaaaaugcgucugggcgugguagcucacaccuguagucccggcacuuugggaguccaaggcgaauggaucugcuuaaguccaggaguuugagaccagccugggcaacauggugaaacccugugucuacaaaaacuaccgugucuacaaaaaaauuagccaaucaugguguugcaugucuaugguuccaacuacuuugagaggcugugguuggaaagaucacuugagcccaggaguuagagguugcagugagccgagaucacaccacugcacuccagcaugggcaaaaaaaaaugagacucuuguuuaaagaaaaaaaaaaagaguuuagaaauggccauuacgggccgggcgugguggcucacgccuguaaucccagcacuuugggaggcugagguggguggaucaugaggucaggagaucgagaccauccuggcuaauacggucaaaccccgccucuacuaaaaauacaaaaaaucagcugggcgugguggcaggugccuguagucccaacuacucgugaggcugaggcgggagaauggugugaacccgggaggcagagcuugcagugagccgagauugcgucacugcacuccagccugggcgacagagcgagacuccaucucaaaaaaaaaaaaaaaagaaaaaggaaaauggccauuacuuugguuacacuuuaccaagcauagauaaauauagagggcuagguugggaaaacccagugugugaagaugacauagccuuacauugaauguuauugggccagaauggugcagaaagagagccagcaaugagaaaugggagagcacagagcagugccccaucucagauacaaucagugacuuucccagcagcagagccuuaagauacaggaaagaaaaacugacaaaauugaagggaaaaaucaacaauucagcaauaauuuggagacuuugauacgccacuuuuaauaauggauagaacagcuuaagacuauaaaccaaugaggccuaacagacaucuauagaaccucaucagaauacgcauucaucucaagugcaagugcagcauuccaggauagaacauaugcuagaccguauaacaagcuuccauaaacuucaaaggauugaaaucauaaaagguauguucugugaccccaauggaggaaaauuagaaauuaacaaggaaauuugggaauuucacaaauacauagaaaugaaauaacacacuucuaaauaaucagugggucaaagaagaaaucaaaaaggaaaucagaaaacauuuugaagugaauuaaaagaaagauaaaacauacuaaaacuuacaggaugcagccaaagcggugguuuagagggaaauuuauacuuguaaaugccugcgugaaaaaaagaagacugggcgugguggcucacgccuguaaucccagcaguuugggaggcugaggcaggaggauggcuugagcucaggaguucaagaccagccuggacaauauggcgagaccccacuuuuacaaaaaaauacaaaaauuaaccagguuugaugaugcaugccuguggucccagcuacuagggaggcugaggcaggaugauuccuugagcccaggaauucgaggcugcggugagcugugaucaugccacugcacuccaggcuggguggcaaagcaagacccugucuucaaaaaaaaaaaaagugaguugugucguaugugaauuguauuucaauaaagcuauuaugcuguuaccaaaaauuuaacaauguugauagcuuuucacauaccuacaugcaacuaauuugauugcaaaaucauaugucuacccuuggcaggaacuuacauuuaaguauuuguucugugaaagaguggaugaaaagguuaaacuuuacucuguguuucauucuuccccauuuugguuuugagagccugaaaguuacauugcuguuguccuccauaaaugaugugcugauuccauggaaggacugucaguggcauauacaucaaacuuaaucagcucugaugaaacuucuuacaaacuuggccuucauuuccuucuuuacauugcuuuucuuccacaguuaaacccaguuauuucaguuauauauuucagucuguauuuuuauccauucguucauaauugcuucaaacagaggucaguagaaauaggucugucauucucucuccacuucuuuccccacuucuacugcccagcucuggaauugugggcaaguuucuuuuugucugggccucaguugccugcaaaguggggauaauaaucauucaccugcccuaaagcaggaagcugaacuucaugagauuccuuuugauacuugagaucuggaguucuggcgcuucuugcagaaacuaucuuguguuccucuuuccuuuucagucgaguccuaucuguaauggcccuguguauugucuuguuaaaauagugaacaugcucccgucccguuucucaguguuccuuggagagaagggggugggggagagucaagcauuugaaccaaauucucacgacuacccagaccccauucuugggaaccugcuauuacuaccugcuaacgauaauacucucaguaauggagauaguuuacugcauuugguuuucugucuuaugcaaagguuauuaaauucuuaauuacuaaaaugauugauuuuucaguucuuuauuaccagcuugaaugggcaaugccgcuaaagauuuuaaggcagauuuaaguaguuuucaauuugaguaauuuuucuugcuuuugcuuuucacagguaaugguaacucgggauuugaaggacagagucgcuauguaccauccucuggaauguccgccaaggaacucugugaaaaugaugaccuagcaaccaguuugguucuugaucccuauuuagguuuucaaacacacaaaaugaauacuagguaauuuucagucuuuauccugaauggaacagaugauuauguugaauucaagaacauagauggcuaauuuuacuuuugcucaaaauuuaaaaugacauuaaaggaaaguucuuugcaguggaaggguuuucugucugugagccaagagaagcagagaaaagacuccaggaaucuugucaguucuaacucuguguucuuauuuuaccucagaacauuucuauuaacguauaaagcuggaggagcauccucauguucuauuuuaaaaguugaugaugccaggcaugguggcucacgccuguaauccccacacuuugggaggccaagguggguggaucaccugaggucaggaguuugagaccagccugaccaacauggugaaacccugucucuacuaaaaguacaaaaaaaauuagccaggcagguggcacaugccuguaaucccagcuacuugggaggcugaggcaggagaaucacuugaacccgggaggcggagguugcagugagccgagaucgugccauugcacuccagucugggcaacaagagcgaaacuccaucucaaaaaaaaaaaggugaugacaauuaucuuagcgaaaagaaaaaucugacaagcauccuguaacaccuugaaaguguaugauuauuuccaaccuaaaguaggguacaucccuuuuuuucaugauuuuauuauagacuuuucucuuacacguugucucuguauagauggggaauuuugucaucauguuuaaucuuugggauucagcuaauuauuuaagagcgaauaguuuuaaagacauguuuauauucaguaugcagguaagaaaguggauguguaaguguuuugaguaccaaaugcuguauauaaaaaacauuauuacauuaaucuugaaaucugucaucuuuuaacagcugaggucucucuuuaauucucuuaaauaccauuucucccucaaaaaagaccauuagaucauuucacaaauguaucugccaccaaacaggucagagcuuugcaacuuugcuuugucucuuaaccucuauggcaaaggguuuuuuagccugguggaaaagcauaacagcagggauuuagaagauagagcuaguucuggcccaucacuuucaucuccaucacacccggacugggguuauauaguucugauuuuaguggcaacccugggggaacuugauacccagguagguggucacugaucaguaguugggagagguaggaauuggugaguacagguaauuagaggaaagucuuguguccuguuuccccccuuuuaauuuuaucccuugcuagaauuaagauacuauaugccucacuuaucaauuacagucuaaauccaaaagaaguaauucagguaaaaauaugcuuuuguuuuuuucauaaauuuuuuuuucuuuucuuuuuuagauggagucucacucugucgcccagacuggagugcaguggcaugaucucagcucacugcaaccuccaccuucuggguucaagugauucuucugccucaguuucccaaguagcugggauuacaggcgugcaccacugcacccagcuaauuuuuguauuuuuaguguagaugagguuucaccauguugaccaggcuggucuugaaacuccugaccucaggugauccaccugccucagccucccaaagugcugggauuauagacgugagccaccaugucugaccauaaaauuuucugucauauaucuuuaccuacuaaaaugaagugugaaauauuggaauggaguugggggauuauuuaaacaguucccugccaaaugacugccauuggaugcccugauugauuaagauccaggcugggcgcaguggcucaugccuguaaucucagcacuuugggaggccaagcuggguggaucaccagaggucaggaguucgagaccagccuggccaacaugaugaaaucccaucucuacuaaaaauacaaaaauuagcugggugugguggugcacaccuguaguccuggcuacucaggaggcugaggcaggagaaucacgugaacccgggagacagagguugcagugaaccaagaucacaucacugcacuccagccuggguaacaaagugagacugccucaaaaaaaaaaaaaagauacaggacugggcaugguagcucaugccuguaaucccagcacuuugggaggccgagguggguggaucaccugagcucaggaguucgagaccagccuggccaacaugcugaaaccccgucucuacuaaaaauacaaaaaauuagcugggccuggccacaugcgccuguagucccagcuacucggaaggcugaggcaggagaaucccucgaaccugggagguggaaguugcagugagcugggaucgcgccacugcacuccagccugggcaacagagcgugacuccggcuaaaaacaaaaaacuaauuugcauuauuuuaaguccauuuucuuuucuuuucuuuuuuuuugcccauugaacaugagaccagugcucauucuccuagaagaugcugauaauauuugucacccuguagcacccccaguguuuuucuuuguuuuuuuuuuuuuugaguuaagaaaugugaaugugugaaugaaucacucuuugacacaguagucuaguggcauucagaaugucaccacaaaggcccagaaucuugaccuggggucaucaagaaaguuauauugauuaugccuuauuaccaagauauggaagcauauaaaacagcguuacaucagaauuacaaugggccaggugcgguggcucacgccuguaaucccagcacuuugggaggcugaggugggcggaucaccugaggucgggaguucaagaccagccugaccaacauggaaaaccccgucucuacuaaaaauacaaaauuuagccaggcgugguggcacaugccuguacucccagcuacucaggaggccgaggcaggagaaucgcuugaaccugggaggcagagguuguggugagccgagauugcgccacugcacuccagccugggcaacaagagcgaaacucagucucaaaaaaaaaaaaaaaaaauuacaaugaaaguuuuaguggcuuaugacagaacuucauguacucuaaaauccccgugccguauuccagaaggcugccuguuacuggcaucuucaauaguaaauacuccaguuuucugcugcaguggcucaugccuguaaucccagcacuuugggagggcaaggugggaggaucacuggagcccaggagcucgaggcugcaaugagcuguauucauaccacugcacuccagccugggccacagagugaaacccuauauuaaaaaacaaaaggaagcacuccaguuuucuguaaaaguccuccuauaccauugcuucuuauaauuaguuuacaugagagucaccugggaguuuguugaaaugcaggcucugauucaguagcuuugggguggggccugagauugugccuuucuaacaagcucccagacuacacuuggaauagcuagguccuaaaacaucuggccucucaguuucauugugacgugcuaaguggauaaaaauaccuuacuaggaguuuccuagggcucacguaaaacuauguagucauaaauguaaacuucaggauuaccacacaaauauuuuuggaacucaagacauuaacugaggacuccuaaguuaaaaugcacccagugccuaagauuuuuccccauagaauugaagcaucuaaaauuaaagcugguuaaacuugcagaagaaaucauuuuuuaaguauuuuuuaguccaacauuuaauuauacaguuccuaaaauaaccuguggaaguacagacgauucuguugcccugguuagagcagccuggguuccuagcaaugccagcacuucaggccggugugggagugcaggggacggccugccuacuucccaccagaguguuccguuuacgugugcuuuuacacucuuguguacacugauauuugggaacagaaacuuuauuaaugaccuuuacaauaaucuuggugaaagguauauguuuucaauuaaccuuagugaauuuacuugaaaauaaaacuaucccuucuagcucuucaucuuuugagcaagaauuuaccagaaugugacuuuagaaaauaaggaaaacugauaaugcuuaauuaagguaguaaauagccaauaaauacuucuuaaauuguuaguuuauggacuucucucucuuuggggugcaaaagaagugaccagaagauguacugcucuuggauuuuaauuuucuaagcucucugccuguuccuuguauagugcgcucuuuguucauauguuuaugcaccuguaauuugucacuuuuuaguuucucuuuuuuauacucuuuucccuuccuuuuacuucuuucagucuaccaacaggaagaauguuuagaaacaguagauguuuagcccgggcgugauggcucacgccuguaauuccagcacuuugggaggccgaggcggguggaucacgaggucagguguucgacaccagccugaccaacauggugaaaccccgucucuacuaaaaauacaaaaauuagccaggcaugguggugcgugcccguaaucccagcuacucaagaguuugaggcaggcgaauaacuugaaccugggaggcagagguugcagugagccuagaucacaccacugcacuccagccugggcaacagagugagacucuaucuccaaaaaaaaaaaaaaaagaaaaaagaaagaguagauguuuaaugauuggagaauuuucaaaacuggcuauguuuugagugcacagguuuuaaucuuaauauauccuuacauuuacuaacaagcaagaguuguagcaugaauacuuagaaauaguacgaacaaaaugcuaauuucaauuuauugggagaaauuugaacuuaauugacuuuugucaauuaugaaaccuaaaguuuucuuuuuaacaagaaaaaaagaguuguuguuuauaccucugguuuuuaaauggagugggagcgggauauuuuaagaaagggaucgaugcuuucaguaaugcccccuuuuugaggcugcaugacccugagaugucacaguauccugaggcgcgaaggcgacucaggccagcagugagcugagcaggagacagcauuuaaacaucaggggagucacuucagggcacugaguuucucuuuucaacuuuucuugguuuucuaaucagaaugucagccuguacaguccuuacucauuuuucuacuguuauaaccaucuaauuuuuauuucacuuuuauauguauuugauuauucauauccacuauuggauaugaauaugaaucacuuuaaauaucauuuuaaaauuaagugcuugacuagaauccguaaagaauguuuucaaagcuucuaacuucaugguaagguguguucuaugggaagcagagaauuucagcagcauggcuucuauccugccgcgcccaccugugguaucuuaaaguucuugauuaucacagaguuuuaaagauuuuugcaacaacgaauauuguaagucuguuuagaaauuacaaguacagauuauacaaauagcuuuuuauuuuuguuguuuguuuuugcauuuauauagcgccuuuccuucgaggagcucaaggcauuuuucaaaaucugacaguuuuucucacaacaacccugugagguagguaguguguguuaaaaacaaugagauacugacuaacccauucuagccuuuuaaaauguucuuuuauguuaaguaauuugaagugucagcauaaauuagaguuuuagaacauuuuacaaaccuuuuaaaguaguuugauaauaguuguauuuuuuaaaaaaccacuuguacuucauaacagggugauuuuaagagaaacaaaucauucuucaaaagaucaggagucacuccaugugauuagcugagcacugauugcaggacucagccagguauguuuuugguucucguuuauuuucaggucaagaaggacugaagagcugaucugcgacuccucacucagcgucuacaaacuguggauuugcagcuaaacuuucuucagagggggaaauguguucacuauguugccucaugguuuuauuuuauaucuuaaauauuugagcauuuuucucucuuccucucuccuucccugucucccuuuuuucuguuccccuuccuguuccccaccccuccagucagcucuugauugugcaugcuaaugaagggcacaguagcacagcuaauacagucuacaacuuuucuucacugccacaguggggagacagaaaaaccaaauagcaagaaaaccugggaagugagucucuggaaagaguggggaacaggugugugggagugugaauucauauguuuuuuuccugccccuuuaauaauaaucaauuguaaaugacauuuuuauuuuucuuauaccagccauugauuggaaguguaaaaagagaaaaaauagauauguuugguugauuuaaaguagcaaauuuucuauuaagggagggaggacggggcauauugguuuggaaaugccaaauaacuguuuuucuugccucccuugucacccacccccccacccaaauacgaaauuuuaaaauucacauuugcguccaucccuuccacuguauugucaguauacaagcuagagcugucucuggcugggcccagugcugauguucaauggcaaacgcaagucaaauccucuucuaaccaugaaacaaugugaggaaggcucuccugagccaggugauauaacaggaaccagaaaggccaggguaaaucccaggucuuccauucauuaacccuaagucauuggcaaucuacucagccuuguugggccuuauuuuccucauuuguggaacaaaagggcuguucuaaauuaucuggccuuuaagugucagaguaaaaggauaguuuuaugcaguuuguaugggagauuuagagugauuauaguuaaggagagaggguauuuuucuguucaauaauaggaaaaaaaaaaauuucccuaagguuuucagugcauuugcaccagcccuaauagguauaacagucuuaacuuuuauuuuccacaguauuuguuacaaugggauuugauuuggacuaucagccagcugacuuuuacauacuucuguaggauuauugaaaacaacugucucaucuccugccugucugcacccuuaaccauuuucuucccccuuuuccuuacugucauuucaugcccauagcagccaacugugacaguaaguuuuaacagguuugggacagcaacuuauauuuuuagugaaauagagguucuugcuauugguagcaagggauaguuucagggguuuuauuuauguuugaggcaauaaagucaggaaagcagaaacagaagucaacacagggaagguaggcagaauacuacuaaaucaagaguugacuauuuuguguugguuuuagcauguaaauuguuuggcauuaugaauaaaaaguaaacaaaaccaagguuaccugaaggcauuuuuagauaggaaugaacuuguuucagaaagcauagaacacacauaaagccuauuaaaaauagccaaguuucauuccaggucuauaacuuacuuuuguauaauguucccauuggucacuuucacauugaacguguaaagauagcuuggcccuuucugucguuuguagcccugucauuuaacggcauggauaauuuauugcauuugcuuaaagugaacuauugcuuuucugauugccacacaaagcacggguuaucuguuucccaccauuucauauuucauauuucauauugcucgacaggucaugccuuagcugagagcugcuuuguugucuuaucuguccuucaugugcaaauaaccauguaguguaggauugcagcaagaaugguuuccauuggauuucuuggagaugguaucuugacacaaucaauugugauggcuacaaguaguugaguauggauauuuggaugcuuucccaauucuacagcucuuuauuuucauggugguucucugacaccauaugucgacagacuaguaagacguucugaauuguuuaaaggacuugcauuuaucugucuguaaaggcuuguauaccaauugauugaaaauggaaaauagggcccuguucauuucuucaguauuaucucuaggauauguuugaacuuucagaugguucagcuaauaguugugagaauucaggauuacugaauuaaaaaaaaaaugacuagaguguguagcuaguaaguuccugguaguaucaguaugcauuaauacaccugaagucuuccagugauccuguccaguaaacaguauuauaccuguucaggaccucaugucuuuccucuuccugauucugguacuuuacuuuauuauugcuaccuagcugacccuggucaacucuuugaauccagcuugauuaagaucuucugcuuagacuuccccucauucuuccuuccuuuugauucuuaccugcuuauaaugugcuuuucuuaaaccuuucccauguacauuuugcacccuaguuauaauuucuauacuuuuaggugcuauagcaaugcaguuuuuagcauauuaacaugcauuugcauauugaucacuugcuuaacuguuugaugcauauauaugucuuuuagucccaauuaaauuuuccauucaagaacaguggccaugucuucucuuguauuuuucaccauagcacuucauaugccacuguauacacaacacagcaccuaauaauccuugaugaaauacuguggcuugaaaucuuacugaaauacuaugaauacauauaugauagcuucucuaggaaaaaaaauucugcugaaugcuuccuuugcuggaguuugugcuagaucuuaccucaauuuuagcauauucagguuuaugaaauguacaauuuuaaaugucagaguaagacacauaaagauuuuuuucuccugaaccacuaauauuuuuucuuaauguauuuuauuugaauggcaaucggugauuccuuuuuucuguuggacguuuuguuuuguuuuuuugauacagagucuugcucugucaccaggcugaagugcagugacgcgaucuuggcucacuccaacuucaacucucgaguucaagcaauuccccugccucagccuccugaguaccuaggacuacaggcguguaccacuacgugggccuggcuaauuuuuugcauuuuagagacgggguuucaccagguuggccaggauggucucgaucuccugaccucgugauccauccgccucgaccucccaaagugcugggauuauaggugagagccaccauaccgggccauaauccgguuagaauuagcuuuaugaaaauaaaauaaaacuuuuuuuuaaaauaaaaacuuuauuugggagaauuagcuuuaugaaauugacaugaaaagaaaauuugaaauuaagaugcuaguaacuuuauaguacacguuuuacugaaaacacagcuuuagaaugagggguucacaaauuugucuugcuugggccaugacugcaucaugcauaaauacagaccuaaugggauaauauucugaagacaucaguguggcugauucuacaauggaagccuuuucaauucuaccccugcaggccaggcgcaguggcucacaccuauaaucccagcacuuugggaggccaaggugggcagaccacuugagguuaggaguucaagaccagccuggccaacauggucucuacuaaaaauacaaaaauuagcugggcaugguggcgcacgccugucaucccagcuacaugggaggcugaggcaagagaaucacuugaacccgggaggcagagguugcagugagccaagaucacaccacugcacuccagccugggccacagagugagacuccaucucaaaaaaaaaaaaaaaaaacaacucuaccccaucaguuuuccuacauuaccaguauagcaauuucaccacuagaguuaacacugcuuguacucguuuuguucucugaaugcagucaucaaagaugacuuugacaugggugguuagaacaucaagguguguuucgaagccuguuggaauacuuaguuugggguuuuuucugacuguguacauaaagaauguuuuuguguauggcaugguuuuguuuacaucaucauacuucugaaauucauugccuggcacucuuccagcuugauuuugcauguuuuaaaaagauucuugucauucuaacucuaaauuaggugugcuguauucuagagcuuugauuuugugucucccaaaguugacgacuaguguaagucugaaucagacagcuuuuguuugaaucgucugcucaccucacaguuaaugagauaacagugaaauaaaaauaauuaaaauaacagauugaaaaaagagaaguuacugagauaacagugaaauaaaaauauuaaaauaacagauugaaaaaagagaacuugcguauccaggugaucaguauuacuugaauaguaguaaucaagacuauugauuguuguucucuucucuuagaucuuugcucugauaaccauggcuguuuuuaggguauuagcucuuucucaagaucuguuaagauggaucaguggcgcaaggauuguggcagauaacccauucauucuuuugauuucuuucagauuuaggccuauuaaaggaaggcaggaagaacuaaaggaaguaauugaacguuuuaagaaagaugaacacuuggagaaagccuucaaauguuugacuucaggcgaaugggcacggcacuauuuucucaacaagaauaaaaugcaggagaaauuauucaaagaacauguaaguuuauuaagacugaugcuguuaaccuauuuggauaagaauagugaaguaaauuaaaacccuaaauguuaguuaauacugaaauuuuaaauuuauuuuucauaaaacuaaucagucugaagaucuuguaacacauacagucauuuggaugacaguccagagaaaaaacugggccaggcucaguggcucaugcuuguaaucccagcacuuugugggggcuaagaugggaguauugcuugaggccaggacuucgagaccagccugggcaacauagcaagacuccaucucuaaaaaaauaagaauaaaaaaauuagcuaggcauaguaguguguaccuuuguaguuuguaguuccggcuacucaggaagcagagccagaagcauugcuugugcccaagaguuagaggcugcucugagcuaugaucaugccacugcgcuccagcccugggagacagagcaagacccugucucuaaaaccaaaaaaggagagaaaacuuugucauauagaggugaaauucauuaugagccuuaagggaaacaagccauuagguacucauacagagugaguacccuuaaccccaaaauuugaaaugcuccaaaaucugaaacuuuuugaacaccgaccugacacucaaaggaaaugcucaugggaggauuuugaauuuuuuguuuagagguguucagcuaguuacuguaaugcaaauauugcaaaaugagaaaaauugugacauucaaaacucuugaguaacaauaaaguuuguuaccuaaugaucuuacuuuuuuuguuuauuuuauuguuuuuuuagaggcagaaucuugcucugucacccaggcuggagugcaguggccugauuauggcucacugcagcuuccaucucuugggcucaagugauucuuccucucagccucccacguagcuggcacuaaagguacaugccaucaugcuuggcuaauguuuuucguagagacagggucucgcuauguugcucaggcuagaucuuacauuuuuuucaucauugcgggugguuugcuuuuauaauuguaagaaagucuagcaggguauaccauuuaaagucauuaucaauuuuuuuuuccuguuuuagguauuuauuuauuugcgaauguuugcaacugacaguggauuugaaauauugccauguaauagauacucaucagaacaaaauggagccaaaauaguugcaacaaaagagugguaacuauucuacuaguauaagccuuuaauuuaauuuaaaguucucuucuaaauuauuguugaagugcugagaaauucaugguaaggaaugaagccagaguuuacccugaaguagccaaugcaucgccguugccuuggcccaucagcuggagucagaguggggaaaucggaagucucaguugaaccagaucccaucucuaggccaaauugcuuuucauuuuccuuuauugacucuggaugccuguucagugauaugauugcugaagaguuguggauaccgugauuagauaaccuggcuuccacagucagucuucuacuggccuagaagaaagguuggggcuaaaguuuuaaugauccuaguuuuauggguggaaaccucccuaaagcauuaguugcuuaaaaauacauacauacagauauauauauauguauauaugccagcuucaauaaaaauaguagaguugguggggggcauuggcucacgccuauaaucccagcacuuugggaggccgaggcaggcagaucacuugaggucaggaguucaagaccagccuggccaacauggugaaaccccaucucuacuaaaaauacaaaaauuagcugggcgugguagcacacaccuguaguccuagcuacucggguggcugaggcaggagaaucacuugaacccaggagacagaggcuauagugagcugagaucgcgccacugcacuccagccugggcaauagagugagacucuaucucaaaauuaagucagaguugagcccagcuaaaagggauaaaaguuacagaugaaagagaauauacuacuguaucuucuuuccuaucaugccuguucccuauguuaucucccaggaaaaacauguagcuccucauguacccacccucugauauuucuaccacaaaaauuuggggggucagauaucugaaaauggauagguaaaagaacuuuauugccaggccucuggggugaguguguguacaugaaaugugcuucauuuaccucaggauguauugagccugcuaguuggauuauguggcucccuguguugcagauggguguguagguuugagaucuagaguccuagagcuguaccguccgguacaguagccaccagcccuugaguccuugaaauguagcuagucugaauugagaagcgcuguaagugugcuauacacaccagauuucauauuaaauuuuauucccauucauaguucuuauauuaccuacugaaaucguauuuuggauauuggguuaaaauauauuguuggcugggcaugguggcucaucuguaaucccagcacuuugggaggcugaggugggcggaucaugacgucaagaaaucgagaccauccuggccaacacggugaaacuccaucucuaguaaaaauacaaaaaaaaaaaaugagcuaggugugguggcacacaccuguagucccagcuacuuaggcugaggcaggagaaucacuugaacucaggaggcagagguugcagugagcugagaucacgccacugcacuccagccugggcaacagagcgagauuccgucucaaauaaaauaaaauaaaauaaauuguuaaaguaauuucaccuauauucacuuaacuuucucaauguggcugcuaaaaaauuuaagauugaaaauuuggcuugcauuauauuccuagcagauggugugcucuaaagaguggcaccaugauuccggauccucauaacccuuacugccacuggucccugccugcuucauccagcagucagaaaguuuaauucauugccgcaaguauuugaguacuuucugcuugcaaaacaccacaccagggcauucagagacauagguggcauagucccuguccugguugaguuuccauucucuugcaggaauaagauagguacacaaguaaccauggcacaaggcuguggagcuccaggguaggagagaagauagccagguggggaucccagugagcuaacuaaaguauagacagcuaggccuuuucaguuucugauauuuauugucaggauuauuuuauuaaaagaagccuuacuauauuuaauuacuaguaauuuuuaacacaucacauauuuuaaauaggaaacgaaaugacaaaauagaauuacugguggguuguauugccgaacuuucagaaauugaggagaacaugcuacuuagacauggagaaaacgacuucagugucauguacuccacaaggaaaaacugugcucaacucuggcuggguccugcugcguuuauaaaccaugguaagcuguguuuccaagguguuggcgcuaguguuggccauuccugcuaacugcuagaauggccuugucaaccucagucaaaccuuuaucuuccuuuaaaggagaauuugaaauagaaauguuuccacaaacuuauuaaaauaaauguauauuccuuuaguugaacuugagaccuaaacuccuaucaaaaguuguaaaguuauauggaaagcuuauuucagauuucuauaauuguucguguuucagaucuuaucaacaguuaauugacuuuaucuuuuggacauuuuucagauugcagaccuaauuguaagguaagcauuaaaaaaauuuucuucaaguauuuuguuuuugcuucaggugugaguuucuuacugaguuacuuuuauuuuaguuugugucaacuggucgagauacagcaugugugaaggcucuaagagacauugaaccuggagaagaaauuucuuguuauuauggagauggguucuuuggagaaaauaaugaguucugcgaguguuacacuugcgaaagguaagguauuaaguaaaauguucagccuaaacauuuuuuguuaacaaccugauuauggggauuaaacucacauuaucucuuuguuguuuaaaugcagagauagucuuuauguucuuuagcauagcggcuggugcaguguguaugaacaaagucaaaugcugcacagcuauuuagggacauuggaaugucccucaauaaauuuaaaauuucccuuuaaaaucuuaauauuaccagcuaagagugggccagaauacagaugugcuuaaggagagaaugguuaauagcucacacacaugcacacacgcaaugccagaaugggguugccgcuacucaaaaugucaaguggaguucaccacugauagucgucuugcauauuaucaagcugugucuucuggaauuuugguuucacaguucuuaagaguuguucccugauaucagucauucaauaaggaaccucuucuuaugucucaucaagaguccuggagucuuuacagaaaucccccagaucuucauuggcaggaccaccaguucauauugcucauuauagugacuucugugugugagagcaccaugaagggagcgucacaggcucaggcaggcaagggcugcaggaagaguccccucaaaggcaguacagaccacacaggccacagagaaggaaaccuggaguccauuuugcacaucuugcacugugccaggcacuuuacucacaccaccuuguucaguucucacagauauucaugagagagcuaggaggugcccacauugcgaguaccagaacauaaguaucagaccccagucagccuaacuucagaguccucauucuuuccacuucauauugcuuuuggaguuaugaucagaguuauuagugucacuucucccacuuuaaaacaccuacaaauagccagccuagagguugcagugggcagauaccccaguugccauuucccuccuuucuggauagccagggauuuccaacuguguggugagagaggacggagucaucaagucacagugcuaccguagccaucccucucccagcacugagugggcuccuugccauaaagauguggcagaaaaccaguuccuagugcugcugaauuuuuaccagggcagagggacauaaaauuuaucuuuuucuacauaaaaauuauucacauguugguuagaucuuggaccaguccagagaauacccuuuaaaguaguuuaauuauaguucaauaauucuucaaaaucauuuuguagaggaaacaguauaacaguuaagugccuaucaucugaaaucagacugccuggguuggaauccugcaacucugcauuucauuagcuaugugauguguaggguaagucacuuagcugcuuugugccuuaauuuccccaucuguaaaauggggauaacaucagaaccuauuuuguaggguugaugugaaggcuaaauuuguuauuuccuguaaagcauguagaauagcacacaguuaauacacaaauguuaacuacaauaauugguuucugguuauuuucccauuagaauaugagcuccaugaaggcaggggcuuguaucuguuucauuuuccgcuauauccccagaauacagaacaguacccuggugcauaguaaguccuugauaaauauuugguaaaugaaugaauagaguaaauauauauaaugaaguuuuuggaggcgguccugaaaacaccuaaccacauacugaggauuccaaaccaacaccgaaacagcucuuucccugguuuagaacugcagguauagucauuuuccuugagcagauuaguucucuuucaugagccucuguuuucucacuggugaaaaugaggauaaucccaccuacuccacaagguuagugugagaaguagauagaaacguguguaaguccuuuuuaaauggaacagcaugauggagaauaguggccauggcuauugucagacuguuugagcaguuugauuucaagauuggcugcauauauucuugaaguucucauaaacaccaaauuguuucugccuuuacagaaauuagcugggaagaugcaucuaggagcucauuccauuauucauuacauauuaacugaacaguuacuuaauguuaggccaagugcaugcaggauaaacaagaccagcacagugccagcugucagggcaguucagugaaggggacacacacacugugcugagagccagaggguaaaaggaagaggcuccgugaagaagugagaauggacggaaucacgugugcagagacacugagucgcgcuagacacuccaggauacauuugaagcauguuucucugcuacacuguacugacaguaguaauuguaauauguucauaaguacugcacauuuuacucuagaaaauuuaaagcaaaggccacgcacgugugacucacgccuauaaucccagcacuuugggaggcugaggcagguggaucaccugaggucaggaguucgagaccagccuggccaacauggcaaaaccccgucucuacuaaaaauacaaaaauuagccagaugugguggugcgcgccuauaauuccagcuacucaggaggcugaagcaggagaaucgcuugcacccaggaggcagggguugcagugagccaagaucgcaccacugcacuccagcuugggugacacagcaagacugugucucaaaaaaaaaaaaaaaauucuaauaacaaaaagcuccuauaagcuuauagggaaaagacauagucaaauaggaaaaaagguaaaggaaaaagagaugcagagaugcuucacaggaaaaaaauggccauaaaugagauuaaaacaagauuagguauucauuuucacucaucacuuuggcaaaaaguaaaauuuuuuuagacggagucuugcucuguguaaguuucgaucucaacucacugcaaccuucaccuuccagguucacgcaauucuucugccucagccucccgaguagcugggacuacaggcgccugccaucacgccgggcuaauuuuuuuuuguauuuuuaguagagacaggguuucaccauguucaccaggauggucucuuuaucucuugaccucgugaucugcccaccucagccucccaacgugcugggauuacaggugugagccaccaugccuggcccacuuugguaaaauuuaaggaguacaauguaccguugaugaggauguggagaagcaggaacucacaccaugcuagugggaccaugauuugcucuaucccuuuggcaaaguaaucuggcaauguuuauuaaagggcuggacuuuguggcucacgccuguaaauccagcacuuugggagacccagcugggaagaucccuugagcccagcaguuggagaccagccugggcaacauagugagaccccaucucuacaaaaaaaaauuuaaaaauuagcuggugguggugcuacacgcuuauggucccagauacucaggaugcugaggugggacgacuucuugagccuaagagguugaggcugcagugagccaugaucgugccacugcauuccagccugggcgguagagugagacccugucucaaaaaaaaaaaaaaaaggaaaaaauuuuacaagguccaguaguuucucauaggcaauuaaugauugauaauagucauaacaaguuguuuuauuauuuuaaauauagauuuaaaguuaauuuuauaauauagauacuuaauuuccuuugugaguucuagucuucgguuuccaguggugauuaaggccucagcagcucaucacaucuguuaaccuguagccaaguacccucagcaguuaagcuuauuauaagaaaguguguucuauuuguuuaaccugugcuauuuucucuuucagacggggcacuggugcuuuuaaauccagagugggacugccugcgccugcuccuguuaucaauagcaaauauggacucagagaaacagauaaacguuuaaauaggcuuaaaaaguuaggugacagcagcaaaaauucagacagucaaucugucagcucuaacacugaugcagauaccacucaggaaaaaaacaaugcaaguaaguaagggagauuugauaagcauaucuuuuaaaaguauuuucacacaauuugcuuuauaaagugugcuucaguaguuuuaaacuuuuaaauacucagagagacugggacuugugagcuuuggcugcacuucaaggcucuagacgugauuugaguagaggcacagucuguaucccaucucuaacuucaguaccguccucuagacuauuuuucuugaauaccuugguaacuggauaugaguucuucaucauauguuccaaggucaucauauguuuuaaacauuuucaagguguuagagacugugaugaugucgcuaaguccugcaagaagacaaaaggacugaguagaauuaaauuagacucuauacauuccagugccuagccaguuuguuagaaaagaugauggacuuggggaauucauagcuucuggccuuaaggcuuccaccuuuucauugcuugcugaccuuuuucaaaacgaacugacucaguucagcagaccaccaguaccagacucagaauugugauagaggagcauuuugaacagugccguauugugacaugcuguauuggcuacuccagaaaguaggaguaaagauggaaaggagaaagaagcaaccucugagauuccaguggugugugggggcaagaucugauggaaacugaaaaagagaacgaagacuaaacaaagagaaaggaaagagaagaaacccuaaaugggcaaaggaaagcacauccuguuugcggagcuuugaaauauuggaaccauuucuaauugcuccuguuuuucuggguaacaccaguuuucuguaguugccacuaaagcaguagacucuugagucucacuugucucugagagagacagaaguuagaaaguuuugacuuggcgauuccgaaaguaugccuuuguuggcacuuaaauguccagugagacuucuuggcaccuuagagcccucugagauacugauuauuuuagguucuucucccuacuuucagauguuuucagcccaacacugggugcucucuuccacuacagagaauccugaagaaaagggaagguguuucccaugauggugaaugucacugccaugaauuccugaaucuaccugcugcugggagucagaguccaagcauaacccguguagcauaaaagcagcgcuguagcccuauuccagucuuuuucguuaauguccagagugaacaacaagaguuagucaaucauuaacuguugacuguugauucucauaauaaaugcagcauaacgac

SEQ ID NO: 192772 - RNA, 47599 nt, Homo sapiens
gucguuaugcugcauuuauuaugagaaucaacagucaacaguuaaugauugacuaacucuuguuguucacucuggacauuaacgaaaaagacuggaauagggcuacagcgcugcuuuuaugcuacacggguuaugcuuggacucugacucccagcagcagguagauucaggaauucauggcagugacauucaccaucaugggaaacaccuucccuuuucuucaggauucucuguaguggaagagagcacccaguguugggcugaaaacaucugaaaguagggagaagaaccuaaaauaaucaguaucucagagggcucuaaggugccaagaagucucacuggacauuuaagugccaacaaaggcauacuuucggaaucgccaagucaaaacuuucuaacuucugucucucucagagacaagugagacucaagagucuacugcuuuaguggcaacuacagaaaacugguguuacccagaaaaacaggagcaauuagaaaugguuccaauauuucaaagcuccgcaaacaggaugugcuuuccuuugcccauuuaggguuucuucucuuuccuuucucuuuguuuagucuucguucucuuuuucaguuuccaucagaucuugcccccacacaccacuggaaucucagagguugcuucuuucuccuuuccaucuuuacuccuacuuucuggaguagccaauacagcaugucacaauacggcacuguucaaaaugcuccucuaucacaauucugagucugguacugguggucugcugaacugagucaguucguuuugaaaaaggucagcaagcaaugaaaagguggaagccuuaaggccagaagcuaugaauuccccaaguccaucaucuuuucuaacaaacuggcuaggcacuggaauguauagagucuaauuuaauucuacucaguccuuuugucuucuugcaggacuuagcgacaucaucacagucucuaacaccuugaaaauguuuaaaacauaugaugaccuuggaacauaugaugaagaacucauauccaguuaccaagguauucaagaaaaauagucuagaggacgguacugaaguuagagaugggauacagacugugccucuacucaaaucacgucuagagccuugaagugcagccaaagcucacaagucccagucucucugaguauuuaaaaguuuaaaacuacugaagcacacuuuauaaagcaaauugugugaaaauacuuuuaaaagauaugcuuaucaaaucucccuuacuuacuugcauuguuuuuuuccugagugguaucugcaucaguguuagagcugacagauugacugucugaauuuuugcugcugucaccuaacuuuuuaagccuauuuaaacguuuaucuguuucucugaguccauauuugcuauugauaacaggagcaggcgcaggcagucccacucuggauuuaaaagcaccagugccccgucugaaagagaaaauagcacagguuaaacaaauagaacacacuuucuuauaauaagcuuaacugcugaggguacuuggcuacagguuaacagaugugaugagcugcugaggccuuaaucaccacuggaaaccgaagacuagaacucacaaaggaaauuaaguaucuauauuauaaaauuaacuuuaaaucuauauuuaaaauaauaaaacaacuuguuaugacuauuaucaaucauuaauugccuaugagaaacuacuggaccuuguaaaauuuuuuccuuuuuuuuuuuuuuuugagacagggucucacucuaccgcccaggcuggaaugcaguggcacgaucauggcucacugcagccucaaccucuuaggcucaagaagucgucccaccucagcauccugaguaucugggaccauaagcguguagcaccaccaccagcuaauuuuuaaauuuuuuuuuguagagauggggucucacuauguugcccaggcuggucuccaacugcugggcucaagggaucuucccagcugggucucccaaagugcuggauuuacaggcgugagccacaaaguccagcccuuuaauaaacauugccagauuacuuugccaaagggauagagcaaaucauggucccacuagcauggugugaguuccugcuucuccacauccucaucaacgguacauuguacuccuuaaauuuuaccaaagugggccaggcaugguggcucacaccuguaaucccagcacguugggaggcugaggugggcagaucacgaggucaagagauaaagagaccauccuggugaacauggugaaacccugucucuacuaaaaauacaaaaaaaaauuagcccggcgugauggcaggcgccuguagucccagcuacucgggaggcugaggcagaagaauugcgugaaccuggaaggugaagguugcagugaguugagaucgaaacuuacacagagcaagacuccgucuaaaaaaauuuuacuuuuugccaaagugaugagugaaaaugaauaccuaaucuuguuuuaaucucauuuauggccauuuuuuuccugugaagcaucucugcaucucuuuuuccuuuaccuuuuuuccuauuugacuaugucuuuucccuauaagcuuauaggagcuuuuuguuauuagaauuuuuuuuuuuuuuuugagacacagucuugcugugucacccaagcuggagugcaguggugcgaucuuggcucacugcaaccccugccuccugggugcaagcgauucuccugcuucagccuccugaguagcuggaauuauaggcgcgcaccaccacaucuggcuaauuuuuguauuuuuaguagagacgggguuuugccauguuggccaggcuggucucgaacuccugaccucaggugauccaccugccucagccucccaaagugcugggauuauaggcgugagucacacgugcguggccuuugcuuuaaauuuucuagaguaaaaugugcaguacuuaugaacauauuacaauuacuacugucaguacaguguagcagagaaacaugcuucaaauguauccuggagugucuagcgcgacucagugucucugcacacgugauuccguccauucucacuucuucacggagccucuuccuuuuacccucuggcucucagcacaguguguguguccccuucacugaacugcccugacagcuggcacugugcuggucuuguuuauccugcaugcacuuggccuaacauuaaguaacuguucaguuaauauguaaugaauaauggaaugagcuccuagaugcaucuucccagcuaauuucuguaaaggcagaaacaauuugguguuuaugagaacuucaagaauauaugcagccaaucuugaaaucaaacugcucaaacagucugacaauagccauggccacuauucuccaucaugcuguuccauuuaaaaaggacuuacacacguuucuaucuacuucucacacuaaccuuguggaguaggugggauuauccucauuuucaccagugagaaaacagaggcucaugaaagagaacuaaucugcucaaggaaaaugacuauaccugcaguucuaaaccagggaaagagcuguuucgguguugguuuggaauccucaguaugugguuagguguuuucaggaccgccuccaaaaacuucauuauauauauuuacucuauucauucauuuaccaaauauuuaucaaggacuuacuaugcaccaggguacuguucuguauucuggggauauagcggaaaaugaaacagauacaagccccugccuucauggagcucauauucuaaugggaaaauaaccagaaaccaauuauuguaguuaacauuuguguauuaacugugugcuauucuacaugcuuuacaggaaauaacaaauuuagccuucacaucaacccuacaaaauagguucugauguuauccccauuuuacagauggggaaauuaaggcacaaagcagcuaagugacuuacccuacacaucacauagcuaaugaaaugcagaguugcaggauuccaacccaggcagucugauuucagaugauaggcacuuaacuguuauacuguuuccucuacaaaaugauuuugaagaauuauugaacuauaauuaaacuacuuuaaaggguauucucuggacugguccaagaucuaaccaacaugugaauaauuuuuauguagaaaaagauaaauuuuaugucccucugcccugguaaaaauucagcagcacuaggaacugguuuucugccacaucuuuauggcaaggagcccacucagugcugggagagggauggcuacgguagcacugugacuugaugacuccguccucucucaccacacaguuggaaaucccuggcuauccagaaaggagggaaauggcaacugggguaucugcccacugcaaccucuaggcuggcuauuuguagguguuuuaaagugggagaagugacacuaauaacucugaucauaacuccaaaagcaauaugaaguggaaagaaugaggacucugaaguuaggcugacuggggucugauacuuauguucugguacucgcaaugugggcaccuccuagcucucucaugaauaucugugagaacugaacaagguggugugaguaaagugccuggcacagugcaagaugugcaaaauggacuccagguuuccuucucuguggccuguguggucuguacugccuuugaggggacucuuccugcagcccuugccugccugagccugugacgcucccuucauggugcucucacacacagaagucacuauaaugagcaauaugaacuggugguccugccaaugaagaucugggggauuucuguaaagacuccaggacucuugaugagacauaagaagagguuccuuauugaaugacugauaucagggaacaacucuuaagaacugugaaaccaaaauuccagaagacacagcuugauaauaugcaagacgacuaucaguggugaacuccacuugacauuuugaguagcggcaaccccauucuggcauugcgugugugcaugugugugagcuauuaaccauucucuccuuaagcacaucuguauucuggcccacucuuagcugguaauauuaagauuuuaaagggaaauuuuaaauuuauugagggacauuccaaugucccuaaauagcugugcagcauuugacuuuguucauacacacugcaccagccgcuaugcuaaagaacauaaagacuaucucugcauuuaaacaacaaagagauaaugugaguuuaauccccauaaucagguuguuaacaaaaaauguuuaggcugaacauuuuacuuaauaccuuaccuuucgcaaguguaacacucgcagaacucauuauuuucuccaaagaacccaucuccauaauaacaagaaauuucuucuccagguucaaugucucuuagagccuucacacaugcuguaucucgaccaguugacacaaacuaaaauaaaaguaacucaguaagaaacucacaccugaagcaaaaacaaaauacuugaagaaaauuuuuuuaaugcuuaccuuacaauuaggucugcaaucugaaaaauguccaaaagauaaagucaauuaacuguugauaagaucugaaacacgaacaauuauagaaaucugaaauaagcuuuccauauaacuuuacaacuuuugauaggaguuuaggucucaaguucaacuaaaggaauauacauuuauuuuaauaaguuuguggaaacauuucuauuucaaauucuccuuuaaaggaagauaaagguuugacugagguugacaaggccauucuagcaguuagcaggaauggccaacacuagcgccaacaccuuggaaacacagcuuaccaugguuuauaaacgcagcaggacccagccagaguugagcacaguuuuuccuuguggaguacaugacacugaagucguuuucuccaugucuaaguagcauguucuccucaauuucugaaaguucggcaauacaacccaccaguaauucuauuuugucauuucguuuccuauuuaaaauaugugauguguuaaaaauuacuaguaauuaaauauaguaaggcuucuuuuaauaaaauaauccugacaauaaauaucagaaacugaaaaggccuagcugucuauacuuuaguuagcucacugggauccccaccuggcuaucuucucuccuacccuggagcuccacagccuugugccaugguuacuuguguaccuaucuuauuccugcaagagaauggaaacucaaccaggacagggacuaugccaccuaugucucugaaugcccuggugugguguuuugcaagcagaaaguacucaaauacuugcggcaaugaauuaaacuuucugacugcuggaugaagcaggcagggaccaguggcaguaaggguuaugaggauccggaaucauggugccacucuuuagagcacaccaucugcuaggaauauaaugcaagccaaauuuucaaucuuaaauuuuuuagcagccacauugagaaaguuaagugaauauaggugaaauuacuuuaacaauuuauuuuauuuuauuuuauuugagacggaaucucgcucuguugcccaggcuggagugcaguggcgugaucucagcucacugcaaccucugccuccugaguucaagugauucuccugccucagccuaaguagcugggacuacaggugugugccaccacaccuagcucauuuuuuuuuuuuguauuuuuacuagagauggaguuucaccguguuggccaggauggucucgauuucuugacgucaugauccgcccaccucagccucccaaagugcugggauuacagaugagccaccaugcccagccaacaauauauuuuaacccaauauccaaaauacgauuucaguagguaauauaagaacuaugaaugggaauaaaauuuaauaugaaaucugguguguauagcacacuuacagcgcuucucaauucagacuagcuacauuucaaggacucaagggcugguggcuacuguaccggacgguacagcucuaggacucuagaucucaaaccuacacacccaucugcaacacagggagccacauaauccaacuagcaggcucaauacauccugagguaaaugaagcacauuucauguacacacacucaccccagaggccuggcaauaaaguucuuuuaccuauccauuuucagauaucugaccccccaaauuuuugugguagaaauaucagaggguggguacaugaggagcuacauguuuuuccugggagauaacauagggaacaggcaugauaggaaagaagauacaguaguauauucucuuucaucuguaacuuuuaucccuuuuagcugggcucaacucugacuuaauuuugagauagagucucacucuauugcccaggcuggagugcaguggcgcgaucucagcucacuauagccucugucuccuggguucaagugauucuccugccucagccacccgaguagcuaggacuacaggugugugcuaccacgcccagcuaauuuuuguauuuuuaguagagaugggguuucaccauguuggccaggcuggucuugaacuccugaccucaagugaucugccugccucggccucccaaagugcugggauuauaggcgugagccaaugccccccaccaacucuacuauuuuuauugaagcuggcauauauacauauauauauaucuguauguauguauuuuuaagcaacuaaugcuuuagggagguuuccacccauaaaacuaggaucauuaaaacuuuagccccaaccuuucuucuaggccaguagaagacugacuguggaagccagguuaucuaaucacgguauccacaacucuucagcaaucauaucacugaacaggcauccagagucaauaaaggaaaaugaaaagcaauuuggccuagagaugggaucugguucaacugagacuuccgauuuccccacucugacuccagcugaugggccaaggcaacggcgaugcauuggcuacuucaggguaaacucuggcuucauuccuuaccaugaauuucucagcacuucaacaauaauuuagaagagaacuuuaaauuaaauuaaaggcuuauacuaguagaauaguuaccacucuuuuguugcaacuauuuuggcuccauuuuguucugaugaguaucuauuacauggcaauauuucaaauccacugucaguugcaaacauucgcaaauaaauaaauaccuaaaacaggaaaaaaaaauugauaaugacuuuaaaugguauacccugcuagacuuucuuacaauuauaaaagcaaaccacccgcaaugaugaaaaaaauguaagaucuagccugagcaacauagcgagacccugucucuacgaaaaacauuagccaagcaugauggcauguaccuuuagugccagcuacgugggaggcugagaggaagaaucacuugagcccaagagauggaagcugcagugagccauaaucaggccacugcacuccagccugggugacagagcaagauucugccucuaaaaaaacaauaaaauaaacaaaaaaaguaagaucauuagguaacaaacuuuauuguuacucaagaguuuugaaugucacaauuuuucucauuuugcaauauuugcauuacaguaacuagcugaacaccucuaaacaaaaaauucaaaauccucccaugagcauuuccuuugagugucaggucgguguucaaaaaguuucagauuuuggagcauuucaaauuuugggguuaaggguacucacucuguaugaguaccuaauggcuuguuucccuuaaggcucauaaugaauuucaccucuauaugacaaaguuuucucuccuuuuuugguuuuagagacagggucuugcucugucucccagggcuggagcgcaguggcaugaucauagcucagagcagccucuaacucuugggcacaagcaaugcuucuggcucugcuuccugaguagccggaacuacaaacuacaaagguacacacuacuaugccuagcuaauuuuuuuauucuuauuuuuuuagagauggagucuugcuauguugcccaggcuggucucgaaguccuggccucaagcaauacucccaucuuagcccccacaaagugcugggauuacaagcaugagccacugagccuggcccaguuuuuucucuggacugucauccaaaugacuguauguguuacaagaucuucagacugauuaguuuuaugaaaaauaaauuuaaaauuucaguauuaacuaacauuuaggguuuuaauuuacuucacuauucuuauccaaauagguuaacagcaucagucuuaauaaacuuacauguucuuugaauaauuucuccugcauuuuauucuuguugagaaaauagugccgugcccauucgccugaagucaaacauuugaaggcuuucuccaaguguucaucuuucuuaaaacguucaauuacuuccuuuaguucuuccugccuuccuuuaauaggccuaaaucugaaagaaaucaaaagaaugaauggguuaucugccacaauccuugcgccacugauccaucuuaacagaucuugagaaagagcuaauacccuaaaaacagccaugguuaucagagcaaagaucuaagagaagagaacaacaaucaauagucuugauuacuacuauucaaguaauacugaucaccuggauacgcaaguucucuuuuuucaaucuguuauuuuaauauuuuuauuucacuguuaucucaguaacuucucuuuuuucaaucuguuauuuuaauuauuuuuauuucacuguuaucucauuaacugugaggugagcagacgauucaaacaaaagcugucugauucagacuuacacuagucgucaacuuugggagacacaaaaucaaagcucuagaauacagcacaccuaauuuagaguuagaaugacaagaaucuuuuuaaaacaugcaaaaucaagcuggaagagugccaggcaaugaauuucagaaguaugaugauguaaacaaaaccaugccauacacaaaaacauucuuuauguacacagucagaaaaaaccccaaacuaaguauuccaacaggcuucgaaacacaccuugauguucuaaccacccaugucaaagucaucuuugaugacugcauucagagaacaaaacgaguacaagcaguguuaacucuaguggugaaauugcuauacugguaauguaggaaaacugaugggguagaguuguuuuuuuuuuuuuuuuuugagauggagucucacucuguggcccaggcuggagugcaguggugugaucuuggcucacugcaaccucugccucccggguucaagugauucucuugccucagccucccauguagcugggaugacaggcgugcgccaccaugcccagcuaauuuuuguauuuuuaguagagaccauguuggccaggcuggucuugaacuccuaaccucaaguggucugcccaccuuggccucccaaagugcugggauuauaggugugagccacugcgccuggccugcagggguagaauugaaaaggcuuccauuguagaaucagccacacugaugucuucagaauauuaucccauuaggucuguauuuaugcaugaugcagucauggcccaagcaagacaaauuugugaaccccucauucuaaagcuguguuuucaguaaaacguguacuauaaaguuacuagcaucuuaauuucaaauuuucuuuucaugucaauuucauaaagcuaauucucccaaauaaaguuuuuauuuuaaaaaaaaguuuuauuuuauuuucauaaagcuaauucuaaccggauuauggcccgguaugguggcucucaccuauaaucccagcacuuugggaggucgaggcggauggaucacgaggucaggagaucgagaccauccuggccaaccuggugaaaccccgucucuaaaaugcaaaaaauuagccaggcccacguagugguacacgccuguaguccuagguacucaggaggcugaggcaggggaauugcuugaacucgagaguugaaguuggagugagccaagaucgcgucacugcacuucagccuggugacagagcaagacucuguaucaaaaaaacaaaacaaaacguccaacagaaaaaaggaaucaccgauugccauucaaauaaaauacauuaagaaaaaauauuagugguucaggagaaaaaaaucuuuaugugucuuacucugacauuuaaaauuguacauuucauaaaccugaauaugcuaaaauugagguaagaucuagcacaaacuccagcaaaggaagcauucagcagaauuuuuuuuccuagagaagcuaucauauauguauucauaguauuucaguaagauuucaagccacaguauuucaucaaggauuauuaggugcuguguuguguauacaguggcauaugaagugcuauggugaaaaauacaagagaagacauggccacuguucuugaauggaaaauuuaauugggacuaaaagacauauauaugcaucaaacaguuaagcaagugaucaauaugcaaaugcauguuaauaugcuaaaaacugcauugcuauagcaccuaaaaguauagaaauuauaacuagggugcaaaauguacaugggaaagguuuaagaaaagcacauuauaagcagguaagaaucaaaaggaaggaagaaugaggggaagucuaagcagaagaucuuaaucaagcuggauucaaagaguugaccagggucagcuagguagcaauaauaaaguaaaguaccagaaucaggaagaggaaagacaugagguccugaacagguauaauacuguuuacuggacaggaucacuggaagacuucagguguauuaaugcauacugauacuaccaggaacuuacuagcuacacacucuagucauuuuuuuuuuaauucaguaauccugaauucucacaacuauuagcugaaccaucugaaaguucaaacauauccuagagauaauacugaagaaaugaacagggcccuauuuuccauuuucaaucaauugguauacaagccuuuacagacagauaaaugcaaguccuuuaaacaauucagaacgucuuacuagucugucgacauauggugucagagaaccaccaugaaaauaaagagcuguagaauugggaaagcauccaaauauccauacucaacuacuuguagccaucacaauugauugugucaagauaccaucuccaagaaauccaauggaaaccauucuugcugcaauccuacacuacaugguuauuugcacaugaaggacagauaagacaacaaagcagcucucagcuaaggcaugaccugucgagcaauaugaaauaugaaauaugaaauggugggaaacagauaacccgugcuuuguguggcaaucagaaaagcaauaguucacuuuaagcaaaugcaauaaauuauccaugccguuaaaugacagggcuacaaacgacagaaagggccaagcuaucuuuacacguucaaugugaaagugaccaaugggaacauuauacaaaaguaaguuauagaccuggaaugaaacuuggcuauuuuuaauaggcuuuauguguguucuaugcuuucugaaacaaguucauuccuaucuaaaaaugccuucagguaaccuugguuuuguuuacuuuuuauucauaaugccaaacaauuuacaugcuaaaaccaacacaaaauagucaacucuugauuuaguaguauucugccuaccuucccuguguugacuucuguuucugcuuuccugacuuuauugccucaaacauaaauaaaaccccugaaacuaucccuugcuaccaauagcaagaaccucuauuucacuaaaaauauaaguugcugucccaaaccuguuaaaacuuacugucacaguuggcugcuaugggcaugaaaugacaguaaggaaaagggggaagaaaaugguuaagggugcagacaggcaggagaugagacaguuguuuucaauaauccuacagaaguauguaaaagucagcuggcugauaguccaaaucaaaucccauuguaacaaauacuguggaaaauaaaaguuaagacuguuauaccuauuagggcuggugcaaaugcacugaaaaccuuagggaaauuuuuuuuuuuccuauuauugaacagaaaaauacccucucuccuuaacuauaaucacucuaaaucucccauacaaacugcauaaaacuauccuuuuacucugacacuuaaaggccagauaauuuagaacagcccuuuuguuccacaaaugaggaaaauaaggcccaacaaggcugaguagauugccaaugacuuaggguuaaugaauggaagaccugggauuuacccuggccuuucugguuccuguuauaucaccuggcucaggagagccuuccucacauuguuucaugguuagaagaggauuugacuugcguuugccauugaacaucagcacugggcccagccagagacagcucuagcuuguauacugacaauacaguggaagggauggacgcaaaugugaauuuuaaaauuucguauuugggugggggggugggugacaagggaggcaagaaaaacaguuauuuggcauuuccaaaccaauaugccccguccucccucccuuaauagaaaauuugcuacuuuaaaucaaccaaacauaucuauuuuuucucuuuuuacacuuccaaucaauggcugguauaagaaaaauaaaaaugucauuuacaauugauuauuauuaaaggggcaggaaaaaaacauaugaauucacacucccacacaccuguuccccacucuuuccagagacucacuucccagguuuucuugcuauuugguuuuucugucuccccacuguggcagugaagaaaaguuguagacuguauuagcugugcuacugugcccuucauuagcaugcacaaucaagagcugacuggagggguggggaacaggaaggggaacagaaaaaagggagacagggaaggagagaggaagagagaaaaaugcucaaauauuuaagauauaaaauaaaaccaugaggcaacauagugaacacauuucccccucugaagaaaguuuagcugcaaauccacaguuuguagacgcugagugaggagucgcagaucagcucuucaguccuucuugaccugaaaauaaacgagaaccaaaaacauaccuggcugaguccugcaaucagugcucagcuaaucacauggagugacuccugaucuuuugaagaaugauuuguuucucuuaaaaucacccuguuaugaaguacaagugguuuuuuaaaaaauacaacuauuaucaaacuacuuuaaaagguuuguaaaauguucuaaaacucuaauuuaugcugacacuucaaauuacuuaacauaaaagaacauuuuaaaaggcuagaauggguuagucaguaucucauuguuuuuaacacacacuaccuaccucacaggguuguugugagaaaaacugucagauuuugaaaaaugccuugagcuccucgaaggaaaggcgcuauauaaaugcaaaaacaaacaacaaaaauaaaaagcuauuuguauaaucuguacuuguaauuucuaaacagacuuacaauauucguuguugcaaaaaucuuuaaaacucugugauaaucaagaacuuuaagauaccacaggugggcgcggcaggauagaagccaugcugcugaaauucucugcuucccauagaacacaccuuaccaugaaguuagaagcuuugaaaacauucuuuacggauucuagucaagcacuuaauuuuaaaaugauauuuaaagugauucauauucauauccaauaguggauaugaauaaucaaauacauauaaaagugaaauaaaaauuagaugguuauaacaguagaaaaaugaguaaggacuguacaggcugacauucugauuagaaaaccaagaaaaguugaaaagagaaacucagugcccugaagugacuccccugauguuuaaaugcugucuccugcucagcucacugcuggccugagucgccuucgcgccucaggauacugugacaucucagggucaugcagccucaaaaagggggcauuacugaaagcaucgaucccuuucuuaaaauaucccgcucccacuccauuuaaaaaccagagguauaaacaacaacucuuuuuuucuuguuaaaaagaaaacuuuagguuucauaauugacaaaagucaauuaaguucaaauuucucccaauaaauugaaauuagcauuuuguucguacuauuucuaaguauucaugcuacaacucuugcuuguuaguaaauguaaggauauauuaagauuaaaaccugugcacucaaaacauagccaguuuugaaaauucuccaaucauuaaacaucuacucuuucuuuuuucuuuuuuuuuuuuuuuuggagauagagucucacucuguugcccaggcuggagugcaguggugugaucuaggcucacugcaaccucugccucccagguucaaguuauucgccugccucaaacucuugaguagcugggauuacgggcacgcaccaccaugccuggcuaauuuuuguauuuuuaguagagacgggguuucaccauguuggucaggcuggugucgaacaccugaccucgugauccacccgccucggccucccaaagugcuggaauuacaggcgugagccaucacgcccgggcuaaacaucuacuguuucuaaacauucuuccuguugguagacugaaagaaguaaaaggaagggaaaagaguauaaaaaagagaaacuaaaaagugacaaauuacaggugcauaaacauaugaacaaagagcgcacuauacaaggaacaggcagagagcuuagaaaauuaaaauccaagagcaguacaucuucuggucacuucuuuugcaccccaaagagagagaaguccauaaacuaacaauuuaagaaguauuuauuggcuauuuacuaccuuaauuaagcauuaucaguuuuccuuauuuucuaaagucacauucugguaaauucuugcucaaaagaugaagagcuagaagggauaguuuuauuuucaaguaaauucacuaagguuaauugaaaacauauaccuuucaccaagauuauuguaaaggucauuaauaaaguuucuguucccaaauaucaguguacacaagaguguaaaagcacacguaaacggaacacucuggugggaaguaggcaggccguccccugcacucccacaccggccugaagugcuggcauugcuaggaacccaggcugcucuaaccagggcaacagaaucgucuguacuuccacagguuauuuuaggaacuguauaauuaaauguuggacuaaaaaauacuuaaaaaaugauuucuucugcaaguuuaaccagcuuuaauuuuagaugcuucaauucuauggggaaaaaucuuaggcacugggugcauuuuaacuuaggaguccucaguuaaugucuugaguuccaaaaauauuugugugguaauccugaaguuuacauuuaugacuacauaguuuuacgugagcccuaggaaacuccuaguaagguauuuuuauccacuuagcacgucacaaugaaacugagaggccagauguuuuaggaccuagcuauuccaaguguagucugggagcuuguuagaaaggcacaaucucaggccccaccccaaagcuacugaaucagagccugcauuucaacaaacucccaggugacucucauguaaacuaauuauaagaagcaaugguauaggaggacuuuuacagaaaacuggagugcuuccuuuuguuuuuuaauauaggguuucacucuguggcccaggcuggagugcagugguaugaauacagcucauugcagccucgagcuccugggcuccagugauccucccaccuugcccucccaaagugcugggauuacaggcaugagccacugcagcagaaaacuggaguauuuacuauugaagaugccaguaacaggcagccuucuggaauacggcacggggauuuuagaguacaugaaguucugucauaagccacuaaaacuuucauuguaauuuuuuuuuuuuuuuuuugagacugaguuucgcucuuguugcccaggcuggagugcaguggcgcaaucucggcucaccacaaccucugccucccagguucaagcgauucuccugccucggccuccugaguagcugggaguacaggcaugugccaccacgccuggcuaaauuuuguauuuuuaguagagacgggguuuuccauguuggucaggcuggucuugaacucccgaccucaggugauccgcccaccucagccucccaaagugcugggauuacaggcgugagccaccgcaccuggcccauuguaauucugauguaacgcuguuuuauaugcuuccauaucuugguaauaaggcauaaucaauauaacuuucuugaugaccccaggucaagauucugggccuuuguggugacauucugaaugccacuagacuacugugucaaagagugauucauucacacauucacauuucuuaacucaaaaaaaaaaaaaacaaagaaaaacacugggggugcuacagggugacaaauauuaucagcaucuucuaggagaaugagcacuggucucauguucaaugggcaaaaaaaaagaaaagaaaagaaaauggacuuaaaauaaugcaaauuaguuuuuuguuuuuagccggagucacgcucuguugcccaggcuggagugcaguggcgcgaucccagcucacugcaacuuccaccucccagguucgagggauucuccugccucagccuuccgaguagcugggacuacaggcgcauguggccaggcccagcuaauuuuuuguauuuuuaguagagacgggguuucagcauguuggccaggcuggucucgaacuccugagcucaggugauccacccaccucggccucccaaagugcugggauuacaggcaugagcuaccaugcccaguccuguaucuuuuuuuuuuuuuugaggcagucucacuuuguuacccaggcuggagugcagugaugugaucuugguucacugcaaccucugucucccggguucacgugauucuccugccucagccuccugaguagccaggacuacaggugugcaccaccacacccagcuaauuuuuguauuuuuaguagagaugggauuucaucauguuggccaggcuggucucgaacuccugaccucuggugauccacccagcuuggccucccaaagugcugagauuacaggcaugagccacugcgcccagccuggaucuuaaucaaucagggcauccaauggcagucauuuggcagggaacuguuuaaauaaucccccaacuccauuccaauauuucacacuucauuuuaguagguaaagauauaugacagaaaauuuuauggucagacaugguggcucacgucuauaaucccagcacuuugggaggcugaggcagguggaucaccugaggucaggaguuucaagaccagccuggucaacauggugaaaccucaucuacacuaaaaauacaaaaauuagcugggugcaguggugcacgccuguaaucccagcuacuugggaaacugaggcagaagaaucacuugaacccagaagguggagguugcagugagcugagaucaugccacugcacuccagucugggcgacagagugagacuccaucuaaaaaagaaaagaaaaaaaaauuuaugaaaaaaacaaaagcauauuuuuaccugaauuacuucuuuuggauuuagacuguaauugauaagugaggcauauaguaucuuaauucuagcaagggauaaaauuaaaaggggggaaacaggacacaagacuuuccucuaauuaccuguacucaccaauuccuaccucucccaacuacugaucagugaccaccuaccuggguaucaaguucccccaggguugccacuaaaaucagaacuauauaaccccaguccgggugugauggagaugaaagugaugggccagaacuagcucuaucuucuaaaucccugcuguuaugcuuuuccaccaggcuaaaaaacccuuugccauagagguuaagagacaaagcaaaguugcaaagcucugaccuguuugguggcagauacauuugugaaaugaucuaauggucuuuuuugagggagaaaugguauuuaagagaauuaaagagagaccucagcuguuaaaagaugacagauuucaagauuaauguaauaauguuuuuuauauacagcauuugguacucaaaacacuuacacauccacuuucuuaccugcauacugaauauaaacaugucuuuaaaacuauucgcucuuaaauaauuagcugaaucccaaagauuaaacaugaugacaaaauuccccaucuauacagagacaacguguaagagaaaagucuauaauaaaaucaugaaaaaaagggauguacccuacuuuagguuggaaauaaucauacacuuucaagguguuacaggaugcuugucagauuuuucuuuucgcuaagauaauugucaucaccuuuuuuuuuuugagauggaguuucgcucuuguugcccagacuggagugcaauggcacgaucucggcucacugcaaccuccgccucccggguucaagugauucuccugccucagccucccaaguagcugggauuacaggcaugugccaccugccuggcuaauuuuuuuuguacuuuuaguagagacaggguuucaccauguuggucaggcuggucucaaacuccugaccucaggugauccacccaccuuggccucccaaaguguggggauuacaggcgugagccaccaugccuggcaucaucaacuuuuaaaauagaacaugaggaugcuccuccagcuuuauacguuaauagaaauguucugagguaaaauaagaacacagaguuagaacugacaagauuccuggagucuuuucucugcuucucuuggcucacagacagaaaacccuuccacugcaaagaacuuuccuuuaaugucauuuuaaauuuugagcaaaaguaaaauuagccaucuauguucuugaauucaacauaaucaucuguuccauucaggauaaagacugaaaauuaccuaguauucauuuuguguguuugaaaaccuaaauagggaucaagaaccaaacugguugcuaggucaucauuuucacagaguuccuuggcggacauuccagaggaugguacauagcgacucuguccuucaaaucccgaguuaccauuaccugugaaaagcaaaagcaagaaaaauuacucaaauugaaaacuacuuaaaucugccuuaaaaucuuuagcggcauugcccauucaagcugguaauaaagaacugaaaaaucaaucauuuuaguaauuaagaauuuaauaaccuuugcauaagacagaaaaccaaaugcaguaaacuaucuccauuacugagaguauuaucguuagcagguaguaauagcagguucccaagaauggggucuggguagucgugagaauuugguucaaaugcuugacucucccccacccccuucucuccaaggaacacugagaaacgggacgggagcauguucacuauuuuaacaagacaauacacagggccauuacagauaggacucgacugaaaaggaaagaggaacacaagauaguuucugcaagaagcgccagaacuccagaucucaaguaucaaaaggaaucucaugaaguucagcuuccugcuuuagggcaggugaaugauuauuauccccacuuugcaggcaacugaggcccagacaaaaagaaacuugcccacaauuccagagcugggcaguagaaguggggaaagaaguggagagagaaugacagaccuauuucuacugaccucuguuugaagcaauuaugaacgaauggauaaaaauacagacugaaauauauaacugaaauaacuggguuuaacuguggaagaaaagcaauguaaagaaggaaaugaaggccaaguuuguaagaaguuucaucagagcugauuaaguuugauguauaugccacugacaguccuuccauggaaucagcacaucauuuauggaggacaacagcaauguaacuuucaggcucucaaaaccaaaauggggaagaaugaaacacagaguaaaguuuaaccuuuucauccacucuuucacagaacaaauacuuaaauguaaguuccugccaaggguagacauaugauuuugcaaucaaauuaguugcauguagguaugugaaaagcuaucaacauuguuaaauuuuugguaacagcauaauagcuuuauugaaauacaauucacauacgacacaacucacuuuuuuuuuuuuugaagacagggucuugcuuugccacccagccuggagugcaguggcaugaucacagcucaccgcagccucgaauuccugggcucaaggaaucauccugccucagccucccuaguagcugggaccacaggcaugcaucaucaaaccugguuaauuuuuguauuuuuuuguaaaaguggggucucgccauauuguccaggcuggucuugaacuccugagcucaagccauccuccugccucagccucccaaacugcugggauuacaggcgugagccaccacgcccagucuucuuuuuuucacgcaggcauuuacaaguauaaauuucccucuaaaccaccgcuuuggcugcauccuguaaguuuuaguauguuuuaucuuucuuuuaauucacuucaaaauguuuucugauuuccuuuuugauuucuucuuugacccacugauuauuuagaaguguguuauuucauuucuauguauuugugaaauucccaaauuuccuuguuaauuucuaauuuuccuccauuggggucacagaacauaccuuuuaugauuucaauccuuugaaguuuauggaagcuuguuauacggucuagcauauguucuauccuggaaugcugcacuugcacuugagaugaaugcguauucugaugagguucuauagaugucuguuaggccucauugguuuauagucuuaagcuguucuauccauuauuaaaaguggcguaucaaagucuccaaauuauugcugaauuguugauuuuucccuucaauuuugucaguuuuucuuuccuguaucuuaaggcucugcugcugggaaagucacugauuguaucugagauggggcacugcucugugcucucccauuucucauugcuggcucucuuucugcaccauucuggcccaauaacauucaauguaaggcuaugucaucuucacacacuggguuuucccaaccuagcccucuauauuuaucuaugcuugguaaaguguaaccaaaguaauggccauuuuccuuuuucuuuuuuuuuuuuuuuugagauggagucucgcucugucgcccaggcuggagugcagugacgcaaucucggcucacugcaagcucugccucccggguucacaccauucucccgccucagccucacgaguaguugggacuacaggcaccugccaccacgcccagcugauuuuuuguauuuuuaguagaggcgggguuugaccguauuagccaggauggucucgaucuccugaccucaugauccacccaccucagccucccaaagugcugggauuacaggcgugagccaccacgcccggcccguaauggccauuucuaaacucuuuuuuuuuuucuuuaaacaagagucucauuuuuuuuugcccaugcuggagugcaguggugugaucucggcucacugcaaccucuaacuccugggcucaagugaucuuuccaaccacagccucucaaaguaguuggaaccauagacaugcaacaccaugauuggcuaauuuuuuuguagacacgguaguuuuuguagacacaggguuucaccauguugcccaggcuggucucaaacuccuggacuuaagcagauccauucgccuuggacucccaaagugccgggacuacaggugugagcuaccacgcccagacgcauuuucuaaauucuuguguaucuauaauaauucaacuaauuaaaacuguuuugcacuaugauacacaaaaggaggccaacagugauuuccuaaaaaacuuaagauaugccuaguuugcugaccagaaugaauacacacugaugugaucacuauauuucucaauucuucacguucacacuagcugcuaaggagugaggcaggaugaggguacaugcugccagcagccucaggagugagugguguccaugcagaggaccacucauucagucuugccucuuccuacucuugucccaagcaggaauucugucugguuuucuauagcaacagugaccugaucugaaauggaaagguuaaggguagccugggcccaaugaaucgcauaaacccuaaaagguaagaaggaaaucuaucagaacuuguacaaucugaaacuacagaaaaucccaggcuaauccaaaucccuggaaacaggccaaugccaaucugaauuaaggauauucaaagguggcuagauucacguuagaaaaagaagaaaagcuguccucuuuaacaugacauacguuuggacauauagcugccuaguuagguauacacuuguccucagucauuuuacuacuuuuagaggaacuaugaaauacgcaccaaaucuacaacuuccugaacucucaaaaagcagccucuuuccuaucaagagguauagaggaaauaaaguaacuuaucagcaguguuucacugucaggaugaacaacugucuacccuguauaaauagaauaaauugcuaugauuugugaggcugcccuaaagcagucaguucuaucuauccucauucuacuuauguaaauuacaguuggcgucauuauucauauuauuccaugaaacauuuguggaaauuagcaaagaaguacauaccuauacuuacaucuauuaaaaaaauacagguuaaccuguaagaaguucaauuaaaauuuuaaaaauuuaguaagacauaucaaccauucagguaaauucuacaaaauauaaaguaacagacagaaaagcaugauuaaaauaauuauaugaagcauuaaacuugaguuuuauauaguuugaugagaauaaaaauugacacaacuuugagaguaaaaagacuauauuguuaauuaugaaaaugcaaaaaauuauuuaagacaaaagaaaacagaauacacauuacaaacuggaaagaauuacuaccccauaucacaaucagaacauugaagguuuaaguguguacauacaucuguucgaccuccucucgacugcauuuuugccagccuucaggguguccuuccccgugugcuguaauuuugauugauucugcugauggucauuagacaacuugccuccauuucuccugccauucaccaccaugaucuuggauucucccaaccacuucauacccacagacagccugacccaggugcauuuagucacucucuucaaauagcuuagagaauacuuucaauguucucuccuaacagaaacaaaauaugaaaaacaaaacaaaauggggagauaaauacaugaaagaucaugcuaaacagacccuugagaaagauauauaauauuaaaaggacagucauucacaguauaaugauguuuuggucaaugacagaccacauaaacaacggugguuccauaagauuauaacagagcuggacauacacuucauaaaauucguauugccuaguauuuacuauauuauacuuuuuacuguuauuuuagaguauauuccuucuacuuuuuuuuaaguuaacuauaaaacagccccaggcagguuauucaagagauauuccagaggaaggcacuguuaucacaggagaugacagcuccaugcaugcuacugccccugaagacgcuccagugggacaagaugcagagggagaagacagugauauggauaaucccgacccugugugggcugaagcuaauguuugugaccugugucucaguuuuuaauaaaaaaguuaaaaaaauaaaaguaggaaaagguuauagaauaaagauauuuuaaaaagaauauagcugagcacaguggcucaugccuguaaucccagcacuuuggggggccauggcaggcggacugcuugagcccagaaguugagaccagccugggcaacauggcaagacccugccucuacagaaaauaaaaaagugagccaggcauaguggcaugagccugugguuccagcuacuugagaggcugagaugggaggucaagccugcagugaagcuaugauugcaacacuguacuccagccugggugacagagcaacccugucuuccaaaaaagaaaagaaaauaauaauauauuuuugugucuuuuugucuguguuuugagacagucucacucuauggcccaggcuggagugcaguggugugauuauggcucacugcaaccucaaauuccagggcucaaccaauccucccacucagccucccaaguagcugggacuagaggcaggagccaccacauccaguuaauuuuaaaacuuuguguguguguguguguguguguguguguguguguagagacgaggucucacuauguugcccagacuggucucaaacuccuggccucaagcaaucccuccaccuuggccuccaaaagugcugggauuacaggcaugagccacugugccuggcuaagaaagaauauacauucauuuauuugagacagggccuugcucugucgccccggcuagagugcaguggugccaucucuucucauugcaaccuccaccucccagguucaaaugauucuccugccucagucuccugaguaggugggauuacaggcgugcaccaccacacccagcuaauuuuuguauuuuuaguagagacaggguuuuaccauguuggcuaggcuggucucgaacucccaaccucaagugauccaccugccuuggccuccgaaagugcugggauuauaggcgugagccacuguauguggccagaauguauuuuuguauagcuauauguguuuguauuuuaagccaaguauuaccauaaaagagucaaaaaguuuuuagaaaaaaaaacuuuauaaaguaaaacaguuacaagcuaagguuaauuauugaagaaacauuucaaaauaaauuuagcguagccuaaguguacgguguuaauaaagucuacaauaguauacauguacuaggucuacgcaauuacucaccacucacucacugacucauccagagcaacuucaaauccugcaaguuccauucaugggaagugcccuucacagguguaccauuuuaaaaucuuuuauucuguauuuuuacuguaucuuuauguuuauauauguuuagauaacaaauaauauuguguuaccagugacuacaguagucaguacaguaacaagcuguacagguuaguggccuaggagcaauggcccagguguguaguaggcuagacuaccuagguuuguguaaguacacucuaugacaacugcaugacaacaaaaccaccuaaccucacauuucuagaauguguccgagacacacucuaugagugcacucuaugauaucugcacgauaacaaaaucaccuaaacucacauuucucagaaugugugguaucccugucauuaagcaaugcaugacuauacuuuaauaacugaugucuccacucuuuaaagacaaucuuggcucuccccaaucauaugaugccugcucaggaauacagugcccccagacuggccagaauguaaacuacagaaggcagggacucauucugacuuguuccuugcuuguguuuagaacaguacugacaaacagcaggugcucaacaaauauuucucucaguaaacaguaagaaccaucuuugcuccuuguuauacugauaucuaguagagcuuucucaucuaucugcucaaacuacauguuuugguaaugcucugaacugggugaguaaacuacaaggaaguuauuuaucucuuuguuccaaggcaagcuuaggaaaaggcaucuauacuaagcuuuguccaucacaguaagagacuccuaacuguugugcuggcuacucaucaccacaaacaaaauuuagcagagggacaagaguaaggaaaguaaaggacuucauaucucuuuguuguuguuaguuucaauucacuguucuagauauuuaagaaaccaauauucagauaucaaaguagugcccaucuggaaaugucuaccuuaucauuccuucacaauggcaacaaaacugagaagcuacuguauucgguaauguaaauguaucucuuacuaucugaauuugggaaccgauugaucugaauagugggggaugcuuguaauuuauaaugaccuuuggaaaugaggauauuauacaucacacucacuacuaauggaaugagaaaaaggauguccaugauaccaccucauuaucgaauuaugcauuaguacaagucagacuaaaaaggcccuacgauaaagggcaaaaauacagaacuucagagccaaagaugccuuaagaucaucagugcaacuccuucaauuugcaaaugaaacugaggccacaugccuaaaaccacaugauccaccugcagcagucucacgaguagaacccagcacugcugcccaacaaauucucaacuacaccagacgcaggucaauuuccuuuccacaaacacauagaaaaguacaaaugauaaauuacuucgaaguauucacaaaaagacaugccuggacauaccuuuaaugauacucaacacaaacacaaaacaugaauuuuuacuugaucucaggucucuuucauguuacaggaguaucugugugaguucacuggaggguaagaugugcaugugagcaguaugcuuaggggaauggcaaaaaaaaaaaaucugaucaaugcuaaagacaacuuuacaauuguuuucuaacaugaauuuuuuuucugguucccuuacuauuuaaauucgauuauaguauuuaacuuuuaacgugccuuuugauuuuucucauagguuucacuaaacagucuucuaucuauucuacaucaguuauaagcuaaggauuuuucaauuauuaaauuuuaccaaauuuaacauuaaaaccucucauuaaugaucauauaucuuacacuuaggagaaaaggcauagaauugaacagcaguauacuuuuuuuuuuuuuuuuaagagacagggucuugcucugucacccagguuggagugcaguggugugaugauggcucacuguggccucaaaguccuaggcucaagcaauccuccaccucagccucccaaaguguuaggauuaccagcaugagccaccacacucaguaagagcaguguacuuuugagguauaaaguacaaagaaagcuugagaaaaagagcaaugggugguccauugggagccuuggaucuuggauccccagcaguuuugccuauggacucuaaaauggacuucauuuaaagaaacccauggaacaguaauagauaaaaacauaaaacaauaugaauuguggcauucaaauccuagcacuucgggagagcaucaaguaccaaguuuuuuuuuuuuuuuuuuugagacagaguaucgcucccucacccaggcuggagugcaguguccacgaucuuggcucacugcaaccuccaccucccagguucaagcuauucucaugccucagccuccuaaguagcuggaauuacaggugugcaccaccaugcccgccuaauuuuuguauuuuuuaguagagacagaguuucaccauguuggccaggcuagucuugaacuccuggccacaagcgauccucccaccucggccucccaaagugcuacgauuacaggcaugagccauugugcccggccaaguguucaaaaauuauagccuacuaucacaaugcauugaagauuugaauuucaauaaccucgucaagacuuagaucuuuaaaagcuucaagguucaucugcauuaaagcucuccaucauugagccaucucacaaaaguaaaagcuuaaagggacuaaaauccgugacuacauuccauuuuauaucccuuccucaguuuucuucaauuuccuugaccccuagggucuuucauauuacuuauguuccuuuaagacaagagccaaagaaacagcacuuucugaaaaacagauguucuguggcuauaagcuuucauugguacagaugcauaaacuuggcaugauaaauuuagaauuagguuuuuuguuguauccuauaaaaagcugcauuaacaacaagcaaaugggccaggugguggcuuaugccuauaauccuagcccucugggagaccaaggcaagaggacugcuugaggccaggaguucgagaccagccugggcaacacggcaagaccucauugcuacuaaaaauaaaaauuaaaaaauuagccaaggauggugguaugcaccuguaguuacacucaggaggcugaagugggaggauggcugcagcccaggaaauugcggacacagugagccaugaccaugccauuacacugcagccugggugacagagugaaaaaaaagaaaaugaugaagugguaaauuuauauaaauguauuuuauauuucaaguuagauuauacucucagaagcuaugugguuuacagaaaauagcccucuccuaucccaccucugucucuuacuaggcaguugguaaccaacaaagucacuuaaccucucugaaccuuaacuuccauuauccagaaagugaagcugaucauauuuuccccauccaccucacagggcuguugugaggaucacaugaaauaauguaccuaaaaaaguuguuucuauaaaagguacaacacagauagauccaggguccuguuacauaguugcaagucacacucuuaucuccagggccugggaagguaggugauuuaagcacacagaaagcaccuaccauguccagggcacauacaugguaacaagauuauguuauuuuccucugaauacacagaauacuaccaugggcuaauucuaaggagcaagacuguaacuuucccuaaaauuauagcucagcauucauagugcucuagggcaauuauggguuguaacauauuaaugguuugcaacauuuuuuuuacuauguugugaccaguaauuuuuuuuaaaugaaagaacacagagcagaauauuucacaaugcaucccacauaguaaguuuuguuuuaguuauauauguguaaauguguguauacuuggucauuaaauaaaaugaauuuuuggccaggugugguggcucaugccuguaaucccaacacuuugggaggcccaggugggcagaucacuugaauccaggaguuugagaccagccucgccaacauggugaaaccccgucucuaccaaaaauacaaaaauuagcuagguguggugguaugcgccuguaaucccagcuacucaggaggcugaagcaggaggaucacuugagcccaggagauggagggugaagugagccaagacugcaccacuggacuccagccugagugacagagcaagacccugucuaaaauaaaauaaaauaaaaugcauuuuuuuccuggggguguggggaagggcaaugcaccaugccuuucuccucugucugccuggaauguuauaacaccaucucuuugccuaauuccuuaagucccaguucaguguucacauccucuaggaaguguuccuugacauucacugccaaaucuaguuauauacuuaugcuauaaaacuuaagugaaagcccuuaugugacuauauuguuuaagugucugcuuccuuaauugagaguuccuaagguugagaaucuauuuuucuuaucucuggcccuuguguaucuaguauagcacacaguacauccuagaggcacucaacugaugaaauaaauagguuguauucuaaacugcaucauagaaacuauauuucugcauuaaaaaaaacuguaaauuaaagauacuuccugaccucuucaaauccucuccuuucucaaaauguccaugguguguaagggggugagagaagcuccugcacagacagaaacaaggcaggaaucacagcugcuaccaccacuaacuucccuacugcuugccauuauacuuucugguuuacucccuaguccuugacccuccagagaaaaagaaccaggaccaggaaaagugcuuuugguccuuuaggaaaucaucuguagaaugccuguguuuaacacacaacuuauggauaaucauggaacaauguacuuuuaggcuucucaggaguccuaauauaccucaaaaauaagacauaaagcauaauuauaugaaauagaaauaaaauauauggaauagaaagguuauccauggagagucuuuuuuuuuuucuuuuuuugagacggagucucgcacuguccccaaguuagagugcaguggcccaaacucggcucacuacaaccucugcuuccuggguucaagcgauucuccugacucagccucccgaguagcuaggacuacaggugcgcaccaccacaccuggcuaauuuuuuuuugcuauuuuaguagacacgggguuucaccauguuggccaggauagucucgaucuccugaccucaugaucugccugucucggccucccaaagugcuggaauuacaggcgugagccaccacgcccggccauggaaagucuuuaagucccaaccaagaugucuacuugagagaaagcagaaaauuuggggaugaggcccagcaaucuguguuguaguaagaccuccaggugaugcaagcuccaguguaagagcaaucgcucuaauuuacuuauucauuuuaucauguuagggcaaagaauagauacaaaauuuuaagaaaaauuauggaauaaaaaauuaaggaaauuauaauaucaaccaaacauuuuucugagaauuaggaaaauucaccaacaaaucacuuuaguaauagcaaacuuugguucaauucauggaacacagacugagauccacucuaaugugcacauaauuuaaauuaaauguggguuaaugauccaaacuggaaaaaaucugugcccucagaucucauuuauauugugaucaacugauauuauuugaacucaagguaauuuaaucuaacagguacuucugucaaucacagaacauggcuaaauuucacuaguaugaaugcacugcacaugucuggauguagccuagcagagagagauucuccacagguccauaugauaaaagcuaucaaaagaucuuucuuaaacugauaaaugaaacauuuguaaaaacaauucuaaugaagcuaucaauaauuugggggcuauuuaaaaaaauuuucagcucaaaaugaauauauauuguacuaaugaucaggucaucauuuguucugcccuccuaaguguggaaucuguucuugcuggcaugaucuuuccucuaagaccacacguuuacacauuaaagguagcgaugggauuuuaaaaagcuaacacaagucgauacuguaguagaguauagacaaauagggguugaaaacaucccagcacuuugggaggccaaggcgggcagaucaccugaggucaggaguucgagaccagccuggacaacaaggugaaaccccaucccugcuaaaaauacaaaaauuagccaggcguggugucacaugccuguaaucccagcuacuugggaggcugaggcaggagaauagcuucaacccaggaggcagagguugcacugagccaagauugugccacugcacuccauccagccugggcgacacagcaagacugugaaaagaaaagaagagaaaagaagaggaaagaagaugaaggaaaggaaaggaaaaaagacaagacaagacaagacaagacaagacaagacaagacaagacaagacaagacaagacagggcggcuagcaaagccuaaaugcuucauagcuaccacagaggugcccccucccaacaaacacacaagggugcagacucccaugggacauagcuggcucacguggaaauguccccauggucacgguuuggcugacacacucugagcuaauuagccacugacuacauuuagaaguaaaaauugccucaauuuugucccaaauuguuaggaaaaacauuucaagaaaguacugacugcuucuuuuuuuuuugagacggagucucgcucuguugcccaggcuggagugcaguggcacgaucuuggcucacugcaaccuccgcuucccggguucaagccauucuccugccucaaccuccugaguagcuggaacugcagaugcacgccaucacacccggcugauuuuuuguauuucuaguaaagaugggguuucaccguguuagccaggcuggucucaaucuccugaccuugugaucugcccgccuuggccucccauagugcugggauuacaggcgugagccaccacgcccggccauuacugaccacuucuuaaaugguguauuagcuuggugcaaaaguaauaaaguaauugcguuguuuuuuuuuuaguuacaaauccuguucugauuucccaauauaaaaaugucaggaaaauuagacauccacuauauuccagacacuguugcaggcacugagaauacagcauggaacaaaauaaggcuucugcccucaucugugcuuauauucuaauggaaaaaagcacuaggaaauaauaaauuaacgaaugaaugucggcaccuuuuggggggaauaagccauuuaugguggcagggaguguuucagguggagaaggagggugauaguggcuguuuucuaagacagcaagggaugugaagggacagccaggcaucaggcaagaagcaugcaguagacaaagggaagggcaaacacaaggcccagaggcuggcguggcuggggcaaauauggaggaagagugggaggaugaggucagagaggcugccacagggaagaagggcuucaaagccacugcugagacuugggccuuuacucccagugagagggaaagcagaggagugacacgauccaacccacaguuuuaaaggaccaugcuggcagcuugcuacaugguacuuuaaaaaagcaguucuaaugaagcuacuaauaauuucuaggacaagagaaugcagggagacguuauuaguaguaguagucuauuuacuaacugacuacugcuagccagaggagaacuaguggcugcagcagcagagguggcaagaagugguuggcuucgagaucuuuucugaagguuccgcugauagucgggaacugcugacagauugaaugcagguguaggagaaagaggacucaaaaauaccugcaaaugaagaauggaauuaauauuuagggaugugacaaagacuauaggaagauuggcuuccgcaaggacugcggugugggaauuugguuuuggucauuuuuucuuccuuuuugggggucuuuuuugguuuuagucacuuuugagaugcccacuacagauccaacuggaguuggcagcuggauaccagggucuggaguccagcuccaagcugaagauaaaaaucugguauuuuuaucuucaaauaaaaucaaaguauuaauggcauuucaagccauggaaucagaugaaaucuaggacucagugcagaucaaugaaguccaaggacugggugucgggggcacuuuaacauguauaggucaagaggaggagaagcagcacaggaucacaaaaggagcaacaagugagaagcagagccaggcaugacagggaccacucuguggagggaguuaccaacucaggcaaggacuauaggugcccaguaagcaaauacuuuuauuuuaugagucuaaacucguggaaaggaugggcuauugcugaucugugagccuugcucagaaacaacagagaacuucuaaauggacacaaugucuuaaaacacgcacuugugaggaagacggggcuuugcuuuaagaaacagauggcagagggcaauaucaggaacgagagagagagagacugacucgcaggccagaaaagacaaauguaaguuaaaauuauggagugggaggugaugggaauagguuaguuaauuugagaaggcaagccuucagagcgcuuauaggaucuguguuaaaaaaauuuuuuuaaacuaauagauugguuaaaucucuggaugggaguaauacagaugaucugaguaggaaaacgaaguggaauuccugaggacuacugugcaaggcuuugugccuucuacuuucgugaguauucacagaaaugaugcaaucaggcucugagaaaauggaauugggauucugcuccaagaugggcagcaucacuuccccaagggauuuacccagcacugaaaucaacaggaagagucaccuuaugugguuucacuggaucaacacaugggaaaagaagcacuuacuacagauucugguaccaaacauaaauaaggagguggggggugaggggacaauuuaugaucaagauaaaacauacuggaaaacugcuaaaauaagaaauguauuuaaaggggaaaagauuucaagaaugauuuccaguuguauuuaaagcggaaacuccuaaucauaacacgaugccacuaaggugagaagcgcgacacccaccaccaccagcaccaccacaaugcauuccaaaucaccagugcuaccguugcuggggggaaggauaacuuucaaaaguauuuuuuccccaaacguuuacagugaaccuauuuacuuauaaucagaaaaaaacugaaaaccuuaauacuuuaacacauuucaaaagaaagcagcauugauucauagaaaaugggcuacguucacauaaccaugccuguucuaugccagugauggccccucaacaaaugucaaugcccuucucuuuccaggcucuuuaugagauuauaaauuguugagugacuuuugagaaauuguguccaauuugagaacucugauuccaauccauuuuuacuuaaacacaggcauuuuuugcuuaauauccuaaaaacaaacuaagauuaaaaaaaaaaucugucaaaaaaguuaaaacacugauucugaaugacuagaaagaauguuaacguaauuccugugacauuaccgagaacccucuagccaguugacaugcugaacuugucugcaaacaguuuaucuuagagaaauuauccaguggcagggaaacaauccccaagugguugaaaaagaaaagucaauacacauuuuuaaaaaguagguucuggcugggugugguggcucacgccuguaaucccaacacuuagggaggccgaagcagguggauuccuugagcccaggaguucaagaccagccugggcaacauggucagaccccagucucuaccaaaaaaaaaaaaaaaaaaaaauuagucgggugugguggugcgugcuuguagucccagguacucaggaggcugaggugggaggauggcuugaguccaggagauugcaccacugcacucuagccuaggugauagagcaagacucugucucaaagaaauaauaaaaagcagguucuagccuguuagaggacuuucauaaaucuuuauuuagaaaggcaaagaaaacauuuuucaagugauuuaguuauaauuugguaagaaaacaauccaguacaccacugguuaacagugagugagauuacaauggagaaugacaucacaagcaauauuuaccugcuacauguucaacuuuucaaaauaaacaucugugacuuuuguaacaaaauauuaaagauacuuacacaaaggaaagggaaacagcuuggcagcuucccaccacagggccuuugcacuuggggugccgccacacugcuccucagucccugcccaaccccacuucuccagcuauauagauuuccuuguuauacauuuuaacccuuaacguuucucagcauggugcuuauuacaaccauacucacuacucuguguaauuaucugguaacaccugccuucccuacuagcuaagacacacuuuuuuuuuuuuuuuuuuuugagacaaacucucacucuguugcccaggcuggagugcaguggcucaaucucagcucacugcaaccccugccucccggguucaagcgauucuccugccucagccuccugaguagcugggauuacaggcgcgcaccacuaugcccggcuaauuuuuguauuuuuaguagacacgggguuucaccauguugguugggcuggucuugaacucuugaccucgugauuugcccaccucggccucccaaaguacugggauuacaggcguaagccacugcaccuggcuuuauuuccauguuuuggccgaauaauccugcugugaacguggguguacaaaauaccuguuugaguacccgcuuuaauucuuuugacgauauacccagaaguagaauugccgggucauaugguaauucuaugcuaaacuuuuucuuuuuagauggagucuugcucugucacccaggcuguagugcaguggcacgaucucagcucacugcaaccuccgccuccuggguuccagggauucuccugccucagccuccugaguagcugggauuacaggugugugccaucacacccagcuaauuuuuguauuuuuaggagagacgagguuucaccauguuggucaggcuggucucgaacuccugaccucgugaucugccugccucggccucccaaagugcugggauuacaggcgugaggcaccgcacccggccccauacacuuucauaucauuagaauccagcacaagaccagacauagguccauucauaucaccuucccuuucuauucucaaaccaacugcuacacauaagcagaaucgguuuuuaguuuucuccuaaaugugaaaucacaaaaggacuugacaucaaagaauuccaaaucggucuuuaucaauggcuauuccaaagccgucugcaaucaauauugcaauaacuaaggcuccacggaauccuaugguaucaaucccagcgaugaggccaauaaaagaagcccugcaaagcuaucagaagcauuugugaccaauauuccaucauaacaccauuaacacugcuugacagggcaauuucucaguugcuaauuuguuagaaaacuaccacgaauucacguucauaccuguaaccuuaaaacuugcuccuauaaacauuguugucucaccugagaagcuaggugacuugucagaguaguucaacgggguguuaguauuaugaaaagagaaaggccucaggguuuucauuucccugaauucacaauuaugcuucuaccuaaggcagagccuuuacuuuaaaauuagagcugucacgcuaauucaaaugguaaucagguaucuagaaccaucaacuccauagcaaagaauacgucucuauacuccuaaaauaauuacaaauguccaugauauuaucauuccuacuuuccuucucuagcuuucauagggucaagcuuggaugcauuuugcuucacccaauucaacagcuuucccaaguacccucaggugguaaugcccucacucaggccaccaagagaauagcgucugaagcugagcaguuuaccuaccaccaagguagaaugcuucacccacugcccuuucagaauaaaacgauggccacagacaccaucacuaaguuuugaaaaagacuaaacuuguugagcuaacagcucuaaagcagacuguaguaugguggaaaacggcccccaaagacaucggcuccuaaucucuggagccugugaaugcuaccuuauaaggaaaauggucuuugaagauguuauaaaaaauuuugagauaaaagagauuauccuagauuaucuggguaagccuuaaaugccacucaaaugacuuuauaagaggcagagggagauuugacaccucacaaaguacagaaggugaagcagacuggagugauguggccacaggugagggaaugcugcagcccaccagaggcuggaagaagcaaagagcagcuucccuccacagcccugccaacgccuugacuuuggcccagugaaacugauguugaacuucuggccucgaaaaccgugagagaauaaauuuccgguuuuuuuuuuuuuuuuuuuuuuuugacacagagucucacauguugccuaggcuggaggcaguggugcgaucucagcucacuguaaccuccaccucccagauuccagcaauuucuccugccucagccuccugaguagcugggauuauaggcaccugcugccacgccaggcuaauuuuuguauuuuuaguagagaugggguuucgccauguuggccaggauggucucgaacucuugaccucaagugauccgcccaccuuggccucccaaagugcugggauuacaggugugagccaccgugcccagcccauuucuguuguuuuaagccgcuaaguuuauggaauuuguuacagugaccacauaacagagauuaugaaaaacuaaaccaaaguagaaacgcuuuacaguuaccacacuccaaaaauacauaaaauuccaacaugucacaggaaaaaagauuuuaaacaacuuuuaaaacaguguauuuaaaacaaguuuuaaaagacugggcaacaaagugagacccucaucucuaccaaaaaaaaaaacaaaaaaaacaaguagccaguugugcugcugcgcaacuucagucccugcuacucaggaggcugaggcugaaggaucaugggaguccaggagguagaggcugcagugagcuaugaucaugccacugcacuccagccugggugacagagugagaccucaccuuuaaaaacauaaauaaauaaaaaguuuaaaucauacacuauccuucaacugaagguauaaaaugcagcuacugaguuauauagauuuugaaaauagagccagccucuuaauuacaccucugauuacucacacacuugcuaggccagauaaccaugaucuuccugaauagcauuguaauugaacauuuuucuauuuauauuaaaacuuacaauaaaaacugaaacuauuagaauuucucauugagcaaaacauuuuaaggagcaaacuauccacuacugguaaguuuaugaucagacauucgcaauucuuuuuuuuuuuuuuucagacggagucucacucuguccaccaggcuggagugcaguggcaugaucucagcucacugcaagcuccaccucccggguucaagccauucuccugccucagccuccugaguaccugggacuacagacacccgccaccacaauuagcuaacuuuuuguauuuuuaguacagacaggguuucaccguguuaggcaggauggucucaaucuccugaccucgagauccacccaccucggccucccaaagugcugggauuacaggcgugagccaccgcgcccggccagacguucgcaauucuuagacuuacuuauuuggcuacugaucuacagccagacauguaagaaacuccuaauugccuuaucacagaaaauacugcuucauucuuaaauaucacauucaauacguauuuacgacgagggaugucauguaagaaagacuucaugucuucaucucaguaguuauuuuaaaacaaagguuuucacugaugggguuguugagggaaaguccucaaaaaaacuuccagaagaaaacaaaaaaugccugcuucccccaucucuccacauuugauccaucugcuuaccuagcagugccuagaaauaaaaucaaggaugcuuucuuuguuacuguuuucucuaggacucaaacagccauucacgguucuagaaacagaugccaccuagugucaaaugacuguaaguacagccuuuacagcccacaguuucugucagaaguuacaagaaguacaucaaagauuuuuacugggcaaggacaagugugaggaaaagcuuccaaaaggugguucuugggcuggacguuagaggccacuuugaguuugccagcuggugggcuuugcagaggcagcccgcacagggauuaaggauguggcucugcagucaaagcaccugucccacccuagcuucauccuuaccccagcagugugagcagacgaguuauuuaacuucaccgaugccccaccaguacaaugaaaagaaggccucccuagguuuggcacaagauauuuuaaaugagcacaaacugcuaacaaauuaaggucuccccuuccaaguaacuaaggcaaaaguaaagcaggccagaaacauucuucacaaaacuuuaaucaaguagaaauuucccuucuauuccccaccauaacucacacaugaaaaaaaaaaucucaucaccucacccauuuaaaaaagaacaaaugugcaaaagaauaauuaugacacaaggcugagcaccaguucugcuuucccuacaguucccaaagagaaggaauguaacuucuggcugcaacacgcaugauuaaaaaucaugccaagcagcagggcacaguggcucacgucuguaaucccagcacuuugggaggcugaggcgggcggaucacgaggucaggagaucgagaccauccuggcuaacacggugaaaccccgucuccacuaaaaauacaaaaaauuagccgggcaugguggcggcugaggcaggagaauggugugaaccugggaggcggagcuugcagugagccaagauugcgccacugcacuccagccucggcgacagagcgagacuccguuucaaaaaaaaaaaaaaaaucaugccaagcuacaucucccauccuaaacauucagagggaccacagacuggacuacagagcuucuuacaacacaguuuaguuugugguguaccuggucaaacagauuauuuucacacccuauaaaagaagauacaaacaucacugcccuuuaacacacacucaauacuaucauccccauuuuacaaaugagaacaaaacucagagaauuagaaaaaaaacugaagugaaguccaggcugagagacuguguacuguuaauaucacacaaaaaagcaacacaggccaggcacgguggcucacgccuguaaucccagcacuuugggaggccgaggugggcggaucacgaggucaagaauucgagaccagccuggcgaacauagugaaaauccauuucuacuaaaaauacaaaaauuagccaggcaugguggcaccugcccguagucccagcuacucgggaggcugaggcaggagaaucgcuugaacccaggaggcagagguuguggugaaccaagaucgugccacugcacuccagcuugggcaacagagugagacuccaucucaaaaaaaaaaaaaaaacaaaccaaaaaacaacacagaauaaugacccaaacaaauuuuuuauuuuuuuagacgcugucucgcucuauugcccaggcuggagugcaguggcacgaucucugcucacugcaaccucugccucccagguucaaggaauucucugucucagccucccgaguagcaggaauuacaggugcccaccaccacgcccagcuaauuuuuguauuuucaguagagacagcguuucaccauguuggccaggauggucuugaacuccugaccacgugauucaccugucucggccucccaaagugcugagguuacaggcgugagccaucacgccuggccccaaacaaauuuuuaaacacacuucgcccaagccaggcacgguggcucacgccuguaaucccagcacuuuaggaggccgaggcgggagggucacgaggucaggaguucaagaccagccuggccaacauggugaaaccccgucucuacuaaaaauacaaaaguuagcuaggcgugguggcauguggcuguaaucccagcuacucgggaggcugaggcaggagaauugcaugaaccgggaccugggagguggagguugcaaugagccaagaucgcgccacugcacuccagccugggcaacagagugagacucugucuccaaacaaacaaacaaaaaaaccacugugccccauauuugaagaguaaaacucuagagcaaaauagacaucguuccugacugcauagaggucagagcauacuaugggaagagauguaaguaaguaugugguuaucaaucugaugcgagcuguaagaaaaacaaacaggauguuaggagagagacuaauguaagaauggacuugagaugggaugaucagggaaauauaaaucaaaauuguaaauauaaaaacaagaccagacauggcagcucauccuauaaucccagcacuuugggaggccaaggcgagaugauugcuugggcccaggagacuaaggcugcagugaacugggauuaugccacugcucuccagccugggaggcuacaagacccugucucaaaaacaaacaaacaaaaaauaccuuuuuugggucaaaagcccuccugguacuuauuuauaugcaccaaacaaauauuugcuuuaaacccuccaggacccugaaugacgucugguuuuguuuccuuuccaagggggaaagugaagggggguuuccuauggugccacuggcucacuggcugaaggaucaagcccccuuuuacuucucagugaggaaagcugcagcuuccuaaaaucagauugguuuucuuacuaaaaauaucuauuucuccauaugaugcaacauaaacauugccucgaaaauaaaaauacuccucagagaccauuaaaauguaucauacauuucaaccguguuauacaaaucagacaggcaaaacaauucaucgggccgaccuagaauccacucaguucaacaaacuuaugaagaaccucccagagcugccaggcacuguucguggugcuggaauacuggucauguccagggaacacuagagggcguaugagagcuucuacuuucaggaaaaucagucguugagucagggaagaaaaccaaacagaugcauaaggggaaaaaaaguuaacaggguagaaaaguacagacuaggaagcagaaugacccuucacugaaugggccuuuugcguaaggccugagaagcaagccgagugccauuagagaugugcugaccaggcauuccuauaaagguggcacaagguagaaacacaggugucacaacacacacauucgguuucuacugguuccccuaacaugcaggacucgggauucgcuagcucagcaacccuaucaggugaaacagguauuagcacuacaacaaggaggcuaaagcucagaaacaaauugcuuuccuaaacucaaagugcuacuaagugguaagggugggucuaaaaccuucaucuuuaaacugcagucugggguuuacuccagugcuugagccacguguaccaccuagagguuuaucaccagcaaaugauccccggaucuagguacuguuuucuuucccccuuuuuuuuuuuuuuuaagagacggagucuugcucugucgcccaggcuggagugcaguggagccaucucugcucacugcaaccuccaacucccggguucacaccauucuccugccucaaccuccggaguagcugggacuacaggcuaauuuuuguauuuuuaguagagacgggguuucaccguguuagccaagaugaucucaauuccugaccucgugauccacccgccucggccucccaaagugcugggauuacaggcgugagccaccguacccggccgguacuguuuucuuuagugugcuauuacaacagacaaacuaagacagcuuauagaaaugcaacuggcauuguaggagucauacaggcccccaaucaagcuuuggggggggggacacugauacccuagucucucaauucuaaaacccaacugauuaacuaucucauaaugacauuucaaaaaaaggagguaaaacuacaugaaacaugcagaugaacuaaggugauuagagagaugucaaaauaugauuaaaauaauuauuaggagaaaauaggauggcagugaaguguaaaagaugaagcauuaauacaauuuuggauuggaagugaccucagagucguuuuguagacggagucuaggcccuaucaaugacuuauacaaacagugauagagcagagaauggaauaagaauugauucuuauuccaugguccuucaacuauuccuaaaauuacacuucuauacagcagucaucauuugacauacggcccuagaagauggccugguguucaagucugucucauucggagaccggcuagccccaaaucaaccccauccagacacauaauggaucacccccugcauuuacuuaacaugcaguauuguagcuaacagggugauggagcggagggaggacacauggucccuaucgucaaaagugugaggaagauucuuaaccaucagagcguucuaaggcugacauagucggggaacuccugaccacggagaaggauuuugccaauggagagauuugccaauguaaagcucauacaugguacacagaaacacgaaauaaugggaccacggcgauuuaucugaaaggauuugcucuguaagccaugggaagggcauuccuguggacagggagcugcuuagaugccacacacacaaaucucuuuaucacacaaccuggccacgaacccaggcccuauaaacccacaaacugauaaucagguaaaggaaaaucagauucaaccuccuuuuuaaauaacccaagagaaaaaucaccaacaucccccacccacuaaauucucugcugaaagacacgcagacaccgggacacuuccuucacacgcgucucucccugucagaguccgcuacccuccauccaccuccaccuuccccacuacuguccccuggcauuugcugcgagaauaaaaaguucacugcaugagcaguucaggguguuugggaaagcagaugaaaauaaaggcgcgagagcacuuggaaaugaucauggauaaagaaucaagcccuacccuacucucuuauugaagaaauaucuaccauauucccuucacucuccagcucaguuuuuaaaauauaauuauguuuguaaacaacauuaaaguggauuuauuuugaaaaacuaauacaaacuauuaagcuugacaacuuggagauuaauaaauuaacccauucauuaagggucuaugagcaccuacucuguaccugcccgugggcggacgagauaacaagagacucaaaaacucacgaguaaccaccccaacggcugugugugugaagguuucaccaggaagcaacauucucacggggccuuucugaaggacaagaguguacgggguggagaaaagggguggaggaaugccgggcagggcacggccgacagggaccagguaugggaagcuauuggagccagagcuugggagagggaccagaaugucgaauguuuagagauuacaaagugaaaaaugggcuggaguucccacacaagccgggauuagagcguuuguggacucuaaccugggaauauaaggcgcuccaagagggacagggccacaccucugguucaaauugcuaaaccuucagauacacaauaaaucuguauuuacagcaagcggcaauuuauguauuucaacaugcacacauuaucuguaauuauuucagguaaaaaugguuuccuccucuuuugaaaauacuucuuuuuacuacuaauuaucaauauuauaggcguguucucaauauuaaagacuaaaggaaaaaaguuauagcuggcaacugcuuccucuaaagauccuacacagcaaaguucagaccuguauggccauccucaacuacacuuuauaucaaacugguuuaaaucgaaaaagguccacaucacaaagaaccacaaucaaucaaauuaauucaccugcccucuauucuaaggaaaacuccccccacuccagguaaauuucauuuggcaaauucuuaaaaauuaacuucaaagaacacauguucaccuccccaguauuccgaaaguuccaccacuuaauaaaucguuaaguuacuguuccagacccggguccaauaaacccaaauagacugaauuucucagcacccaacuuguuucuaucuuaauccagcaaguugcaucgaguugucauuguuccuccuuccaaggcggaggugacaacggugcacaucauccgcgaauacguggaaggacagacacacaccaggggacgcagggagagcggauaaagcacaaaggggacgcagcggccgcggggucgccgggccacggccaggggcgccgucggggaggagggugggcugcaggacgagcucgggagggcuccgaaaugcgcucgggccaaaacaaaaacaaaaaguucagcgcggcagugggagcagauugggcgagacgguucacggcugcccauuggagaaaagggaaaacagagucccccaaucgcgagcggcggggcugcuccccucgugcggccgcgggcccggccccgacgcugcccggcggccgcuaccgcucccuuccggccgcggccaccacugcaggccccgcgccggccccgcaccggcccggccgcagccccgccccccgcgcccggccgcuugcgcccggccccggccccacccgcccuggccccggagcccugcgaccggccugggcccgcggucccccacgucccugcccgccccgucaccgaggccgccccccgcacacccucgccggcgcccgccccucccccgacucaccgccugcgccgccccgcuccuccucggggcgcgucccaggccccgcugcccggccgcugcgaugcggggccgcgccgccgggccccgcgucccagucccccccagaaaauuaaucaccaaaaauaauuccagagaaaaauggagaguaaaauccaagauggcggcgcgggccgcagcacc

SEQ ID NO: 192773 - RNA, 3761 nt, Homo sapiens
cuugaccucuggcccaagaugguggcgcccagagcuucgcucuugcugcuccccugaggugaacugaagccagcagccccgcaucaugucaaagcucggccgggccgcccggggccucaggaagcccgaggucggcggugugauccgggcgaucgugcgggcaggccuggccaugcccgggcccccacuaggcccagugcugggucaggugcggccguggcgggaacccgacguggggguugucuaggaugguggaagcuaggacgcggauggagggcgcuggcccuggaaccacccgggccucgguucagagcucggcucugcuucucacacgcuuuauguccuugugcugguuacaaagugucuuccaccugggcuuccucaucccuucuucaaugugcuguaaugaggauaacgugggaagaugcguacgaucuucuggcucacggagggguaguugaaucuggguacagaugggaacccagagaagugaagacgaaggagggaacggacggcgccuccugggcgauaggaagccguccccuccucucaccacuaacccccucugcuucccucacagagaggcguuuccaucaaccaguuuugcaaggaguucaaugagaggacaaaggacaucaaggaaggcauuccucugccuaccaagauuuuagugaagguggagucuggacucugaucccugguuuccuucucccucuguucuuccucggcccugggacuggucaucugggguuguuucucugcuccugacuugacuuccuauuacugggcuccacuuuccccauuuaggacuagaucauauuuuuucugaaccagccccaucuugccauguugcaguuccucccuuugccccuccaucucacuggggcuuccagagcagaaugagggcaggaauagaggggacagggauguuugcugcagauuuauuuuuuucuuucuuuuuuucugagauggaguuuuguucuugucgcccaggcuggagugcaguggcacgaucuccgcucacugcaaucuccuccucccggguucaagcaauucuccugccucagccucccgaguagcuaggauuacaggcgcccgccaccacgcccggcuaauuuuuuguauuuuuaguagagaugggguuucaccauguuggucaggcuggucuugaacuccugaccucaggugauccacccgccuuuuccucccaaagugcugggauuauaggcaugaaccacugcgccugaccccgauuuauuuuuuucuugugauucuguggucuuuuugagggaugccauuggaaagugagaugaaggaagcagggggcaagacauuagaaguucccugggauggggcaguaggaagagagaaucucauauuucuuuuuucuguuaagccugacaggacauuugaaauuaagauuggacagcccacuguuuccuacuuccugaaggcagcagcugggauugaaaagggggcccggcaaacaggugagggccaggguaagcaucugagauucugggggcuccagaaggaagcaguaacaccugaagagccacuuguuccuuccucccagggaaagagguggcaggccuggugaccuugaagcauguguaugagauugcccgcaucaaagcucaggaugaggcauuugcccugcaggauguaccccugucgucuguuguccgcuccaucaucgggucugcccguucucugggcauucgcguggugaaggaguaaguauccuggcaugugcagugugacgagagggcccagaaagcucuggacucgggcagagcugagagggcccauugcagugggaaagucagcuuuuaagucaagggacccuagauucuagaggauggggugggggugggaggccacauucauugaucuggaauacucuuauugggcaccuguuauguauuagacguuguucugcaaauguucuaagaaauggaaagaucuccaugaaggauccaagugggagaaguucagugugaccugggucugucguccuagaggcaaguggagaaugguaugagggaaggaccagugcgaaggacuuuugagcugugucagguucaugcuugcuccugaggcaaacagggaccccugucauggggcuucggaugacuucaggaauuguuucauugaaguaagauguugggugggagggugucuggccuagacaaccgccgggacagagauagcauucaacccuuuacuggccucuugcugcuguguuacaucccaugucaaggcugacaauugauuauuucccaagaagaaugggguuaagcauggagcagacacagacuugaauuuucucaaaucuuuuuuuuuuuacugggagcauggagauggguaaaucugaccccuguccugggagagacacacaugcucagccccgugacgucauuguacagcauauucuggggcacagaguaccccaguuaaucuggacuggggccuggcugaugccucaaaggaugaguagggauuuaauaagggaacaaaagauagggguguuggggguugggagauguugucccuggagaggaaaugagcaaagguauggaggcugggaagucagggaggcagaaggggccaggcaagcugggcuuggagacaggggccccuucaagccccugcaagacauaggguccugugagcucccacuggugaccaaucaugcgccaaccauuugucuuuuuucacuugcagccucaguucagaagagcuugcagcuuuccagaaggaacgagccaucuuccuggcugcucagaaggaggcagauuuggcugcccaagaagaagcugccaagaagugacccuugccccaccaacucccagauuucaaaggagguaguugcaaaagcugugcccaaggggaggaaggaggucacaccaauaugaugaugguuuucaugacuuugaaugauauauuuuuguacaucuagcuguaucgaggcaucaggccugaauaaacauccuuucuuacccacugucaucuucuaucuugggaccucagggaagggaaccaguacuggugguagccaauaugggcagacauuaggaaauuggggucuucauacugcuucucagaugugcaaacugagguucagccaagcaaaguaacuugcccagguccuuuuuuuucuuuuuuaaguuauaauuuuguuuuauugcccagguucugaauuggugccagagguaggaauagaacccaggccuucucauuugaaauccuguguucuuccccuccccagggugggaacuaugguugcuagggcugagguguauugcuuacuucuuccaucaaaaaucucuuuuaucucugaacaacuugccaccucugcagaaacaagucccuguggagaucucaguucagccccaggcaggguuacuacauggaguacccagaucccaggggcuacuucaggcccuucuacuaagcuccugacccuggcucugggucagauguuggcugaacaugaacuauuguagggcugacagcuacagaccacagaaagagcaaagcuucaguagguuccugccugauggagaaguccucgggaagcccuuggccuucuauuuccucauuguccuuucagagaagagagcaggaguugggggagaaaggagauucgcauuuacugaccaucuguuaugugcuagacacuucauuuuacacugagaaaauauggaaagcauagauaaacaccuaaaagaaaauaaaaaccucauguuaucccacca

SEQ ID NO: 192774 - RNA, 16567 nt, Homo sapiens
aguguuaaauauucaucucuuuccuugggaaacagcuuuauuuacaaaacaggucuaaaauaagaacaugaaaugacaaguccuugggaacugcgggagaggugguucuugugugaagcccaggcauccagacguagggccaaaaaaagggcuagugugaggggaccuaaaacuugaacuccuuauauuucuugcugcccccacggcuguccuggggcugagcuuuccguuuuuuuugcuguauagggagaaagagacacagguuaagacagguugaaccacccccggacccccaaaacaagggugggcagccugacauagacauagaagucugugggaaaggcgcugaaucugaauucucuucgagcucccucucagacuuggcugaguuccucccccucaucguccuuaaagagggcagcccacuggaggauuucuaagacuuccaaaucuaaggaagcacagagcagcaagcagaggccacccucacucucaccacuagagggcaccaugccacugaaaacggcaggccagggucccuggcucucacccagcccagcgccccuggaagcgccuaccuucuguuuggcagcgugcucagccaccaugucacugaaguccuccuucucuacuugagccugcugcucccgcacaugcuccucauacuucugggucauggccauaggauccagcuccaacucuucaggcgccagcgccacuuccacaccuugcagcucaggagccgggcccuuccggcucauaaccuggaaaggagaucagggccuggucaucuccaaagagucagagaagcccuagcuucugcugccuuucucagccuccaaaagcaguauccuccaaguacucaccguggacaugucauaaauguggguugaucccaucauggccccuccaacaguggcuguucucuucucuggcaacacagugaagagcugaggugucucacuucugcgaaggacaaugggaucaggcccaaaaagcaagggacaaaagggucuccagaagcggaaacaaaagauacagguggcaccuccacucagcgccuuggagagcuucugagcuccccaaggaugcagccucugcaguucugcccaugacagaaaagaauugggcggggggguggcacagugcugacuccagggaacacagauggagcuaaggggcccccugaaucaagucaagggaucacagaccaggacucccacaugcacauaagggucaaaaggucagagaggcucaaaguuuccaaaagaacuuugguacagagaagcuggcaagauagagcaggcgacaacaguucccacccgaagaaugucaugccuggaguucucauguauguaauucacacuuccaggccuuccaacgcaagagccauccacagccaguuucaccacuaauuucaaggauuacacuaggaacaagagcaaaucuaccacuaucaccccagacuaugcccaucaucuccaccucucccgcuggaagaggugacaaucuauuguccacacaggagccagagaaaauaccuuaaaacggaugucggguccugucagaccuuugcucaaaacccucugaggcuucugaucauuaucugaauaaaauccaaacuccuuaccaugaccuaaaggguucauagccuggucccuuacccaagcccuccucacuauacucuguccacaguacccuucuuuauuuuucuuccuugaauaugcaaagcuugagacuucugcuuccugacaaggagcaagaggaaccagauacacccuccugccugaaacaaccaaaaaaaaugggcaaaauauaugaaacagugguuuucaagacacuacacauggggcaacaaagcacagugauuccugcgagacaggaaacaaaugugaugagcccuucaacugccccagcauaccacaccugagaguuugcaggccacagaacagaggggagacucauggagagcccugaggacuccgugaguugggaggaugaaacugaaaguccagggagaucaaggcagcuagaguucacaggauagaguacuggagaaaagagcagagagagaacucgagaccuacagaagguccucaaguaugcaggggaguacuaagcagcacaugccuaccaaggacagggaaagaagcacccaaaaggauucauaacagcaacugcugcucacucagaacugggaauagaguaacucccacuagccagccggaaaaaccuccugauucacagggugguggguagaguacacagguacuugugccucacaauggggaggacugcuucaguccugccucaagaaccccaaaacaagaccugaaaggaucaaacuaucuccauauaacuauauucccgaaugagcugaagaaaauguacaggaauacaaaaauaucuuggacccaacaagguaaauuucacaaagccuagcauucaauaaaaaauuaccaggcacuggacaggccugauggcucacaccuguaaucccagcacuuugggaagcugaggcaggaugauugcuugagcccagaaguucaagaccagccugggcaacacagugagaaccucucucaaaaaaagaaaggaaaagaaaaaaaaauuaccaggcgugcaaaagaguaggaaaauacaauccauaaugaggaaaaugaaucaacuaauggcagucaacccagaaauggcacagauguuagaguuagcagacaauacauuaaaauguuguuauagccaggugugguggcucaugccuguaaucccagcacuuugggaggccgaggcaggcagaucaccugagguuaggaguucaagaacagccuggucaacaugguaaaacccugucucuacuaaaaauacaaaaaaauuagcugggugggguggcgcacgccuauagucccagcuacuugggaggcugcggcacaagaauugcuggaaccuggguggcagagguugcaguaagccgagaucacgccacugcacuccagccuaggcaacagggcaagacuccgucauaaaauaaaauaaaauaacauaaaaauaaaauauuguuauaacugcauuccacauguucaaaaaguuaagagagaaagaauagauuuaaaagacccgaaaucaaacuucuagaaaggagaauuauauuguaugggauuacuguuagaucagaaauuacagaagaaaauaauaguaaacuugaacauauagcaauagaaauuuucuaaagugaaauacaaagagagaagaauuucuuuaaaaaugaagagcaucagugagcucuucauuuauuuuuucauuuauuauuucauuaauagaggaauaauuugaguucccaaaggaaagagaagggaacagagaaaauaucugcagaaaucaugacaaaauuuuccccaaauuaauaaaaacuaaaaacccagaucuaagaugcuuaaaaaaccccaagcaaagaaacauucagaaacuacaccaaggcacauuguagucaaauuguuagaacuagugauaaaaucuuaaaaacagccaaauaaaaaugacacauuauguacacaggaacaaagguaagaaugacagcaguuuucucacuagaaacaaugcaagaaagaagacacuggagcaacaucuuaaaaguacugaaagaaggcugaugcggucacucacacauguaaucccaacaagcugggaggccaaggcaggcggaucacuugaagccaggagcucgagaccagccuggccaacauggcaaaaccccaucccuacuaaaaauauaaaaauuagcugggugugaugguaugcacauguaaucucagcuacucgggaggcugaaacaggagaaucgcuugaacccaggagguggagguuauagugagccaagaucacaccacuacacuccagccugggcgacauagcaagauuccaucucaaagaagaaaaaaaaaaguguugaaagaaaaaagauugucaaccuagaauccuaaaccuggcaaagaucuuucaaaaaugaaggccaaauaaagaauuuuuaagacuacucaagcagaacaaauucaaaaccagcagacccacaauacaagaaauguuuuuuuaauauuuuguagaaauggggucucacuauguugcccaggcuggucucaaauuccuggaaucuagcaauccuaccaccucagccuucucccaaaguacugagaguacugagauuacaggcuuaagccaccacgcccccuaacuuaagaaauguuaaaggaagcccuucaggcagaggaaaaaugauaucagauagaaaccuggauauacacaaagaaaugaaagaaacaaaaaugguaacuacauggcuucaugcaugauucuuauuuaaaccucccuaaaagauaacugaccauuuaaacaaaaauaauaacuauauaguauaggauuuauaacauauguaaaagugaauauaugacaauauagugcaaaaauugggaggagagaaaugaaguauacuauaauggcucuuaauacuaucuggaagcaguguaacaucaagagaagguagauccugauaaagacaugaucuauaaaccccagagcaacaacuaaaauaacaaagcaaaaacuuaacagcuaauuaaccaacacuggagauaaaaugaaaucauaaaaauuguucaaguaauccaaaagaagguagaaaaacaggaaaaagggaacaaagagcagaauggauaaagagagggucauuucaugauaaaggggucaauucaugaagaccuaacaacacuacacauucaacuaccuaaaaauggagcuucaaaauacuagcccaucccugucucagugccuuugcacuugcuugcauuuacuguuacuucugacccagaugauccuguggcuggcgcuuuuucauucgggucuuaguucaagcaccaccuccccagugaggccuucccaaaggccucccugccaccccaucccauuacccaguuuccucugcuucaacauccuuaucuacaucugaaaguaucuuguucucugauuaccaguuuaccucaacugcugacuccucacugccuacaguagugccuggcagagaguugguucaauaauuguuuaaaaaaggaugagggagaaaggaacaacagucagccagccagccaaagggaagugaagguccuccccucucagcccugucugguacccuuacccguccaucgccuccucaaucuucuucuuccucagcucaaugaguucaggggucuccauuccagcaggcacugaugaaaagccuccaggagugauaaggccacuguaaagagaggaacaagcucuggaguaaagagaaggaccccaaagauagcccacuuccaagaggcauucucugcuucccccaccugucugcagggguaauaaagccugucucaucugguuugucuucaucacuuucuuccucuuccucuucuucugaggauucuucaucagaugguuccaguuccccccaagggguccgaucaaucucuucuuccucagucuuggucugaaagagaucacuuuaucauucaacaaauguuuucuaaguaccuauuaugugccaggcuguuuuaagcugaagggguguaagagucaaaacacaauaaucccuaccuaccuagagcucaaauucuagugaggagcuuacauuaacaucucaggaaaauguaugcccuuuuccaggcucugcugugucagaacacacaacucccugauaaugaagcuauaaaccaacaaucuaaccuucaugacauuaaguaaaaccaagaucgcuaguacauggcccauaccugaaauucagcagcauugguuccaaacacguccccauagagcgguuucccagucucauccacuggagguuugccccagccaccagcaugguacccaaaggaacagcucugcaagacagugagcacaaucaguucacuccuuagcugcaaaagaaauucugaagcccuagagaaaaggcacacucaaaaguacagagcugauacuugggaacuccggaaauuaugacugcagaauuaaaucaaauguuaugaagcauuagaaaccaaaauuaauaaacaacuaaaaucuggaggcaacaggauaaggagacaggaggcagaaaguaugcuaauaacuucugucauggcagagucuuuacugucugaaaccaaaauacguacauugaaaacaugacuucaauuucuuauugaguuuuccuaacuuuggaaagcuagcuuguucagaaucuauuuaucuuaaggggcagaaauuucuaucuaaaauuuaacaauacuacuguuuuacuuuaaugacucaucaauuuuuuuaaugcuuauuuuaaaauaagaaauuugaagacauucuugagauaaaauuauuucugagagacugaagugaagcuaaaaaaaaauuauuucuuuuuucuuuuuuuuuuuuuuuaaaguagaggugcgguuucacuauguugcccaggcuagucuuaaaccccuggccccaagggauccucccaccucagccucccaaagugcugggauuacagguguugagacaccacaucuggcugagauaaaauuauuucucucuggucauucuuaauauucagagacauaucuggaaacacauucaccaaacagugaauuuggcuauuucugagugguaaaauugugacuugcuuucaucuuuguacuugucaauucugacugaauauuuuaugaugagcaugucaguuucuuuaaaaaacaaaaaccauuauuuguuuuucuacacauacacaugguauaugacaaauauuaugucaauaaaauauuuuuuaaguaaauaaagagacacaugguggaguuagagaaggaaaacaaacaaauuaccuuccaguucaaaagcagaaauggccaagaaugaacgaaaggacaaugcucaccucagggaugggcgaguucagcccagggauuuucagguugggauacgaugggggugguccauaucgcugcauggcaaucagccaugggggagggaccuugugggcauucugcaggaaaaagagaacaggauaccaucugccaaacccuaucccugucucugccuuccacuccaauccccaccagccucuucgcugcuuccccagacagcuaacugacacucacugguccuacuggcauccccaaggaaauccuuagcucaucagacagaucuccuggcuucuucuccuucagucgugucucgaacuccuuccccugagggaaaagcagagcaugcuacauuguagacccagacacucagugggagcacaauccuaacgcacaucagauauaaaaucccagugagggcuaccuggcucccacucugauucucaucacuucuuucccuggccaaagucggggaaggaauaaaaaccaggccagacucacagugcugucaauaacccacuaugagaacacggccaacguuaggaccugccuccucaucuguaaaaugagggcacucgacaggaagauaugcaaaauucuuccaccucauaaauuccaugacaucauggugacuacgauuucaaggaucagaaaaaaccagcaauuucucuaccacucccaauauuaaaaguuuccuaaaagcaucugccccuuggccccuccaucccuaaaccaccuaccacaaacuauuaucauuucuaagacaggauacgaagagucuaucagggaaagaagccaccagaucugcaucucuccuccaaauagagccucauuuuuaaauuccaucucauccgaggguagucgaugggcaauucuaaggcugaggaacuaucguaguugcuucaaaagcccuccuuggccaggugcggugguucaugccuauaaacccagcacuuugggaggcugaggcggguggaucacuugagcucaggaguuccacacuagccugggcaacauagcgaaacccugucucuaccaaagauacaaaaaauuagccagguguggugugccuguggucccagcuacucaggaggcugagaugggaggacugcuugagcccccaaggcagagguuacagugagccgagaucccaccacugcacuccagccuggauaacagggugagacuccaucuuuuuuaaacaaacaaacaaacaaaaaaaagcccuagacagucucaaccccaaggcccagccugaccucucccagcccccucccgaaccucauaguacagguccccauggauggucagcuuuggcuuggucugccacuugaagaaggcaucaugcaguuucugguagucgaugucaauuuugcccaucuuaggccgaacuuucucucgcauuuuugacuucauggucuucuguucuuccuguggagaauggcagcaaacaagccuuaacaaguacucaccaaauucauguagagaauccagcucccaacuccaaaugagaucaugggaagccucaauuaucucacccugaaagucaucaaaauccuuccugcuaaaaccuuucaaaauuacauaauccauacugaacaaaacagacuauacaauaucagccucagccguguauaucaauaacuaguuuuuaaaccaucucaucaagagaugaaucucaacaguucucuggaaagcagagacuuccccauguucuuuucuaccuccugaauucaaagcauuuaacuaaaagcuuuaaaauuaagaaguuacacaaccaccacgaaucucuagccacaaaguacaucugagaaaggagucaccaggugagcuggcaaagugaaggcagaggggaggaagagcagaggaggaaaacaaaaggauaauuagacaaguaacaaguaggugguagguggguuucaaaccagauucccauuuugaagcacacugcuaugaaggauggggacacccgggggcaggucugagcccugccaggcccucaccuucuccugcagggccucucgcaucuccuggaugccugugcguuugaugaagucuggcagcucgaaggggggcuucucaaugccccguuugcccugcagguauuugcgcuuaaaacaccaguggcguggcacaggcacagaguuccgaguggccuugaggugaaccaagagcuuaggguccugcgcugucacaucgugcaucuccacgacaucgggccgagccaccagcuggaaaacacauaguaaugcguguucucgagagccccgacuucucaguucugaagcucuucuuccucaaaggacccaaacccaaaucacccacaccuccuucaaagaacuccuuuucaccucccuggcuccccagguggucucccagcugggcuccagggccugcaggauccucucaggucuuaccugcuugaguucagccacagugaagcgguucauucggcgcaacuucuucuuggacagcuugggggcuucuggcuucuuuuccuagaacagaacaaucagcccuuuuaagcaggacucagaugugaaugaaacugcccaacccaccccaaccuuaagccaccaaagcucuguaagaguucaccauggucccucucuggaugcaucucagccaccugugcccagagucccugcuucccaccaggagggcugggccugaccugcucgucaucacugcugucaucaucacuguccuugugcuccucuucaaaucccuucuucuugggggcugcagaguucuccaguuugucaaguuucucuggcuccuucucuuucuccuucuucacaucaucagugagcuaaggaggcagacaaggugaaaccccugcccucugagccccuucccaguuccuaaggccagcacuaaaagaugccuguucaccgcugccucucacccaccucugagccccuucccuguuuggcacugccccuuccuagugugcucuccuuguaccuuaaaagccucaaagauccucuuaaagaagauaaaguugggcucguaaauuucagguucuucagucacauacucaaucucaacaucagcugcuggggaaucagagccacgggaccggguugagucuuucucccgguccccagagcucucagaggacaccccucgcacccgcuggggcuuuuucuucuucuuucgguuccuacgcuuccgguuuuucugucaagaggaggaaaaccagcugggucagggaauccaagcacugugccagcaccccaaccccuaaacuccucccccauucucccccacaguucaacagucaggcuuuucccaaggaggccaucucaugaaguagcugcgaaggggccuuggagucagacuccaaaguucugccacucacaagcuguaugccuuuggguaaauuacugugcgucucagaaccucugcuuuuucagcuguaaaauguaggcacguauaguacuuggaacucaaagcaauuaaaugaaaaauaucuauaagaugcugagggcggaaauuggcacaaaauagaagcuauuacuuacugaacacuuacaaauuguguuauuuccguacccaagucccaucuccuggcuuuccuuccacacucagcuccaaucccuaccuccuuuuuagauacggacacuguguccuccucagucucugacgcugacuggcccagggacgagcgagcaucuguuuccauuuccucuuccucuguaaggaagaagguggugaugagucuucacggugccacugcccugcacucguucacaguaaccugccuuuaccaagagccagggaaagggacagagggaugaggacucagcucagccucuccagguucuguggcuacagcaucagaacgccuggcacucacccugcugagaauucaucucuuccuggcggcucuccuucagcugcaggaucuucuccaaagccugggggaucuuggggcccacagaggggucauccaucugccagagacacccagucagagaaggcaaaucacagugcccuuuuucuuuuuuuuuucuuucuuucuuuuuuuuuuuuuugagacggaguuuugcucuuguugcccaggcuggagugcaauggcgcgaucucggcccaccacaaccuccgccucccagguucaagcaauucuccugccucagccucccgaguagcugggauuacaggcaugcaccaccacaccuggccaauuuuguauuuuuaguagagaugggguuucuccauguugaggcuggucuagaacuccugaccucaggugauccgcccgccucggccucccaaagugcugggauuacaggugugagccaccgcacccagcccacagugcccuuuuuccaccaacuuccaccucuuggacuagaaaggcugcugcccaggugauguaagcagcagagagugggcaacaccaacugggcucagugggguuuaguguuccucagagggaccccaagacucugccucaguaaugucuccccagucccucugccauacccuuaguuuaaauaagaagggcuccccacuacccccaggaauuuaaguccccccaucuucucacagaaccuuucucuaaaaauccaaaaauagucccauccuaaacuaccacucucuuaucccuaggaauaaaucaucagucucaccucucuguucucaucuccagggggcggugggggaccacgaggccggggaacaggggcucccaugggcaaaacuguaggaguggggcccacugggcccacuggagcagcuacuaagagacgggaaaaagaaauccaaugucagaagaggcaaaacacucacguaaaaaauuaccucucuugcugaaagggugaugguaaaccugcaggggaggagggcacguggcguggcuuuuggaaugcugguaauguuuuggaucaugguccaggugcugguuguacagguguguucaguguguaaaaaaccauuaaacuauauauuuacuauauaugcccuuuuuaaaugugauagauaccuuaaaagucuuuuuaaaaaugucuaaaucaccuuccuugcccuuccccucgguuccagggucucaccucgaggacccagaggagugcgcacaccaaucuggcccaugucuugugggggccgagggacuggggugcccaucuuggcaaucuccugcugucguuccugcuccaguaacacagcugccuacgggagggaagugggaguagauacugccugaaaacgcauuuggcaggcagccccuggcaaaugcauucuuucagccggguaaugggcccaaggagaacaaucacgaaccacuugggugcugacauccccuccacccccacacuuccaggcuacuaauccaaacggaggagcccucucaucacaacggaaaaucccuagaaauaacaccaaggaaaaccccaggaaacuucugguuccuagcagagaauuucauauugagccaaacagugccuucuacuuuucagagaguuuucuuccccaaaagauuaaauuauacagaagaaacuuuugagcucuuuucuuauauccaccccucaagauccagcacaaucugggcaaagacaguacuuuacccacagguccagacuuguggcuuuuuuuuuuuuuuuuuuuuuugagacagagucuggcucuguugccuaggcuggaguacaguggcaugaucucagcucacugcaaccucggccuccccagcucaagccauccucccaccucagccucccaaguagcugggacuacaggcaugcgccgccacaccuggcuaauuuuuguauuucugagagacaggguuucauuauguuggccaggcuggucucgaacuccugagcucaagcgauccacccaccucagccucccaaagugcuaggauuacaggugugagccacggcacccagcucauacuuguugcuuuuuaacacuuacuuuuuaauacuccugaguaacccacuggguaaugacugaugcaaugcaccucuggggccaaacaucuuauauaacauucccagacuuacaguccuauucugucuaaauccaauacaaauaacucaauuacccagaguccuaucuagaaugaugucauguaaggcgagcagaggucagcaggcucuuuuuauaauaggucagaagguaaauauuuuaggcuuuauggguugcuguacagacucugguacauauuuuugguuuggguuuucuuauaacccuuaaaaaauuuuaaaguuauuuuuagcucauaggccauacacaugcaggccacaggucauaguuugucaauuccugaacuucaagaaaaauugaaagcuuuggaagauacuagaacuuaguugagaacaaaguagccuccagggaaaacuugaauggugcacucuaagcacuauaaaugacagccaacugacuggaccacgaggucaaagguuagggggagggguauuacccgcuucugcugcuccaagagcucauguuccuucagcgaaugaucucccugcuuaaaaaagaaaacaaguucauaccagcaccaauacccaacacgccaaucugccacaacucuugcuucuugagauccucuuccagucaagggcccauguuccaaucuuuagucccgaccuucccagaagccuuaguucuaggacccagcuuucucuaaggcuccacugccccuucagggaccuaaugaguccaaggccagggcugccaccugcccuaccugcuuggcacgcuccuccugcugcaucagcaaugccgccugcugcugagccaacuucagccgcuccuccucugacagugccacuggcucacccacacggagaggaggcgggggccccaaauuuggugggugggccauaggaaagccaaggccaaggccugguggaggugguggggguggcggaggaggcugcagaggggggagucccaaagguggugguggcaugggaauuccagggagcuguggagaaaauaugaucauaaaacuaggaagcauuuaucuacucauucugcaaauaucugggggaucuacuuugagucaggagcuggaauucuaagucaaaugauacauaguuaccacuccauaagagagaaugcuccacagcucuauaaagauaugagaauguuaacuucuggcaccaaccaaaggaagcuauccacucucuccaaaaagauauccugaauauagauucugcauacaauucuaggagacucaaagacgccucugaggccaucuagggacuccucauccuacacacagagaucaguagaugccaggucagagccacugcuuuagagaaaaugaggcaaauccuggaucagaaggaacauggaaauugagaggacuuacauaaacaggaaccacuguaucugggcaaugcaaaccccaaugacuacuaaacgcaaggggugugaaaucaaaucagggagcccucgaugucacacaaaagaacaugggaacugugccuggggcaggcaaagaaaagggugauugcuuccagcuggguaaggacaagucagucuuccuuguauucaagcuguauuuuuuuuuuuuuuuugagacaagagucucgcucugucacccaggcuggagugcaauggcgcaaucucagcucacugcaaccuccgcuuuccagguucaagcaauucucgugccucagccucccaaguagcugggauuacaggcaccugccaccaugcccggcuaauuuuuauauuuuuaguagagacaagguuucaccauguuggccagguuggucuugaacucgugaccucaagugaucgcccaccucagccucccaaagugcugggauuacaggcaugagccaccaugcccugccucuuuuuuuuuuuuuugagacagucucgcucuauugcccaggcuggagugcaggggcuugaucuuggcucacugcaccguccaccuccaggguucaagugauucuccugccucagccucccaaguagcugggauuacagacaugugcuaccacgcccagcuaauuuuuguauuuuuaguagagagaguuucgccauguuggccaggcuaguuucaaacuccugaccgcaggcgauccaccugccuuggccucucaaagugcugggauuacagacaugagccaccacgcccugccucuuuuuuuuuuuuccuauuuuuugguuuaauuuuauuuuauuguaaguuuucggguacaugugcaguaugcgcagguuuguuacauagguaaaugugugcuauggugguuugcugcaccuaucaacccacugccuaaguauuaagccuggcaugcauuagcuauuuuuucugacacucucccagccccucccccaucaccuccccccuuuuuuuuuuaaagaagcaaagucucauucugucacccaggauggaguacauggaguacaguggcgcaaccagagcucacugcagccuccaaccccagggcuccagcaauccuugagccucuuuauagggacuuuauaggcgcgugccaccgugcccagcuaauuuuuaaaauuuuuuguaguaacagagucucacuauguugcccaggcuggucucgaacuccuggcuucaagcgaucgucccaucuaagcaucccgaaguggugggauuacaggcaugcgccacugcacccggccacaagcugcuuuuggagaagcagacaguggaaaaggaggcaagugucagcaucaaagagagaacugaagagcucacaauucugucauggcaguaccucccugcccaacaacugcaagugagaggaagggcuacccugaacauauggaaucuuuuuuuuuccccacucaggucaggcgaguaaugugcaagggugucacaucucacacaugcacgugaacacccaaucaucaugcucaugaacuacaaaaggaucagcagauggaaucuuaaaaaacagaagaaucucccuaccugugccgacaugggagguggagcggcuuuguccccaucuuccccucucaaaaccggccgauucagcacgaugccagucugcaaaagagaaaggacucuaggucaguccaaaacuagcuguuucacuaaacgacguucgcucccaauucauucaacaaaacguacccagugccugucugccagcgcucuggcugggcacugaagaggaccaagauggauacaagaaauuacaacuaagcuggcaaaggcaagaacaagcuaaaaagggcaagccuccgccuugcugugccgagauaaagaaagaaugaagaccgagccgugaugggguauauaaggucuccuggagaagcucggccuauccugacgucccgccgccaacaccuaccuggcggguguagcucugcagccgcuccaccagcuccucgcgauuaccugcagggcaaaguacacgaucaauggggcaggccagcccggccaggucaggccccagcggccugccuccgccccucgcacccgagucucccggguaaccaggcuccgcuucuccgcaggcccguaaaggccccucgacuuccuguguuccucacccuggaucggagcuccgaucucugccaacuuggccugaagcuccugggcagcccaggcgccauaguggccuggagguggcggcggcggcagcugcaauucugcuuugggaggcucgggaugcuccgucgccaucuuagccgcaggaaggcgcgcgaccaacccggaagcuggg

SEQ ID NO: 192775 - RNA, 26955 nt, Homo sapiens
auuggcucccccgggucgaagggggcggggccucgggcgccgcgcuuccucccgccguggcuuccgcgucgcuucccggucagcugcguccuuagcgggagcccgagugcgggcgguggcgggcuuggcggcggggcaggauuccaggcaggagccuugccucucagguggcgggcucugcgacccugcgaggugagagcacagcgacgucuggcccgggccuccguccccggcugggcgugcgccuugcccugccugggcauccaggucgacccccgguucuugaccguagcaacccgcaccccucccaccagcgcccggucugcacucuuggccccuccaggcagcgccgcucaaccuugcggacccagccugggaucccuuaccguacucaccgagagcuugaggagaccuccagccccccaucccuggcucccgguaacugcuguuucucuuugccuuugcagauggacgggacagaaggcagugccgggcagcccggccccgcugagcgaucccaccgaagcagcguguccuccgugggagcccgaggugggucccacccgcaucuccucuuccacacccuccugggaccccagcccuggagaaguagcucuggcuugucuucuuuuucauuaaagauaauuuauguaucgacuaagaaauaauaagguacauucagauguggaaaacucacagaagucagaggcucugucacuaguuuacuggccagguuggguccucgcucucauuuguaaaaugagcuuguuuaacauagcugugaaauucaaaugagauuauaugaaugaaaagugaaggcugaugugguucaugcuuguaaucccagaacuuugggaggccaaggugggcagaccacaugugcccaggaguucgagaccagccugggcaacauagacaaaaaagaaagugacacguucacuuucuuugugucauuucuuuuuuucuuucuuuccuuucuuucuuucuuugacagagucucccucugucgcccaggcuggagugcaguggugcgaucucagcucacugcaagccccgccuucgggguucacgccauucuccugccucagccucccgaguagcuaggacuacaggcgcccgccaccacgccuggcuaauuuuuugcauuuuuaguagagacgggguuucaucguguuagccaggauggucucgaucuccugaccucgugaucugccugccucagccucucaaagugcugggauuacaggcgugagccaccacacccggcuguguccuuucuuucucccaaacagccuuuugaaagcagggaucaggcugggcguaguagcucacaccuguaaucccagcacuuugggaggccgaggcggguggaucacuugaaguugagaauuccaagagcagccugaccaacauggagaaaccccugucucuacuaaaaaugcaaauuagcugggcgugguggcacaugccuguaaucccagcuacucaggaggcugaggcaggagaaugacuugaaccugagaggcggagguugcggugagcugagcucgcaccauugcacuccagccugggcaacgagggugaaacuccgucucaaaaaaaaaaaaaaacagggaucauaucaugaucuucauuugauagggaggaaacugggcccuagggagguuaagucccaggcaggcuguggaagcucuccaggugauuacauacugcagcuucuggugccucaguucuugccugagaaguagaucugaaccugagccuccucgaagugauuuugugaucucugagaguagcugcuggagcauaacagacuggggguccgaggagcaccuucucuuguguagaugagaaaccgugcccuucccuuccacacacucuuggagggaggaguauuagcucuacuuuuacagaugaggcaacugacaacuuaaauugacucccugaaguuggccagcgaccaggcaaggaugggaacccgaguaugucggccccaaacuccaguguuccuucaccaugccugcagucucagggauggggauuugaaucugguugcucuuccaggugucuccauuuggcucuggaacccacaaguugucacaagggaacucucagcuauuugggcuguucuucccuagccugcuucguauugacuccugaggcuuaaagaguccucagacuuaaagagucccaaggaagcugagaccuggaacuugcuuuaaccugggugaccuaaagaauuaucucuucgcaucuuagccucagucagagagagacuugccuaaggacagcagcggguuaccagcucucgcuccugccagccagccagacuaacugccauagccucaggaugguuucagccucucuaugcugugguuucagccucucugugcuguaguuucacaucuguggcauguucuuguucagggcagaagaacaguugaauccuuggggcagcuaugguggugaggggcagguuugcaauggccaggcuuaauuugaaucuugggggauugcgguggggcuggucucugggcaggaguuacuggguuucugggugguuuaagggugucaaggaagcacuaauagauagcauucgugauagggucuuuuggggcugcuggggcucugccucuggcgaggacucugucucaggagcguagcccuggucaccccugagggguguagggugggggcuccagccccagugggugguagagggugccugguuggccuggccuggcugugccaggcagaggccucagcugagccugccuggucuccaucacagcggcugacgugcugguauaccuagcggaugacacgguggugccccuggcuguggagaaccugcccucgcucagugcccaugagcugcaccgcgcuguccgcgagguccugcagcuuccagacaucgcccuggaugucuucgcgcucuggcuggucuccccucugcuggguaaggcuuggcagugaggagcccaggcuggaggguuggaagggcacugaccaguacaggagggagggggcaguguuuggagccgcuggggagccgcuggccacugcccauggggaaaggugggacuuggguuuauccugagcuguccaccugucugagcaccuagagcccugagaaggcccccgcuccuggcccugcugucugucuuucugcuggugguggaggaguggacacgccugccccccaggucgugcugggacugggugguccaggaacaguaccgcaggagggagggaggaagggggccuugucugccgagcauaaccuuugccacaaccugggugguguuugggaaccaugauuucaccuuguccucaggccuaggccagucuugcagauggaaguuguaguuaggguggcgagaccacuguguggcaggagcaagacagacccaggccugaguggcuucccggucggccucuuugaacuguuccuguuccuuggggacagggaggagaagggacauggcucaggaaguaggccccucugacccugaggcucuuagugagggugggaagaguagagacuugacuucucugggaggggggucuucagccuccagcccugccuggcuggccucgugaccacccacauccugcccuuucaagcugaaauugcaagauggagggacuuaagggcgguggcucucuagacacucagcccagggucccucagugaacagggucucugagccugcugguucgcacaggagggggccaagggagaggcugccccauguuguuuaguaaaucggugccauaggccgggcgaguuuucuuagcuuacacauucccuucguuauagaggaaugcaggcaagaagagggugaccagucccauugagggagugcguaggacagccugguuuagguccaaggggcccccagcaguuaugucuucuccugaggcugcugguugggggagagggaacauuuggcaccccugcuccccacccucauccuucucuccacccccuccccccugccaguaggagcuuccugcucagcugcugcugggaggugcccgcccacccucuuccugcugccccggcuccucggccaccucaugcccagccuggucaccucucuuucaccuccgggccucgagucaggacugugggccccuugguuugugucugaaagcuggggguacaguucugcauggguuggccccugccuuaccucgggaagcucccagagccugcugggcagccugccuccuccucucaccuccuccgucuccacucccuccucaccacauuccggcucucccacggccggaggccgugaaugggcugcuuuguugcccggcccacacaggaggaugguggcagaagaccccggcacaaagucagcacccacucuguucccaggcuggguucagggaggcugaaaagccacuucagcugugacuugggcccccccagaacccuuuucccccggccccugcaccccugauggggugaaccggugacagaugccccagggccgugagugcccugcaagggcagggaggggcgcugucuucuggagcugcccuucaugccggauguuuuggcagggcuuagccuucucaaugucguugucacucugcguggaacagggcuccagggcccuuccgucccauuuggauagcagccuccaggcaggaaggccccaucuggaagugucugggacugcgggaguucugaagacaggaaggagucuuuugagcugcuggggcuugggguuaaggcuggucagggcugggcuguaggcagcaggaaggacauccuugucuccagggugucccuaggccccaucuugucaguuacugugcuuguuccacaaggacgugcaaagccucucucaggccacgugguauucuagaugcugggaauacaggagggaagacccugguggaacuuaauuuaacuuaauuuuauuuauuuauuuuuuuuuugagacagagucucacucuguugcccagguuggagugcaguggugcaaucccagcucacugcaaccuccgccuccuggguucaagcgauucuucugccucagccucccgaguagcugggauuacaagcaagcgacaccacgccuggcuaauuuuuguauuuuuaguagagacgggguuuucccacguugagcaggcuggucucgaacuucugaccucaagugauccacccgccucagccucccaaagugcugggauuacagacaugaaccaucacgcccggccaccauuggaauuuuagagccuaaaggaugguaaagggggguuuaggaagcagagcucuguuccugguuuagccaguagccccauguggccucaggcacugugccuuccccagcuucaguuucccugcuguaaagugggugaucuccauguccuccagcccuuugaguucccagacagagagagcaugaggaccccaugaggggcucaguggccaagugaggggaguuaauggagcccuuucuggagggaguggggaggcaacuauuggggguaaaugguguuucccuacuggagguggugacagauggguggggcccagggucuagguuguaaaggagggcuguggggccucugggaaaucuggaccagaaauguugggacgagaaagggcugcagaggcuggaugcagggguggguggaagggcugugggcaagggggcccguguggagcuguggcugcucuuccagguggaaggcccagauggcccaaagagcagagacaaggaccccuggccucaggccagcaggaggggcgauuggccaucaguggggacugccuaaggguagagcagggagauguggaucaggcagcgcucgggaagcuuggagcaagcgcuggcuccugcaccccggugacggacauccccauacaucucuggaugaacuuggaaguggccucacaccucucaaaggcagagaacccgguggccacuguuuuuuggugggugcuggugugugagcugaaaggcuuugucccuccuggccugaggcauugaguccuggguccagagcagugguggcauggggcagccuggaguuugaggggcuggacugcugcacuuggucauucugccaaccccuggcgaggucacugugccccagggauacggcgguggacaauucugcagccccuguggguggcagcagcgaggaaugucagguagugaucagccugugaaggcaaacagauguggcaccauuggggugauggaaaauuuugaggaggggcugccuuaauuagggguccagggaagguggcccuugaacuuagaccugaaucagccagccacgggaggaucuggggcaaaggaguccaggaaaagaagaacaucaagcgcagaggcccuggcacaagcaagcuggggaugauuuaaggagauuuaagaaggccaagguggcaggagcagagugggagaggcagugagagaggagauaaggugggagggccaggcaggagcuggguugcgugugggccacggaggugcagagcuugcaggauggaaggucagcuggagcuccucagaggugucagaggugggcagugaugacggggaggcccaggcucugccagugggggggcaaggcagccccuugggccucugggccccaguugucaauuuccaguucugcuuccugauggcacugaggguuccuuugugccccagcaccuuccauuggccagucuccaguuucagcuugccguggggcugcagugaacacuuaguggcuggcucugccuggagccagacccccgucgcuugcugugugacuguggacaaggaacuuggccucucugaggcucauuugcucuaugggugaaaugggggauaggguuauugcagaguaaauggcucuggacccuuggcaccugcucaguuacuauugguugcgacugucgucaugcugugcggugugauagguggaagggcagccacuggacuggccggaggcugcaugggccacuccccaucucguccugcagaggugcagcugaaacccaagcaccagcccuacaagcugggacgccaguggccggagcugcugcugcgcuucaccagugccccagacgaugacguggccaugggucagugcugcugccugucuguccuugccucgggaccaccugagucugcaucucuggcucccagcccagccagggcccugccagcaaggagcugcccuggcugaggggcagggccugcaucucccccaggcuccgucagccaccccuggcaggggaggaaggggucccugagugaagccccauugggggaugggcugggagccaccggggcacguugggaugagcugcacacuccacccucugcacggcccuccgguuuucucagcccuggugggugagguugguggccagggccugggccaaucgggagaggggagggcuaagcagaguggggaugcccggcagugacccagccucucuccccagaugagccuuuccugcaguuccgaaggaacguguucuucccaaagcggcgggagcuccaggugaggcaggagcccugguggccccaccaggccuggccccuugugcccagccucccugucccuagaccccuggacauucgcaccuugccccagcccaacugagcagcucucccugccccagcccagcugagcggcugucccugccacaccccccugcagauccaugacgaggagguccugcggcugcucuaugaggaggccaagggcaacgugcuggcugcacgguacccgugcgacguggaggacugcgaggcucugggcgcccuggugugccgcgugcagcuugggcccuaccagcccggccggccggcagccugcgaccugaggugagggccugugugacuugaggcgggggcgcugggugggggaguuuguccuuggaauggaacuuacaagcagucuucagucucgcaaggugggggcaggguccuggagucaggaggccucagccccgcaggcucacucuggcccuaggcaguuguuccgccccucagccuccuuuuccucaccuguccugggcuggagccucaggugaagugaagucugggagaagaaucuggagcccugccuccugccggccagggucagaggagcugggcuuuuggagucacagccagggaccacccagauacugacccuuugucaccaguaacaggccagcuuaguuccagacuucugggguguuccccaggcggucggcaagcuggcuguccaccucccagcccucuccaggagccgaguucucugcuguguaaauuagcagggccuuggguggcgaggauugagucugcccugccaaagcccaggccggucucuggucuccauggaggauuaucccgagguuuagaaauaauuccagugaaggggccggacgcgguggcccaggccuguaaucccaacacuuugggaggucaaggcaggcaaaucgcuuaaggucaggaguaugagaccagccuggccaacauggugaaaccccaucucuacuaaaaacacaauaaguagccaggugugguggcacacaccuguaaucccagccguuugggaggcugaggcaggagaaucacuugaaccugggagguggagguugcagugagccaagggcaugucacugcacuccagucugggugacagagugagacucugucuuaaaaaaaaaaaaaaugccgggugcgguggcucacgccuguaaucccaacacuuugggaggccgaggcgggcagaucaccugaggucaggaguucaagaccagccucaacguggagaaaccccgucucuacuaaaaauacaaaauuaucugggcaagguggugcaugccuguaaucccagcuacucgggaggcugaggcaggagaauugcuugaacuuggcagauggagguugcagugagccgagaucaagccauugcacucuagccugggcaacaagagcgaaacuccgucucaaaaaagaaaaaaaaggacugagcgcuccaacugcagcuuaucugauggccgguccacagcccacagaguacccgcugccugaggcggggaaccaacuguggguaugccagggccucuccuccuucauguggggcgggggagaugcccuuucuuuugugagccugugcuaguuguagguuggcguuuucacguuuuuaucuggcagaacaaagcauugagagcauuaaaaccccugcaccaguuuugguuauaaaaguuccaccaguucagaaaucccaacguuccugacuuggugacacagauguugcucugaaacccuccugcugcagucugauucuaggcaggugggggcucuuuguucggccuccagaccuucccucagccucucaccucugcugugagcugcagaccugggcccaucuccugggccuccuucacucgccuggcugcccugugugucugugugcccucgcaggugggggucagggaccucugcagugccgggcacacugcgggugcucagggugguggguuccuucccuucugggggugaagaggggccuggugacuccucgugucuuucccuucggcuccuaugaguuuccuggguggacacgugguaaccaaccaggcaggaggcaggaaggguugggugacaggaccaggccccaugggggcccuuggugcacauggggcugcagugcagaggcugccggcucaggcaggacuggugggaagugcaggaagguggggcccggguuccuguuccuggauggagaugcaggcaucuggagccgcaggaugagccuuuggcuucagacggugaccccgggucagacgggcagagggacagccccaggugggccucauagggagccccaucacaauccuuggccugcaccuggagagcuugucaaguuuuagggccgggggagcucaccugggacaggugggggugucaccauccccacucugcaaaggaagcaggcgcaggacaggaggugccucucaccagcuguacagcugcucucggcagaagcagacaggcuggcccuggagucugcccuucggaggggggccgagaacugaacccccucugucuggugccugggucuccccuugugggcuccuuacccagccucugacuuggaaguagaugugugucugcuuccuccaggcagccuugcuucccucgcccucccccgugagccuggcaccucugguugggccgcuagcaccugucuuccuuccuccacagggagaagcuggacuccuuccucccugcccaccucuguaagcggggccagagucucuuugcugcccuccggggccguggggccagggccgggccgggcgagcagggccugcugaacgccuaccgccaggugcaggaggucagcagcgacggcgggugcgaggccgcccugggcacccacuaccgcgccuaucuccucaagugccacgagcugccguuuuauggguaagagccacagccccgcggucccccacccccuccgcaggcuguucuugggcuuugcuagcacagcugccagugagcccaccucugcuccagcugagcuguguccccaugaaguggugucuugucacgagcaccucaggccccaccguuccaagcugggcaccuguccuccccuuccuccugucaggggcugggacaccuuggauggguccucuccuucuaccuggcacagucaccucgucacuggcccggccgaccucgccuucagccagcugucucugucacgcaauuguugucuaacaaacagcucugugcaccuacugcacgcacgcucccugggcacuggaggucccccugagccagagacaccgugccccugccugaugaagcugauguucuaguggagagagacgagaacacagagguugaggagagccugucauugggcacaggcggcagccaggagaccagaggaugggguguggcuugggccuuguggucagaacaggugagauggucagaugcaggacguucugagggcagagugacaggauuugccagauggaugugcaguggaugaagcgaaggagaggaggcagagaggacuggccuaagccccuggcagauggcguuguccuccgcugagcugggggcggcacuguggaguggucagggaaaguuuaggaauuugguuuuuuguuuuuguuuugagacagggucuugcucugucacucaggcuggagugcaguggcacaaucguggcucacugcaggcucgaccuccugggcucaagcaagccuccugagucgcugggaccacaggugugcagcaccaugcccggguaauuuuucuuucuuuuuuuuuuuuuuuuuugagauggaguaucgcucuuguugccaggcuggagugcaaugccaugaucucggcucacugcaaccucugccucccagguucaagcgauuuuccugccucagccucccaaguagcugggacuacaggucugcaccacuaugcacggcuaauuuuuguauuuuuaguagagauaggguuucaccauguuggccaggcugaucuugaacuccucaccucaggugauccgccugccucagccucccaaagugcugggagccaccacgccuggccuaauuuuuguauuuuuuguagagacgggguuuugccuguuggccaggcuggucuggaacccuggggucaagugaugcucccgccucagccucccacagcacugggaucauacgcaugagccaccgugccuggcugggagcuugcuuuggacauguugauuuugagauacuuguuagacgccccacuggcgacuucgagugggcaucuggugucuagugcagucugaacuggagcucguauuuggcgaauccuaugcauauggauggcaccugaagccuggagagaugcugggaggcaagugugggccaggugagaaggggcccugggccccccagcaaggcaggagggcucuacccgcagcagcuccuagcgcaugccccgcuuguccuccuggcagcuggcgauggaugugggcuccagccuggugggcgagcgugagcagggauggagacagugagugugaccagcugucacaacucugcuguaaaauggggucaagcaacgggucuuguagugguuuugagggggaggugacagcccaugugugcugaccggcagguggcccucuccuggcugcuuugguuuccucagugaaaucggagggcuggccaucagcugagcuugggggacagaagucuuccggaggaggcuggagcaggacggccccaggaauucaagguggcccaugcuggucuccagccccaucccaucgcguggagagagcgggguuuaacuugggcucuggcucaguggguggugagggcaagggugagccugagggacaggagaaggcaaggcugcaggagggacagguggcagcucuucucaauguuuuuuuuuuuuuuuuuuuuugagauggagucucgcucuguugcccaggcuggagugcaguggcacgaucuuggcucacugcgagcuccgccucccagguucacgccauuuuccugccucagccuccggaguagcugggauuacaggugcccaccaccaugcccggcuaauuuuuuuuguauuuuuaguagagaugggguuucacccuguuagccaggauggucucaaucuccugaccucaugacccgccugccucggccucccaaagugcugagaucacaggcaugagccaccgcgcccagccucuucucaguuuugagcccuggagccacuccccucaccuccucgugcuucccagcaggucccugcugcugaaaggucuccgccuggacaguggucagcaggcucuccuggccaccuccagcagcccuggcccccagaccaagugccaaacccacgacuggcuuugcuccacaccuggggccacgcgcuucccuccgccugcagugcccacccuucucugugccaucaggcccuucucccuccggucgcacacugccagcucagaugcugccaccccuacgaagccuccccuucaucccaccucuguuucucccuucccuggggcggguuucagucacccaaacagcagaaguuccucagagcccagguuggggccucgagcagccucccucagcauuucuggugcuggccggaggcugaccccaguccccuccccaggugugccuucuuccacggugagguugacaagccggcccaaggcuuuuugcaccggggugggcgcaagccaguuucuguggccaucagucuggaaggcgugcacgucaucgauagcagagagaagguacugcccccagcuccuccaggguggagaggaugggagggggcuccugacucaggucuuccugguuccucugggccugugggggccugggggcaagguggauggacugucugggagggacccugccuccguuggauguccucguagccccugagggugauccuggguccucuugcccaacaugcuaggcugugggguggccggggcaggggaggccgcagcugggacuucacugcugaguggagggagggcagcagggcccgcugcucugccuggcugauggcuggagaacagccugaugcuccagaagaccccgcgacgggagcccucuugggcugaccguguccucuucuuucugcguuugguggccagcccuggguagagagccgcgucagcagccagcccuguggggcagauuaccugucccuggacagaaauuugcuccuaagccagcagaagaguuuuggcuggcuucugguugucccggaagaaggaccccagccccugcugccaucuguguccugggaggcagggcccagcucagccucaugcuagaugccacgcccgaccucauagaagagacuccgcuuccccaccugccuccucccccacgugccucccccgcugucaggggcuuggccugcuggugggacuguugugggagaggggaucucagcuucccuggaccacagccccuggcaggcucugaugaaagcugaggcucucuccuuacagaaacacaugaacaaauguagacucagccuuggagaggcacacacccuggccaggugucugagugggaugggguggggagcagaccucugcccaggggucaagccuggcucugugucuccugcuggccagcauguccugcugggccugcgcuuccaggagcugucgugggaccacaccucccccgaggaggaggagcccaucuuguggcuggaguucgacggggacagcgagggcacaccugucaacaagcuccucaagaucuacuccaagcagguagcgcggguggugccugcacacggguggggaggcugggcccaggugcccugggucccagacaauuagaggcaccaggcuggcgggcaaggaggugagaagcugccuugggccugaggaugaaagcggccugggcacaaggggugccuugaguccugcugacccagagcugcccugggaggucaggaggccuggucugcagacuccacgccgguggugguggcagcugugggguucgggcagcuguuuguugagggcuugcugagugcuuugagaccagccugcacccuccccuccuguccccaagaccagugcuguugugacccuauucacagucaccugcggugggcguggaaacguugggccucuccaagccuguguuugauuuuccccuucauucgucguguuuuacucagcaccgagcaccucuucuaccccagccucccuccccagccucccuccccagccucccuccccugccucccuccccugccucccuccccugcuucccuccccagccucccuccccugccccucccucucccacuugggucacaucagacgccccucccucccacagggcccuuucaggacuguucccaccccuuccuccuuucaucucgggucucucuggauccuucauuccacaccucuccggcuuccuuuuggugcccuucaccccucccuuggcagccagaccccaccccugcgccucccaugcugggggcugcuucuagccccaucggccucugcuuugccacaggagggcccccucccccuucucagcuuaacuacaugcuccuggaagcuucuuuccgcccccaccagccaccuccucccccagcuuccccugcugcuccccauuuuccuggccccccucgagggcacuccucucccugccucauggcuuugaacuccaagauauucucaccuuuauguucaaaguucacaauuuucuuuuuuuuuuuuuuuuuuugagacggagacugguuuaugcuuuuuguuuccuaagaaauuuugccuaacccaagaccacaaagauuuucucauguuuucuuguagaaguuguauaaauuuaagccucccagccaucccaaagucaauauuuuacaucaggugugauauacaggucaauguucauguucguguuuacagauucucaauuguuucggugucguuuguugaaaagacauugaauuggccgggcaugguggaucacgccuguaaucccagcacuuugggaagccaaggugggcggaucucuuuaggcucagagcucaagaccagccuggccaacaaggugaaacccccaucucuacuaaaaauacaaaaaauuggccgggugugguggcacacgcccguaaucccagcuacuacuugggagacugaggcacgagaaucacuugaacuggggaggcagagauugugguaagccgagauggugccacugcacuccagccuaggcaacagagugagacucugucucaaaaaaaaaaaaaagaaagacauugaauugcccugacaucuuuguugaaaaucaauuggcuguacaugugugggucuguuucuggauucccucuucuaaaccacugauauaugugugucuuucacugauaaucacacuauauauugauuuuugaaccuuuauaauaagucuugaaaucagguagucugauaaccagaacuuuguucuuuuuaaaaugguuuccauagaaguuuuagaaucagcuuguugauuuguagcaugcuccgcuauccaccccccaaaaaaaggcuaccuaggauuuuuauugagaucgcauugauuacuucggaggucauugaccucuuaagucuuccaguccauuuauuucuguaucuccauuuauuugucucugauuucuuucauuaacauuuuauaguuuucagcauacaaaacuucugcaucuuuuguuagauuuauccauuucuuuuuuuuuuucuuuuggugcuacuguaaauggcacuguuuuuaauuucaauuuccaauugaucauuuccuuauauagaaauauaauuguuuuuguuuuuuuugaaacacucuugcucugucaccgaggcuggggugcaguggcgcaaucauagcucacugcauccuugaccucugggcucaagcuaucaucccaagccacaggugugcaccaccaugccaggcuaacuuuauuuuauauuuguagagacaaggucucacuauguugcccaggcuaaucuugaacuccugggcucaagugauucucccaccuuggccucccaaagugcugggauuacaggcaugagccccugugucugccuuuuuucuuuuuuucuuuuuuuuugagauggagucucacucugucgcccaggcuggagugcaauggcgcgauuucagcucacugcaaccuccgccuccuagguucaagcgauucucucaccucagccuccugaguagcugggauuacaggagccugccaucacacccagcuaauuuuuguauuuuuaguagagauggguuuucaccauguuggccaggcuggucucaaacuccugaccucaggugauccacccgccucggccucccaaaguguugggauuacaggcgugagccacggcaccuggccuggccugggacuuucuauguggacagucguguggucugugaguugggacagcugggucucacuuuccaaucugugugccucuugcuugccuugccugacagugcuucugacccccaguguaggauggauaggugugcgcaggcgucccugacgcaccuggccugagagagaacauugucuuucacugaauaagugggauuuugcuguggguucuucagagaugcgcuucaucagguugaggaaguuccuuucugacgcuggcuugcugaguuuuaucuuggacagauguucagcagagcuuccucuuuuggcugcauuugaacggcaggcuuccugagccucagaggcauguugcugugcaggaguuuuuguucuaggaaacuuaguaggcuucccuguuaugguugcacucaggacucuguccccaccggcugccguccccucgccagcccacugcccuuuggcugguggaguccacuuggugaggagaggaguguggguggacugagcugagggcagggagcguggagagcccaccaggccucugcucuuccuucugggccgagcagcggugcccaccugcccagcccagagggauuguagcugcccuguggagaggcaggagccaggccagucuccgcagggccacuccagcaucugacccagccccaccagucaggagcacagguggccauuccugucuacuuggccucaucuuaucccaggccugcagcagugcuuggcacgugggaggcacucaggaaauaccuguguccuaaggggugccacccuuuuaacacccucugcgacucccucaaaccccugaaggcccuguccuuggugcccagcugugcccgcuggcacccggcugcugcaucuuuucugucagugugccucaugcuucacaccuguugaguaggagucacuuuugaagaacgugcuggcagggagccgcccgccccugcccuggugacaucgcgccccuuccuccuggcugcagguuuuccucccagccagcaccacccgccuccccgccccgcuuccccacucuucguccucucugcagcagcuggcucccuacccccucccuccccaccugcuucugcccauggagucagccuuccugggcugugccuucugaccagaauguucuuucuuucccaccugaacucccagaucuggagaccccuccucauccaccaggacucaccuucacagucacccaagugggacaccuccccugccucccugcucccucccuccugagugauguguguccccuccccugcuuccccaaccagagagcagagcucauuucaggcucagcaacaggcauggaagggggcccuggccaggccucacacugcccccuccuccccaggccgaacugaugagcagucucauugaguacugcaucgaacugagccaggcggcggagcccgcaggcccccaggacagugcgacuggcucgcccucggaccccagcuccucacuggcuccuguucagcgccccaagcugcggaggcagggcagugugguguccagccggauccagcaucucuccaccaucgacuacguggaggacggugagcagcccuucugugcaugugcacacacaaacacgcaugcgcgugcacacaccggggggaguuccugaggacagggcauugcagagcagcuccagacccagugugagcuggccuccaucucaggacacagcugugagcaggccgagcccgggccuuggccauagugccuuuccugucccuucucacugcugcgucacagacguucugcagcauuguccaggaugugauccgggaaacgacucaacaucuguuacugaaguguuggguagguggggcgcgguggcucacgccuguaaucccagcacuuugggaggccaaggcaggaggaucaccugaggucaggaguucaagaacaggcuggccaacauggugaaacccugucucuacuaaaaauacaaaaaaaguagcgagguguauggcaggcgccuguaaucccagcuacucgggaggcugaggcaggaaaaacgcuugaacccagcaggcagagguugcagugagccgagauugcaucauugcauuccagccugggagacagagcaagacuccgucucaaaaauaaauaaauaaauaaauaaagcguuggguaaaucacugcugugaccacaucuugggguguugagugcagcugguaaaaauacaguacccaggccgggugcagugucucacaccuguaaucccaguacuuugggagaccaagacaaagaggaucacuugagcccaggagcucaagaccagccuggacaacagagugagacccugucucuacaaaauauacuuaaacuuagcugagcacggugguauaugccuguagucucaccuucuugggaggcugaugaggcaggaguaucucugagcccaggaguuggagguuugcagugagcuacgauuguaccacugcacuccagccugggugacaacgaugagacccuauauauauauauuuuuuuuaauuaauuaauuaguuaacuauuuuugagacggagucucacucugucgcccaggcuggaguacaguggcaugaucucggcucacugcaaccuccgccuccccaguucuagugauucuccugccucaaccucccgaguagcugggacuacaggugugugccaccacacccggcuaauuuuuuuuuuuuuuuuugagacagagucucacucugucgcccaggcuggagugcagugggcgcgaucuuggcucacugcaagcuccaccuccuggguucacgccauucuccugccucagccuccuaaguagcuggaacuacaggcgcccaccaccacgcccggcuacuuuuuuguauuuguaguagagacgggguuucaccguguuagccaggauggucucgaucuccugaccuugugguccauccgccuuggccucccaaagugcugggauuacaggugugagccacugcacccggcccuaauuuuuuguuuuuaguagagaugggguuucaccguguuagccaggauggucucaauuuccuguccucgugauccaccugccuuggccucccaaagugcugggauuacaggcgugaaacaucacaccaagcccgagacccuguuuuuaaaaaggaauacccuggccgggcgcaguggcucacgccuguaauccuagcacauugggagaccaaggcggguggaucaccugaggucgggaguucgagaccagucugaccaacauggagaaaacucuucucuacuaaaaauacaaaauuagcuggauguggugguggucgccuguagucccagcuacuugggaggcugaaagcaggagaaucgcuuguacccaggagguggagguugcagugagccaaaaucacgccacugcacuccagccugggcaacaagaacgaaacuccgucucaaauaaauaaauaaauaaauaaauaauaaaaaggaauacccuaaaugcaucuugugucagauccuggaagagaggacauuuguggaaaaacuauugaaguccaaaagaauuuuaguuaacagauacugugucaguguucauuccuuagcucugauguggugacagaacaugcugucaucgggagaaguuguggcgguauucuggaacucucuacaccuuuacagcuuuccuagaaaucuagaauuauuccaugauaaaaaguuuuuuaaugcaguaacaaagaucuacauuuauuuauuuauuuauuuauuuauuuauuuauuuauuuagagacagagucucgcucugucacccaggcuggagugcaauggugugaucuuggcucacugcaaccuccgcacccuggguucaagcgauucuccugccucagccucccuaguagcugggauuacaggggugagcuaccacgcccaacuaaguuuuguauauuuaguagagacgggguuucgccauguuggccaggcuggucucaaacuccugaccucaagugaucugcucaccuuggacuaccaaagugcugggauuacagugugagccaccgcacccggccagagaucuacauuuuacauggcaagauguucacaaaauaauauucaguaaaaagaaauggccaggcgugguggcucacgccuguaaucccagcacuuugggaggccaaggugggcagaucacgaggucaggagaucgagaccauccuggcuaacaggugaaacccugucucuacuaaaaauacaaaaagaaaaaaaauuagccagacgugguggugggugccuguagucccagcuacucgggagaauggcgugaaccugggaggcggagcuugcagugagcggagaucgcgccacugcacuccagccugggcgacagagcgagacucugucucaaaaaaaaaaaaaaaaggaaaugaguaacaggacagcaugugugcagccaugcgcaugaggagggcgggcccagcuguggccgucagcggcuguagcuuugacuuuuucuuuguacuucuuggagcacguaaaucuguuacaaugaacaugucauuuuuauagucuuguaauuuuuagaauaauuguuuuuucuuuuuuuuuuuuuuggagacggaguuucacucuuguugcccaggcuggagugaaauggugcgauaucggcucaccgcaaccuccaccucccggguucaagcgauucuccugccucaggcucccaaguaucugggauuacaggcuugcaccaccacgcccagcuaauuuuguauuuuuaguagagacggaguuucuccauguuggucaggcuggucuccaacucccgaccucaggugauccgcccgccuuggccucccaaagugcugggauuacagucgugagccaccgcgcccagcccuagaauaaguuuuauaaucagaaaaagcaaacuuuuucuacaauguaauuuggaccacuguguggcauuccuuggcaugguuuuagcacgcucauuuugacccaguccucugcuugugggcauuacaguuuucagcguucagcucuucuaaacagcacaccuacaggaaaguccuuccuuagaaucugaaauguuuccucaggauacuuuccuagaaauggccuugcuaauguaaaagugugcagauuuuuuuuuuuaaauaggauuucacucuagugccuagacuggagugcaauggccuagucaaggcucacugcagccucaaccucccgugcucaagcaguccuucugcagucuccugaguaggugggacuaaggucaugagccaccacuccuggcuaauuuuuaaauucuuugucaaggcagcgucucacuauguugcccaggcuggucucaaaacuccugggaucaaaugauccucccaccucagccucccaaagugcugggauuacagaugugagcaccgugccuggccgauaugcugauuuugaagaggcuuuucauaccugccaccuuccagagaaguugugcccagguguacccuccccagcagagaagauggugucugccucccaugcccucacccacaauggguguaaucauuccgagccaaagggaacuugucugggcugguguuugaacacaaugagauuggaaauuuuuuuuuuuuugagacagucuugcucuguugcccaggcuggagugcaauggcaugaucucagcucacugcaaccucugccucccggguucaagugauucucccugccucagccucgcaaguagcugggauugcaggcgcccaccaccaugcccgaucaauuuuuguaucuuuaguagagacaggguuucgccauguuggccaggcuggucucgaacuccugaccucaggugaucuguccgccucagccuccugaagugcuaggauuacaggaauaagccaccgugcccggccgauugcaaauuuuuacgugcuugaucauauuuagauuuccuuccugaauuacugaugauuucuuuugcucauuuuucuucuguugcuugacuuuuuaaaauuaacaaucuggccaggugagauggcuguaaucccaacacuuugggaggccgaggcaggcagauugcuugaguccaggaguccaagaccagccugcgcaacauagcaagaccgcaucucuauuuaaaagauuagcagggcaugguggcucacgccugaagucccagcuaguugggaggcugagaugggaggaucaccugagcccagaggguuacggcuucagugaguuaggaucacaacacugcaguccagccugggugacagagugagacccugucgcaaaaaaaaaaaaagaaaaagaaaaauuuauuaacgucuuggcuaggcucacaccuguaaucucaguacuuugggagacagaggcaggaggcucaccugaggccaggaguucgagaucagccugggcaaucgagcaagacccugucucuacacaaacuaaaaaaaccuuagccauggcucacaccuguagucccagcuauuggggaugcugaagugggaggaucaccuaggcuuaggagguaaggcugcagugagccgugauuguaacacugcacuccagccugagcaacacagcuugucucaaaaaaaaaaccacaaaggcgggacaugguggcucacaccuguaaucccagcacuuugggaggucaaggcagguggaucacgaagucaggaguuugagacuagccuggccaacguggugaaaccugucucuaccaaaaauacaaaaauuagccaggcacaguggcccacgccuguaaucccagcacuuuuggaggccaagauggguggaucaugaggucaagagaucgagaccauccuggccagcauggugaaaccccgucucuacuaaaaauacaaaaauuagugugcgugguggcgcacaccuguagucccagcuacucaggaggcugaggcaggagaauugcuugaacccaggagguggagguugcagugagccaagaucgugccauugcacugcggccugggugacagagcaagacuccaucucaaaacaaaacaaaaggccgggcgcaguggcucacgccuguaaucccagcacuuugggaggccgaggcaggcagaucacgaggucaggagaucgagaccaucuuggcuaacacggugaaaccccgucucuacuaaaaauacaaaaaauuagcugggcgccguggcgggcgccuguagucccagcuucucaggaggcugagguaggagaauggugugaaccugggaggcagagcuugcagugagccgagauagugccacugcacuccagccugggcgacagagcgagacuccgucucaaaacaaacaaaaaaaaacaaacccaaaaaaaaccaaaaacuaacaucuuacagcaauaugguacuuuuguuuuaauuaaugacccgguauugccauuauuagccaaagugccuaccuuagucagauuuccauaguguuuuccagacaucccucugugccaggaucccaccaggaccccacacugcauuuaguugucacgucuccccaggcuucucuuggcuaugaaggacccuccuugucugugaugaccuuaggucggcaguguuagggagcgcugcuugggguauacuguagcaugcugagcggggcugaggcucggaugaggggagcucagucugaccaggcucuggaaggagccgucgcgcuggagccagaaccuggcuuccugggccugagcccccucacacagggacagcgccucugcucagugugcccucccauucccucgcaggcaaggggaucaggcgagugaagccgaagcgcaccacauccuucuucagccggcagcuguccuugggccaggggagcuacaccguggugcagcccggcgacagccuggagcagggcugaggacgcugcacccggcaggaggagggcgacugggggcccuggcccggcacuguccuccugaggggcaggcgccggcugcaacagucucaugggucaccacguggggagggcugccucagcagguuucucagaccacggagaagugacuuuugggcccggggccaugcccgggcugugcaaagcuggccagggccuccuguagggcuccucugcagccugcccucccuucccccggaugcugggcccugcugcucucucaggaccauccgaucaagcugcagcugccacccucaccuagaaacaugccuuugugcccaccucaagaugggcagugucccuguucugaagugcccaguggcagcuccagugguagaggaccaaggauugagguuugggaccugaagcuccagugugugccuuuggccucuucccuggacuugggugaccagucuccgucuuccuccugcuagugcuccaccccccggacuuggaugaccaguuucccaccuuccuccugcuggugcuccaucccccaauaccaggcugggccaccacucugaggaggguaggaggggccucccuggauugaaccgggacagaaacacggugagggcccccaccacaccucccugguugaaucaggaauggagggagccaggcagggcccuaccugggguccugugccccucguucuggucuccuuugcaggcacgagauaccagaaagagcaugccuuucugauagccuuuggugaugucacugcugggagguggcuauccuguggaccaccuggccuccagacccacacucacagucugugaaaaacugaaaauccccuggugggcacucccuggagcccaagcagcuccccuaggggacugaccggaccugaccuccccucccugugucugggucuucagguuuuaguuuggucuuuguucaucugaguugugcuggggcaacgccaggaagugcccuggguaccucugcugugcgcuccuucccagguggcgccauggauuccucugggggcuggcgcaugcccaggaaagccugggccacacgggacacucucuucuuuaucgaggacacuuggaaaggugacugauaugggugcuuggcuucucuggucccagcuugcccuccggggagcaggggcucugucuugucccagaugagcugagagccccugagaggagggcuuucccagcccugggacccuccgaggugggugugcgggucucacaggugcuuccugggacuuccuguggcugcacagggcuuggcuuugucuucguucccgguggaaaaccgugggagaggaagcuugggccucuacuccaaguaucagagccuguucacccuccucccuuugguagcuugugaaugugccagguguuucgagguaggcuugccuucuggcagcauggacuuuguuaaaauaauaggcggaaagaagaggccugggaagggcccccagucuuuuggaauguccuggucacagggucaugucagcugccaguucucgucucccguccuggaguugcucggucuugcggagcugcccgccugccuguucuggcggcuccagcgcaggcugucccugcugcuuugauuccaggugauuuuauuuuuuuuauuuuuuuauuuuuuuugagacggagucuugcucuguugcccaggcaggagugcaguggcgcaucucggcucacugcaaccucugucucaagcgauucuccugccucagccuccugaguagcugggauuacaggugcaugccaccaggccccgcugauuuuuguauuuuuaguagagauaggguuucaccauguuggucaggcuggucgugaacuccugaccucaugaucugcccgccucaaccucccaaagugcugggauuauaggcgugagccaccgcccccagcugauuccaggcgaauucuucucugaugggcgggcgaggguguguucgugugauggguuggagugugugugucugaguacacagaugauguguuuucccuucagcuucuuacguuuucugagcauccauugugccuuaacauuuucugcuuguccuuugggacaaagcaguauuuuacucauucuuugaauguucucauucuuuuguaucaugugacuuauuaaaaucaguuucuaacaa

SEQ ID NO: 192776 - RNA, 6689 nt, Homo sapiens
gaaaagacucgggguuccgagggccgcagaccgcuagcccuacgucacuuccgcuuccuuucccgcagggcggguaauucgaacguuuuuugcagcgaguggccuucccgguuggcgcgcgcccggggcggcggcgcuggaggagcucgagacggagccuaaguuaugucugggaggcgaacgcgguccggaggagccgcucagcgcuccggugagcggagggcgcgcgggagacgugaggucgagccguuugggggacgcaguccggugaaagauggccucuucccucccgcugccgccgccggaggaggcgcccuuaaaagggcuuguuugggaaucuucucgcugucucuagaaccuguucucuggacucuaaggucuagaguccuccucuaccacuuaacuuuuuucucuuuccagggccaagggccccaucuccuacuaagccucugcggaggucccagcggaaaucaggcucugaacucccgagcauccucccugaaaucuggccgaaggugagccccagauuucucacuuccuccccuuguggccccucaccuaauguugagcucacguucaucccucuucuccagacacccagugcggcugcagucagaaagcccaucgucuuaaagaggaucguggcccaugcuguagagguaaaggcuaaggagaguguugugggugguuaggcgggcaaaacuggggaccagcuaugugaucaauugguauugucccccgcaggucccagcuguccaaucaccucgcaggagcccuagggugaguucacuuucaucuacuuaauuaaguagaaucugggucacucuagagcuggacagcacacauuggcuccucacaucugcccagggagcuguuuugcaguacugcaaaaacaguuugccugugggcaccugcaugcauugccagucuugauuacucccugaagacuuaauacacuuaacuuuuuaugccuuguguauuucuaccauuuuccuggaacuuccuuuaaaagcugagcuaugucuuaacuccacguacugccuuucuaauccauuaugccuucagcuuucauguauggguguucugagauaagucauguguaugacauuuuuacaguuuuagcagaaguuauuaucaaaggauguuucauuaauagacaaucugaagacauacugacugagaaaugugaacuccuuugaagagcugauagggcuuagagucaacuggggagaaagaccaaugacaagugauagcaacguuguguacugggacugcaauaaggaauacuagaugcuaugaugguagcuaacccagaccauguggcucagggaauguuucguggaagaagaaacauuugaacugagucuuuaaagacaaguagaggccgggugcaguggcucacgcuugugauccuagcauuuugggaggcugaggcgggcagaucacuuguggucaagaguuuaagaccagccuggccaacguggugaaacccugugucuacuaaaaauacaaaauuagccaggcaugguggcacgugccuauagucccagcuacucaggaggcugaggcaggagaaucgcuuaaacccaggaggcggagguugcagugggccgagaucacgccccugcacuccagccugggugacaaagcgagacuccaucucaaaaaaaaaaaaaaaaaaaaagacaaguagguuuguuccaggucaaagaagccauguuugcagagauugggaauuuaaagaaaaaucaagguucggggaauagcaauuuguuuagugucugcagcagaccucagcaggggaggaagcacccuaaggcagagcagauccugaugaggcacaaaagccacacucauggcuugggcaucauucuugggucugugggcagccuuuggagaguucuggguaagguagugaccgagucaaguuugaguguuuuaagaaagaccccucugggggcuguggggagaaugguuuugagaagggcuacccuggggcuccaagaccaguggaaugacgugaaguccaggaauucugaagcaugaagccaagggcgugagcuaaagccaggaugauauacaguacuggguucagagggaauugccccccaguggccuucccugaccacccuuacccuauugcugucacauuucucuauguaauucucuuaggccuuaccaguucuaaagauagggucuuguucugccacccaggcuggagugcaguggcgagauuucggcucacugcagaucuucccuccucagccucucaaguagcugggacuauagucacaugccaccaugccuggcuaauuuuuugauguuuucucuaauuuuuuuuauagagaugaggguucacuauguugcccaggccggucuugaacuccugggcucaagugauccucccaccuuggccuccuaaaguguugggauuacaggcaugagccacugugccugguccuuaucaguucuuauaguguauuuucuugcauguuugaugucuuucucuccccccucuaagaacacaggcaccuugaggguagggacuucugccuuuccuaguagccacucauucuuguugauugacugagauucaugguacaucgagcaggauaaaguugccaggaccugggugacugcuuggcuauagagaaugaggaagucguagucagcagugaccaccaauuuguucagcuucccuguguuuuuuuuuuuugagauggagucucgcacugucacccaggcuggagugcaguggcgcaaucucggcucacugcaaccuccgccucccagguucaaccgauucuccugccucagccucccaaguagcugggcuuacaggcaccugcuaccacaccuggcuaauuuuuuuuguauuuucaguagagaugggguuucacuauguuggccaggcuggucucaaacuccugaccucaggugauccacccaccucagccucccaaagugcugggauuauaggugugaaccaccauaucuggccacccauuaucucuugaacuucaucuucaguuucuuccucuugccuucacuucagccacacuggccuccuuguuguuugacccugacuaguacacuguggccucaggguuguugcaccuucuguucccacugccuagaacuuggccaugagucacucccacaccuccuucaaguuguagcuugaaugucaccucagugagggauguauugaccuuuaucuuuuugcaauucuaaccugccccaagcacucucuccuguucuguuuuccuguagugcuugauacugcuaacauaauacugaauuuucuuaccuguuuuucucuuagaauggggcagggguuuucucuguuuuauucccugcuguguucccagugccuggcacaggacaggugacugauaaauacuuauggacugaguggacauuuaggacaauccucaucagcuguguggcagauggaccacagcaggcaaggguggaaacagggagagaaaucagaaggucgcugggaccagccugggcaacaaagggagaccuccccuacucuacaaagaaacuaaaaaaaaaucagccagacagagugucacaugccuguagucccggcuacucagaggcugagguaggaggauugcgugagcccuggaggcugaggcuucagugagccaugaucgugccacugcacuccagccugggcaacagaguugagaccguuuaucuggaaacaaaacaaaaaacguugcugagcuggucuagaagacaccuaaugagggcuugaguuggucagaggagaggcuggaugcugggcacauuuuggaaacaagcgacagcaccagcagaugggggcaaguccauuugugucacaaaagcagacuccuuggaagcaaugguggguuguuuucuucucuccaugucucuuucagggucugauuugucccuuccuuaaaaaaaguguguguuggccgggcaugguggcucacgccuguaaucccagcacuuugggaggccgaggcgggcggaucacgaggucaggaaaucgagacccuccuggcuaacacggugaaaccccgucucuacuaaaaauacaaaaaauuagccgggcgagguggcgggcgccuguagucccagcuacucggaaggcugaggcaggagaauggcgugaacccgggaggcggagcuugcagugagccgagaucaugccacugcacuccagccugggcgagagagcaagacuccgucucaaaaaaaaaaaaaaaaaguguguguccugugggucuuuccacccugaaucuucucgggcuuuucuggaaguaagcaguccagcuaaguauugagggcauccccucuucuguccuggugcagauuuccuuuuucuuggagaaagaaaacgagcccccuggcagggagcuuacuaaggaggaccuuuucaagacacacagcgucccugccacccccaccagcacuccugugccgaacccugaggccgaguccagcuccaaggaaggagagcuggacgccagagacuuggaaaugucuaagaaagucaggcguuccuacagccggcuggagacccugggcucugccucuaccuccaccccaggccgccgguccugcuuuggcuucgaggggcugcugggggcagaagacuuguccggagucucgccaguggugugcuccaaacucaccgagguccccaggguuugugcaaagcccugggccccagacaugacucucccuggaaucuccccaccacccgagaaacagaaacguaagaagaagaaaaugccagagaucuuggugagugagaggcagggguuuuucucugccgugugcucugggagacgugcagggcuggggcucuggcucuuuugggggauaggcagcaccugcagggugugggugagaugcuccagccaccauguucccuucucacucaccugcuccucauuucucuucccucagaaaacggagcuggaugagugggcugcggccaugaaugccgaguuugaagcugcugagcaguuugaucuccugguugaaugagaugcaguggggggugcaccuggccagacucucccuccuguccuguacauagccaccucccuguggagaggacacuuaggguccccuccccuggucuuguuaccugugugugugcuggugcugcgcaugaggacugucugccuuugagggcuugggcagcagcggcagccaucuugguuuuaggaaauggggccgccuggcccagccacucacugguguccugucucuugucguccuguccuuccuaucuccccaaaguaccauagccaguuuccagaugggccacagacuggggaggagaaucaguggcccagccagaaguuaaagggcugaggguugaggugagaggcaccucugcucuuguugggagggguggcugcuuggaaauaggcccaggggcucugccagccucggccucucccuccugaguugccuucuguugguggcuuucuucuugaacccaccuguguaaagagguuuucaguuccguggguuuccccuuugauucuguaaauagucccagagagaauucgugggcugagggcaauucugucuuggaggaagaagcuggacauucagccuguggagucugaguuuugaaggauguagggagccuuaguugggucucagaccauaaguguguacuacacagaagcuguguuuucuaguucuggucugcuguugagauguuugguaaaugccagguugauagggcgcuggcugcuuggagcaaagggugcauuucaggguguggccaccaggugcugugaguuucuguggcucauggccucugggcuggucccuugcacagggcccacgcuggagucuuaccacucugcugcagggguggaagguggccccucuugucacccauacccauuucuuacaaaauaaguuacaccgagucuacuuggcccuagaagagaaaguugaagagucccagaccuacuagcauuuugcaacuaugcuuguaaaguccucggaaaguuuccucgcguaccagacagcggcgggggcugauagcaauuuuaguuuuuggccucccuauccucucacaugagaacacugccuggaugcaucucaugaucucuggagaauuuccccaucuuucucuucuuuccaucguguggauucaauaguguggauuugaaggcugcccugcccccgacucuccugccgcaccccuggccauuguaccuuuugauguuuagaaguucguggaaguagacgcugaggugugcagaggagcugguggauaacagagaaugccagggaagaugagugcugggucaggguacuuggaugaaacggugcaggccaggcgggcccuaauaaaacccucugccaggucugggagucccaggccaucugcucaacgcucugugguuugucagaccugcaagcaagcccccugcuggggaagccuagguguccuugagcugaaccgcacugaagaacucuuguccucacuggcugaugcagcagaacucuugggaaaugucuuaguccugcagaaucaggagucaccagaugaugcagaguugagaucaucauugcaaaguucucuguuccugaggaacuaaauuuaaggaaaaaaugggauuuuguuuuagaguuggaaaaaaagccugauuaaagaguuucugccuguu

SEQ ID NO: 192777 - RNA, 13863 nt, Homo sapiens
gacccagaaaaccacacugcucuuuuauucaauggaacauccccgcuuuagcgcaguguugaaucuaacaccgaaaaaagcccagagaaauuucugcagauaaaccagugaagagaacgcgcaguauacauuauugucaacagaaucacuucauggagagggaagcgggaggaaaaaggaaggagaaugaacaaggggcucaaaccccuacacacugcaaaacauucagacauuugggauuaaaacaaaacauaaaaggaagccuuccaggaaggagaggaccaaauggaaucugaggcagcucaggugaucaaggagcacaggaagaacuccaggcuggcaggcgagcccgagggagcucaggcugcccacccacugcuggcaggaucgccaggacggaugggaaucccgaaaccuggagaugaaccuacccucggcaacuuuacaagacucccuugacaaggguggcagagauuaaaaaaccccacgcuuuaaacaaacaucuuuggggguggcuauggcaccuugaaaaacccacaaccagcuugacaugaauggccaaagcccuugcccaaaaccauuugcuccccucuccuugguaagggaaggagaacuggagagaagggaaaggaaucuaaauugcagcagaagaccggggagagcaucuccuuggacggagucugaagaaaggaaaagauaaagaaguaacaaaggaaaaagaaaaaaauuaauaaaaauuucacgauauggagccagcguguuccgauuccguccacaaaaauaacucaggcugcuuugccgaaccauccuguccaccaggggcguugcugaggcugucugccuggaagggucaccaaugggcgcggaaaguccucacucucauggcucgggccaucgccgccgcggggagggauccuggcggcccgguuuggggagaggcaaagggaguugggugaggagagaaagaagacaaagaagacacucgaugcuacggggcgccaggagagcccaagcuggcgccccuacuaccaccugcccguucccaagcgaauccucagucgcuuggcccagcccagugcgugcacacacacacaugcgugcacacacaaucacaugcgugcgucccaaugucuggcuccauauggugagguucggcguguuuaaacgagaccaauucucucuauauauaauauauauuuucuuaaaaaacaagucuaguucugugguggaggcggugggggagcuggaggcaucccgaagggcggcaugcccgccacccccaugcccaucauggugacaaaguuagaaggguccaugggaggcggaggaggagggggcggggcauacaucaugccggcggaaccaggcgguggaggcggcggagggggaggggccccaggcggcagaggcggcuggaccccggggggcaggggcaccauagugggguugccuugcaucugaggggcuccuggagaagcugcggcagccgccugcugcuguugccauggcgggauggacccugugccagcgcucguggugguagucgucguaucuggggugguaaagaagcccaaggucacacgcgcgggggcacaccgcggcugucugcggcugcugccuugggaugggggcgaggggcgccugcuccuugcuuggcaugcgguacggugguggggggcgggugggcggggcuggugauggggaguggaggggugggcaggacuacccuggggucagccucgaggucucugggcuuaacagaguaagcccuuugucaccaaugccccuggaagggcugaggggaagguaccagacacaagaacagcucugaugucccuccgcccagccgccgccaccaccgaacggcacauucaaccucaaggccacagcugcugucuccccacugcccagucccaccucugcagucucucaccccaaucgcagcccuugccagagcaagcaugcaccaucccacucgacccauaugcaccaggcucaguccagccagccgcucacucagccugcgagggucuggacuucuggcccccuaccuacaauagcaggcuccccuccaggcccccacgaaccucuccccagacacaaccacaccaaacaucagcucuccucuucaagaugccccuccacccccuggaccaggaggcccuuucuguuuacaaccccagcagagcccaggggcucaucccaagacaccugccugcuugugugaggcucuaugguuccugucagccccacccccaucccacccacccccacaagcccaaaauauucuacucacuuugcugccauggcaaggggguacuggaagccauacugcugcugggcggaggggguggcggaggcugcugcugcuguuguugccaugggggaagaggaccagagggagggggugggggcugcccacugggaggcggcggcggcggcggcaucaugcccauaggugguggcggcaucauaccuguggacagguggaggcaaagaugaggccucagggaaaggcggggacuugggccagaacccccacucacccaagccuaggugaagacccacagccagcagacagccauuaccuuuuccuugaugcaggcgauagaccccagagcccacaggcguacuucccagguacugaucuugauggaaggaaagagcagggacuuagcaggacauuggaacuggccagggaagccaccccugugauaaccucaguugcuauccuuacgcgaguucugaaaaccaugccuguaaaaggcaggucugugcuuacccaacacagaaucacucccugaaccagaauggagucuugcuccuuccagagccacaacccuggcaagccaggcagacccagcacauugcccagccacuugagagcugcuucuagccaacagcgaccugacguaaccccuugcuuaucccaaagcccccaagguuucuggucugacacuuacuuacccauuggaggagggccauggugcccaggagggugggggcccugguucaucggugguggugguggcugcauccaaggggguggggguccauugggguugugcugcaugggauguccaccaugcccaccugucaggcuggguaaugggugugggaagcugugggggccaccuccgggcccaccaggaccaccuccaugcaugccgugguagggccgacucucugaagggccagaauucauccagggugggcggcucugggugguagacaugagagacuacgugagagcauuuccugccaacgucccugccugcgccuccuaguggcaacauuguucuucggguuaugacacaggaccagaacacaagaacaaggucuucccgaagugagaaguccccaaacuggccugagaucccggaagaacaauguugccauccacauccauugucugcucuacccaaaccacguggccauagcucccagucucugcaguagagaauggggaagccagaccaagagagccagcccccaggcucaccgguggagguggguuguuggcgggagcagcaggacgaggugcgcuggccaggggugugguggcaggcccagagguggagcccacagaugcugggacaggugcuucacccaguucagccaugagggacaaauauucuuuauccauccgugcuuuauccugagcugacugaggaucaccaggccugaaguggggugggggacacaaacagagaaaggggaaaaacuuguuaagaaggaagcuuuuauccugaggaaccaacauauggaaaguucugaagaauucaaucaccagaucaucacacaucuuucuaaccccuuacugggcauggcucucaacagucucaucagaucuucaguuucgugcccaguucugcaucugggaucaccagaguagaggggccccugggcgaagagcacaggagacccugagcaccgaugaagcacagguucucucaagucaauuucaucaaacuucauucccaguuugaggaaaggaaaaucuaugcaagacuggcacaacugccagaacgaacuuccuaaacaaaaccuuacauauucgccagccagucagaaaguguugauaucgagugcugacuugcaacuggucagaaaucuguagagauugcuuagucuucuugaaccaauucugaacagcaaaagcagugaauuuccuauugagccccaguaaaaacauacccaaaauggaaacuuccaguuuucuugggcucaagacaaacaaacagggguaucuguacagccuauuucuaaucauccugggcuuuaaaucacaccauuacagaccacacuaacagaaaggauguuucucuugguaagauuaacagcaaccaaugaaugugccagaaaaguuguccugcacaucgcaggcuaccaggaaaccgcaagagccagccccucaccuuuggaauuuacagucugaagcaauguggccagccccuccacacuugguacacacugugguguugguaaugcugcgggucucugagcucugccagggucuuaagauccuauuaaaggaaaaagaggucaaugcaagggaacaaucucuacuuccauagguucuucaggucucuacacucuccuuuaaacugaucacauaccuguuaucgucuucccgaagggucccauuuaagcgagccaacucccgaagcugcaucuuccguagaucauucugguccucuggagucucgauacccugcuucaggauguuucuuaucuagugaaaaugcaauggacaguuaagugcuuagggccuccaccuagguuucugcuaggaggcuuccuuucugggcucaccgcucaccuguuccacugccuuuuugacguucuccauuguauuggcaguaaccagggcaugaaguggcucaucuucuccuggcaacaucuggccaucuuugcgcccaaccuucccuucuuucacagacccuuucccccggaucauaaucuuggcauugcacuccuucucuauguucuucaggguguucccucuagagaggcagaaaugacuaaguuuauaccugacaaauucacacucaagagggaagagaggcuggaccaauuuggcauuggugggaaaccacaagcgcagagaauuggauuuucccaccaagagcuccaugaacucuauauuauggucagccacaguaaaccugaggauuugacuucuccgcacuaguggggaaguuaagacaccuucucacagaaaggcauuaauucagccaaaaugaaauguccuaccaaaaaggggaaaaguaagccaacaguccccaauuaggcacaaaacggacacaucucacaggcucuaaaggaauucuauauccuauagaccagcaguuacucaccugggcccgaugagcagccccacaaaguugauuucuggguacucaucuuguggaaucaugacuuuaucacucacacguguugcuggaggucuaagaaagaaaagccugugucaccgcacauuucuggagaaugacacagccagcggcuuuucuaaaaccaaauauugguaccaagugcuaauuaugggugacuugaggcaagaggugaguaguaccaauacugucccaucccagcaggucacccaugaucugcaugugucuucaucccagaugaccgagccccuccgcuuacuuguaaucugcagguggcuugaaauccggauugagugcaaccaucucugugaugagguugugccgcuccucuuccagcuuuuugcgggugcggaacucucggguguuaagccgcuuccccucgcuauuguagaugggcucaggggaaggggaccugugggaaacagacucccguuuacuauucugcaccgacuucucucauucccacacggacuauaacaagucuuucccagccccucugccucucagacccuaauacaacacucuucggaggaaccgaccauaacgugugcuacucaagaucguguggaauggggagauggaagcuggcuuaacguuaggggucuggggugugugugagaaaggaaaaaaauaaaagauuuugcaucuagaagugaugagaggaaaaaaugucuauucuuuggggaaaaucuuuggacuguaaguggcaaggacaguaucauccccuggagucuucuugccaaauacggauuuucuuccauuugaaaaaaaauacauaucccaacuuuaugaaccacagaaaccccaaguuuaggcaaaagguuaacucuuggagagcucaugcccuaugaggaaaagcuucuguaccccuaacacauaguauguaugagcucuuuaacccaaugcaacugggacugaaggcuacugcagcuacuuggcccccacaauggagagagaugguucgcuucgucuuugcuuuuccuucaauggccuggcuggcuguguccaaggcccaggagacaaccuguuuucuggcuguucgagguuggggagucuggguagagaaaaacguuaaagugcuaaagcagcuucugcgagaggcugcaaaugcagauuuggucauacuugucuagggucugaaccugcaaacagcaaggggaaaaccuaugauucuccaccagaguuuacaaguccagaaagcagauuuucucucucucauuuuuuuaaggaguaaaaugcuguugcuacaaguaaaaaaauguaaugauaaaauggucaguuuaccacagcuggauuuugcgguaauaaaaaagagagguuacacuccuagaauuuugaguuaagauuacaaaaaggaccauagcuugauauucugaaugaaaauuuaguagcagcugcaagaagggaagagaccauguggaucagguuauuaaaaaaacauacugaaaguaaucaagacuccuauacccuugguuuaguugagagaaccuugccuaguuggagagcaaggacugaacucggcugcucccacugucuucagccuaaagggaaccaugucacaccacguuacacacacgauggaauaaaaggucagguuuguucauggcuaaugacggcuaaaugacaccuccguuucuagcauuuguauaaacuguuagcacaauccauuaagagugaacaaaagcaaacauaccccagcucauuagacuaccaucuuauacauuuaagucuacaagaaaaguuuuaaacauguuuuuacugugcaaguuaagcagcaucaaaauaacaauaaaguggcuuaagugauauaacaccuuuuuaagaaauuaucuuaauuaagaaaacccaugcauuucccuccaaccugggcucaaaagcaaaaccaaucaggcauuagggccucuuucaaaacugaauagaagggaggaaaaacccugcucugguuuuauuucuaacaugcuugacauuucuaauucccaccccacagcugucuagaauuaagcauucuuagcuaguuacaaaaacaagucuuaccagcacccaauuggccaugugaaggccucacaacaguuuaaccuccucccaaauugcagaagugaaaggcaaaagcuaguauucuagagguuagacuggcccgacuucuucaccuccaacaggcaucggcuagaucaacuaaauucuaaucccaguuauccaggaagcaaagaagguuuguuaaaaauucaaccuuuggaggaauugacuggugaccuguagacauauuauuaaagggaaaaaggccaaaaaggcacuaaacaguuguggucuaugaccuacaauguaaauuuaaaaaaaaaaaaaaucuucaaaaagaaacgaaacacaacacaacccuacaaccaaaaucuaucuauagguaaaauauagcaaauguaguaagucaaauuaaagagucaauauggagaaacaaggaaguuaauguuuccuggcaaagggcggaagaaagaugcaugagugagugacuucuaaagccauuacaucaucuuccugauuuaauaagcuauuaacuggguaacaaaaaccaaaaacacuacuuuuuaaagcaaagucuuuucaacuauucuguauguacuaagagaaaauucagugagagggagagacuuacugcccuucuaauuaaaugaccaauuuuagcuguucaaucagcuaauaaaauuccaguuuaaaaaaguucaucucccccacacaauuuauuuuucugaggugagagaaacugcaaacugaaaugacaugaccacagcuguuugaggcccacgcucccuuuaaggaaaaaaaaaaaguaauuuaggguugguugcaugccuucccaaaauaggugagaauauucuggccccucccaacacccccaaggcaauggccaaggcugaaaguuaacuggcagugaaagaaguugguuagaaaucucaucugauuuugaaaccaucucaaaaccaugagcaggaagacugcagcaaugagcugaccagagcuccuggcuugcucaaguucagugaugcucaaaaauauuuuuagucccugcacuguguaccugugagaaaaacucuaugcccugggcuuuuggccaaagcagguacugaaaaggcagguuaacgggccaccucacuguccccuaaggguggguaaaucagguuaagaucuacaugcuuaccaauuggaaaccaguuguccauuuuccuguaacuuuuuauucucccaacauuuuuaaguuuuauuccaauuuucuaacuguugacugaccauacauauuucuaauuaaaccuuaauccccaaaguggucaggguacagucgucauacuaugauuuuauugaacugacacaauauguugccaccaguaaaacguauugagaaaaagguaaaagcguuacugucagcugguuaaaacuguuucccaaccuguccucaggguuaggggggaugcccaggucuccugugcgcaguuuacgagucaggucuucuaucugcaguugcacuggaagaaaccagguuaggaaagaaaaaaaaggauggaaaaaagacaauguuaccaauaaacaucucaaaucucaacaacaagcaugaagaacucggagacuuugaaagggacgacugaucagugaacacauugaagcaaaaacccccaaccaccuaucggcaggaguccuuuuacaucuauagguuuuuuucacuucaaaaugguuaucacuuaaggaagcaaacaguuuguuggaagagggguuagcaauaaagacuguucacuaaggcuaacauccaagcaauuauuaggagguguuucaccucuuccuccccaccaaggcuugcuuaccauugguacccagaaccauaaaccauguuacgucaccaauacccgacucccaucaaauuacuugagggcaagaauugaguuuuuucuucauuaaauguuaaacauagcccaaaaugagacccaauuaacaugggacaaggaaaaauaccaauugagcaaagaucauuuucauuaauacauuuaaaauuccuuaaauaagacauuuaauaacaaaauucaacaccuuauagaaauuuguacauacucuuucuguacaaccagaccuguacuaguaagggucucccaauaccugcagcucuuauucaauuauaugaaauauuuauucaaauauuaaaugacaaaccacauaucuuaauaaaccaguaaccauaaagugcuaagaauuuguuuucaggcucacuguucauauggggagcaggcguguagaagaauggaauguguguucaaggacaauguacuuggcccucgggccuugaccaaugaggcugugcaugaaaaagagagaugaggguuucacaaaaguugccagugacgccagggaaauguuacacagcugauuuuccaagauaaugggaacugcagagccagagcagcuuucuucaacaugcggaauaaccaccuguuccuuaccuucgcagcaucugagaauuuucagcaggcaucuccaauaagggcaaauguuacuagguuggguuaaaacugagcuggcuccaagauaggauuaaugcgugucuaaccaaagauuccuucuaacuuuaaauacauccacagggcuauaccacacccacacacuaaaacccugaagaaaugaaaacccauuauuaucgaaagaaaauacuggccgggcacaguggcucacaccuguaaucccaguacuuugggaggccaaggcaggcagaucaugaggacaagagaucgagaccauccuggccaacauggugaaaccccgucucuacuaaaacuacaaaaaaaauuagcugggcaugguggcgugcgccuguagucccagcuacuugggaggcugaggugggagaaucacuugaacccgggagacgcagguugcagugagccgagaucgcaccacuacacuccagccuggcgacacagcaagacucagucucucaaaaaaaaaaaaaaaaagauauugagggcauccuggacaaagcaguauguaccgugggagacagaaaaguaguaagacacaugguuccccaagcuccuuuaugccuaaaaaguucugacuuugcaguugaguauuaagcucaacaacucgaggugaaagucaccuucacugaggggagaaggugagucuuccuagcugacuauggagauguggggccugaucuaaauaaaaagggucauucucuucuguggagaacuacaccucuccuuugauucuauuuugauuauagcuauaaauaguccuuagggcccagugaacuaacuagcccuccacaaaaacagaaauggagauauaaagaauuugugcucuucccaucuucuaaguaugcuuguguucuugggauaucacuccacuaggggcauuucacaaggauguaaagacccagacuagucuaauaugagacacaauggaaugggugggaguagacaggaacaguaggggaaagaacaaguauuaguaguacugugaaaggagacagacaauuccaacgccucaaaauucucagcagucuaaaaaacaggaaauuaagacccucaaaaguaguaacaugcuggccuugaagcuuuuugguugugaaggccacagccucguagguuuaggaggucuuugcccgaauuuccuccaaaggggauguuuauuugguuaguaggaaauguuuauaaagugaacuuuuuugagacagcugcacagguauauaaagauaaaacuugcauuaaaaacuuuuuuuuccaaaaaagcaauuuugagguuaauuucaauuccacuguggauagucauuaauucucaaaaccucccagcaaauaaaaccuuuuuauccuagcacuucauuccauauccaugcaauaucccuuucccagcagaguucuuuaaaaguaaauacaagagccuucauuuuaagacagcucuccauagaccaaaccagaaaagauguugaagggaagguuaaacucuuaaauucaagaaaauaaaaagggguaaauuguaaacacacuuucagaaccacuuuuugucauuuuuuuuuuuucagaaaguaccuauaaaaaguaaaagaccacauuuuagggggagaaauauaaaauuauggugaaaggccacgcugugaaaaguacuugguuuacaguaccugcgguguucuccacuggggccuguccagagaggcagaugacacucaccucaucaacuggcaaugaacagcagcugaaaaggguggcugcuggacuggggacuguucuuacuccuaagugaaacccuaccuuccugauacucauggagaacacugcaguuacgaacagaccaaaacaaggagcugcaaaugcagaacucacugggcaaaaacugacagaugauaccaaagucgugaaaguaucucaucucaaaaaagauaacuacaaucucaaacuuucaaaaaaugcagaucuugcucagaauaaaucguaacaaucucaaagugcauuuggaugcagaacguauauuuaccuauauaagcucuuucuuguucucgaguaaguccagggggaauaacuguaggcauuccuggaaucacugucuucuguuccauugugucuugguuccagcggcuccucuuccgcuucuuacuugggaagucuaaaaggcagagacaaaauccauccgauguaaauacaaguaguuaucaacagacagcuaaggguauuuaagguacuacacagaaacucagcagacugugaagcugagagcuuaaccuaaaacuuaaacauuaaaaaaacagaaaacaaaccucagagaucagagauuuaaagcuuauggccacuacaaggguaugugguccuuggucaggcaaguuaacauuucaccuucuuuugucuagaaaaacugucagauauauaaacgugguaaucuuaaugcauauggcugcagagaguguuagauagauacuacaucaaccaugagugcucugaaauccccaggggagacaaaaauacacugaagaaucauagauuuguaaagcaguccugaugggacugggggcuccacccaccuccacuccccucaccagucacuuuuguacgagaggccggaccacaacuaaaccuaguuacacccuaccaagugggaaaagcccaauucuucaacaagaucaccuuugucuucauaaguuuagccaagaucagcauucaguuuuccuggccaguuggacacugagggucugaacucuuaaaaggaucuaucaaaaauucaacaaccuauacaauagcagccaaguucuccuuuccccguacauaggcagaaacucccuacauuugccacaaaagaguccuucuauuucccaagggguacaggaucagagggaaaagcuuuuuaaaacaaagcgacagggcagccgaucagacugagaucuaaacauacugaacagauuuaaaaaaaaaaacaaacuaaaauucucuccccaaaagagaccaagaaagaucagacccaaccaucaucugaagcaugccaaccucucccggaugaaaacccugccuugcuguagaagcagaggagcuauccuugguacgguucccauucugguuccucaagaccagaagggagucgcugcacgucaucaggugaggcuuucacgcccugcuggcauucacagcuagcaccccguccagcgcugaacacccgccaccccuguucccgacaccagcggacuggacagcaauagugggcccccagucuauacaguugcgccgcacagcccggccaccucacugcgucugcgcacagagcgccucccgcccgcccagcccuccccccacagcgcgcgugcgcacucgaggcccuagaaccaggccgcgcgcgcccaggggcgccuccgcccgggccuccccgugcgcgcacgcgcgccccugccgcgugcagccgccgucgccgccgccgcgcgccccucaggcggccgggcccguccgcgcgacgccucucgcgcucucucggcccgacucaccuccuccgccgccggccgggcccggcugcugguccuuacgcggcggcugggguggcggcggcugcggcggcgacacgcgcugguagagcggcggcggagggggcggcugcggcggcggguacgaggcgccgggggacgguggcgguggaggcggcggcggcugcuggggaggcggagggggcggcggcggaggcggcggaggcagcgccgcgaaggggaaggccgcggucagggcccccaucgagcccacgggcgggggcggcggcggcccgggagccagcagccccgccccaggcccgggugcaggcggagggcccggcucgaagccuccuuugggcccggggagcgggggcagcccgggggggcccagcuuacccaacggcguggcguucgcuccggucgccauggcgcccccggggacaggcaccggcaccugcuuuuccucugcggcggcuucuccuucgcaagccucccgggggg

SEQ ID NO: 192778 - RNA, 18434 nt, Homo sapiens
caacauauaaccacgcccaacuggcuuguuuuauuggagaaggggacgcagaauaaacaacgugagacagcugggaccugaggcuggaagaacccccuccccuccccauaacaugcccacugccccaaauaaaaaaaaaaccaacuaugggagagcagccgagacagcaacuaggggcaggggaaagagacauggaacucgagggcagcggugaagagaccaugcgugugcugggagggcccagaggcagcggcggcacaaacagcgcagguacgagucucugugucuuccccgggguuauguauaaauauagagagaugaggccuucucuccccugcucucccuuccgcuccgugcugcucgccgcggucccagcuccucuuuccacaugagggcgaagggaaggggggaugaacaagucaucaccgaauugcaaucagacccacauccaucagcuucuggaucuucugugcuauuacaggauucuuuaagugucuacagaggaagacgcaguuacuugaaaugagacaaccuuuaaagucuuacuugcucucagagcaagccccaauucaacccccucuacagaaggccccggcagggagggguccuggcgaggcccggggcgccgagcugcagaggccugcuccacuucgcagaacuugccaguccuacucuugagcccacgacacagcuuccagucaagaccuuucucccagcuaaaugggccuuuccaaaugacugcuuaagcuaucacgacuaacaaagcccuuccagcucgccacccacugccaaucuccuuaaguuuaggaagaaugacagaauuccucuuccucgcagacugagcauaccaccccccagccgcgugcacucaucugccugcuuuuguucuccauuuccagcaaggccgccucucugacucuacguacucgcugagugccuggggguccuucugcaucuguuccaggauaaggcgcauggcugggucacucaugaucugcugcaccucagggucggccauggcucgucgcuucacaucuucggggcugucgugccgguuguacugcgccaucauacagcgcugguagccgucugccgccuccugcaguccagaagagacaaaggugaagcguguuaggaccacccagcucacugcuucagcagguccaagauaacagagguaacugacaaggggagagagaacaaguaagagagaaacagagagaaauggaggugacagggaagaaaucagggacugaacauggaaaagccccaacagagaaagaggcagggggggccccuggaggccagaagcagccccaccuuacagcuggaguccaggucuagcgccuucugguacacauccauggcuuugguguaguccuucaucgcuuccagcgcagcggcuuuccguguauaacccuugacuacaaacaggaaagguggcgcguuauccaaccgcagcgcccaaggcugcuccuugcaccucuucaccugcacaccaacacuguucacaccugcugauguuggauccuaaauccuacaggucccaaggacacacagguagacaaagggcuugcccuuuccuucucuaaucuuuuggcuagagacaggggacaggcagcagaaaggcacuuacugaaggucggcuccagcuggauacauuccucacaguccuagaaugaagcaacagaaagaaauuaggcucauucccuuggacaagcucaguacaggcaacucaagcauguggacuuccaacucuaaugccucacccagcaccaaacagaggggacaacaucaggaaagacaacuccagaugauggaucaucccacacaagacaaacugccuggacucugcaagaggcugauguuaugaaaaacacauagcgggggacaauuccaguuugagaaacugaagaguacaugacaacuagacaaaaugcgugggccuugguccugagagcuuuggaauccaaaaccauugcugacuaaaaaacaaaacaacgcugggugcgguggcucaugccuguaaucccagcacucuggaaggccaagguggguggaucaccugaggucaggaguuugacaccagccuggccaacauggugaaaccccaucucuacuaaaaaaaaaaaaaaaaaaaaaaaaaaauuugcuggccugguggcugcaccuguaauaaucccagcuacucaagagacugaggcaagagaaucgcuugaauccaggaggcagagguugcagugagccaagaucacgccauugcacuccagccugggcaacaagagugaaacucugucucaaaaaaaaauaaaaacaaacaaacaaaaauaaaaaaaccucaguuuuaaaacauauuuuuggagaagugggcaagucuaaguauggauggacagacggcagauggcaucaggccuuggucuggugaggucgcgugugcugacagugcugcacuggacaggagucuuuucaggcaaugcgugcacaagacuuggaugucucauucuaaguaccaaauguauacaauuuccuuucgcaaacaguucagcaaaaacaggucaacauuugucagauaaagguggaagauacaccagauauucacuauguauucuucucuuugaaacaucuucaaagugagaaaugaugaggaagagaacacuaugcaguacacugagcuccccuggaauuaauuccaacucuugcaccaagaagcugggacagcagcagaaaucccauucauucuuucuccacgcucucaugaucgggaaaguacugcccaccucccaggugauugacaaccugcuauucuuugccucacaaaucaauaugcuuuugacaugacucuugcacaauccuacuaguagaaaugaugucucuaggccaagacacagacccagaagacaguggcacaaaauauaaaaaccaacacaaacccagguauggcuguuucuagacaggucacacuuugucaccuucccacaauacgguccagguuugucagcuagagaacagucaaaaaaaacugcugauagaggcaggguggcugagauucgagaggauuaugggaacuccacagugucaaacaauuguauuugaccuaacuugauaugacugagaacagcagaccuaccuagcugagcaaaacagaaaagcaagcaaggaugguacagcugcugaaaaacauauggugguuccucaaaaauaaaacauaggccgggcgcaguggcucaugccuguaaucccagcacuuugggaguccaaggcaggaggcucgcuugagcccaggaguuugagaccagccugggaaaacauggugaaacccugucucuauaaaaaauacaaaaauuagcuggguacaguggugcacaccuguagucccagcuacucaggaggcugaggugggaggaugguuuaagccagggaaguagagguugcagugagcugagauugugccacuguacuccagccagccugggcgauagagccagaccuugucuuuuuuuuuuuuuuuuuuuaaaaaaagggggccaagcguggugguucacgcuuguaauccuagcacuuugggaggcugaggcggguggaucaccugaagucaggaauucaaggccagccuggccaacaugguaaaaccccguuucuacuaaaauacccgggagauggugguugcagugagccgagauugugccacggcacuccagugugggcagcugagugagacugucucaaacaaaccaacaaaaaaaguaaacacagacaccacaugacccagcaauuccacuucuuaaaaaugguuaaaaaggcaaaaacaaagaaaaaagaggaagguuacaggggugaaaggacccaccuuccaauguacugccaaccaguagugacuccauggaccaggaccaguuagauagauacaggucccauauuuuacacacacacacacacacacacacacacacacacacacgaccaguuagauacaggucccauauuuuacacacgcacacacacauacacacacacaccccuauaaaucugggcaacacagcaagaccccaacucuacaaaaaaaauaaaaaauguagcaggauguggaggcaugagccugugguccuagcuccucaggaggcugaggcaggacagagugagacacugucucaaacaucaugaucaucaucaacucaauguugaugaggagagagagagaaaacccacuccucaugugcaggcuuucaguaauggccgcccccacaggucucgucaccuugagugccagcuggaacuccaggaguuugguguagcaggcagcucgauugcuguauaauuuggcaucuuucggguuccuuuugauggcuucuguauaaugcuucauggccuggggauaguccccuggggaagaaaaacaaagacugucuuuuaaaaagcaaaaagcccccauguguagccggccauuuaccccacagccaggcacgggaggcacacccagcacugcucccccaaucccccagcugcaggcaguaccuuucugaaaacacucguugccuuuguucuucuccuccaaagccaggucgggguuuauguaggccagccgcucuugcuccuucaggauuuucucugccuacaaaacauaauucuugaaauaauaauuuaaacgcucauaaucaucuaaauauugggcuuaaaaaucacauuaggggccgggcgcgguggcucacgccugugaucccagcacuuugggaggccgaggcggguggaucacgaggucaggagaucgagaccauccuggcuaacauggugaaacccugucucuacuaaaaauauaaaaaauuagccuggugugguggcgggagccuguagucccagcuacucgggagacugaggcaggagaauggcgugaacccgggaggcggaagcuugcagugagccgagaucgcgccacugcacuccagccugggugacagagcgagacuccaucucaaaaaaaaaaaaaaucagauuaggauuuuaauuuucagaguauugcuggcaagauuuuuuucuuuuuuuuuuuugagauagagucucgcucugucgcccaggcuggagugcaguggcgcgaucucggcucacugcaagcucugccucccggguucaacgccauucuccugccucagccucccgaguagcugggacugcaggcgcccaccaccauaccaggcuaauuuuuuuuauuuauuuaguagagacagaguuucaccguguuagccaggauggucucgaucuccugaccucuugauccgcccaccucggccucccaaagugcugggaucgcaggcgugagccacugcgacuggcuauugcuggcaagauuuuuuuuuuugagauggagucucacucucacccaggcuggagugcaguggcaugaucucggcucacugcaaccuccgccccacugaguucaagcgauucuccugccucauccuccugaguaauugggauuacaggcgccugccacugcgcccagcuaauuuuuucguauuuuuaguagagacgggguuucaccauccuggccaggcuggucuugaacuccugaccuugugauccacccaccucagccucccaaagugcugggauuacaggcgugagccacugcacccggcuauugcuggcaagauuuuaaaagaaauuuacagucuuuauaaaauagucaaaauguuauguuacaagaacuauuaacauucucaaugcacaggcccucaauauuaacacauuuaggguugaaaucuuggccaauaccaaaaacugcaaaaaaaaaaaaaaaaaaaccacaaaaaaaaacaccagaucacuuccuacauguugucacuguuaaaugacagagaaagaaucauguaagaugaccaaagccacuaccuaaaaaaagaucagguucagccaggcauaguggcuuacgccuauaauuccagcacuuugggaggcugaggagggcggaucacuugaguucaggaguucaagaccaaccugggcaacacagugagaccccuucucuacaaauaaaaaaauuagcuggacguggccaggcgcaguggccuguaaucccaggacuuugggagguugagguggguggaucaugaggucaggaguuugagaccagccugguccauauaaugaaaccccaucucuacuaaaaauacaaaaauuagccgggcauaguggcgugcaccuguagucuuagcaauucgggaggcugaggcaggagaauugcuugaaccugggaggcggagguugcagugagcagacaccaugccacugcacuccagccugggugacaaacagacuccaucucaaaaaaaaaauuagcuggacgugguggcacgugccuguaauccuagcuacucaggcugaggugggaagaucacugaagcccaggagguugaggcugcagugagccacgauugugccacugucuuucagccugggugaaagagugagacccuaucucaaaaaaaaaaaaaagucaaguucauuauuaaauaaaacaguaagaaacaauggcucaauuauuaggaaaacaagaaaauaccccuauucuuuuccuacgcaccugcuggcauuucuugagcacaucugggguucggugcucugccagagacuuguuauagaaauggauggcauccuuguacuuuucuucuuugaaguaggaguugccaauucgagcauaugcucugauaaagaaagagggacaaggacugcuuaggacagagagauaaagucagcuccugcagaaaaacacaccugcagcuagaaaggcccgcaucacugccuucaacaccuuuugucuugucucuggugaccuucuugccagcccuuucuuaacacagcagauucuauggccagcagcccuccuccccaugcagagaaacuuaagucuuggacagcaaacccuccgcgcuacucaagguauucuggaagguugagccuacuuggcaaucugucgauagucuucucgguuuucucuccccacuucaauggccuucucacaaagcucccggcacuuauuguagucgcccuuuucaaaguauaccgcugccaggcaggaugguuaagaaggaacagucagucuuugcuuccucccucagagacacccaacaauucccuugccccuuguuucugggccucaccugcuugauugguaauguaagucauguuagugggguccagcuccuuggcuuugucguaaugcuucaaggcugugucaaagucuuucuucuuguaggcaucguuccccagcucuuuuucuuucagugccuagaugagguuuagaagugagugcugagcaaaucuaacucaggugacaaagcaagaaucuaugaucugucacaaguucugaaaugcaacuaacaugaauagaauucuaucaaguucuccugaaggccucuucaucagucagcuauagacaauaaaguaucagccguuagaaugaaaacuaacuucaucuuugcuugcucugaaacucccccuuuuccaccuacucuccuagaucuuugucaggaagcagagcgcuucuuuaggggagaggaaaucccuucgacuugaagcaaccggugaggacagcagaguuuuggaccaggcuuuauucugaggcugcagcagaucuggugucagucuugugguugccucagggucuuaguugucagggaaccauagcagaggggguggugagaggaugagaagcggcugaguggcacgagucuucagcaaagcucacuaccgcccacacuggagggccuuuuuccagcugagacacccuaaacaaccaacgcuuacccauuucaaggugcuaaauuuggcaacaaucugcuguuccaguuuacaaggagggaaaugaaaucguugaggcacaugccuucugcucuaaaagagugcugcuuagcggacacucccaaccacacaccauguccagccaggaagcaaaggccuagggauugauguggacaacauucuucggaucacgacaaggacgugaauuacucucaacuuuccagucuugcuaggaccaacauucacacuggcagcaaugaagccgcuguggugaccacgggaagggcaacucccgcagcucacucuuugcuacacauuacuccuaggaaugcucuugugaagcuuuuuuuuuuuuuuuuuuugagauggagucucgcucugucacccagccuggaguguagugaugagcucucagcuuauugcaaccucugccucccgaguucaagcgauucuucugccucagccucccgaguagcugggacuacaggcgcccaccaugacaccuggcuaauuuuuguguuuuuagugaagaugagguuucaccauguuggccagacuggucuugaacuccugaccucaggugaucugcccaccuuggccuccaaaagugcugggauuauaggcaugagccaccgugccuggccugaagcugauuuuuuaacaugcuggccauucuaaugaauaauagccauaagcuuagcgcauacuaaagcacucaaaauaguuuuaggugggcacaguggcucgugacuguaauccuagcugaagcaggagcaucgcuugaggccagaaguucaagaccaaccugggaaacacagcaagacuccgucucuaaaaaaaccauaauaaucauggucaaucaaggucaacagauguccccauucaacauaaagauuucuaguuguuuauagauaggugacagugaggagagaaaaaaacaagaccugcuucuuauucucuggaagaucuucuuccauuggcucuggcuuggucuccuuuuugggaggggguggugguggagguguugcaaucucuuccuccucauccauacugcccagaucgaccccaaggaggacgcugagaguggucaugauccggggaucuuguaguuuccuaguauugauuuaaaaaaauaaagaaaaauuguaauuacuccuccccacaauuagucuuuuaacucccacuuacuacuaaagucagauucuuguguuuagaagcuccucacccaucaaaagauggcuagauuuugcaccacucaugaguuacaauugagaaauacucaaaccgucaaaacacuaucuaaaauagagucaacaaaaacaaauaaaaugaagucacagauagcggagcacgguggcucacaccuguaaucccagcacuuugggaggccgaggcgggcagaccacuugaggucaggaguuugagaccagccuagccaacauggugaaacccaccgcuacuacuaaacauacaaaaauuagcugggcgugguggcguacaccuguaaucccagcuacucaggaggcugaggcaggagaaucgcuugaacccaggagguggaaguugcagcgaacugagaucacaccacugcacuccagccuaggggacagagcgagacuccaucuugaaaaaauaaaauaaaauaaaauaaaauaaaaugaagucacagaggucaaguuuauuccucaagguuagcagauacacagaggaaugaguuguuuuagguauacuuccguagcugaucucaggagccagaggauugauagagaugaauaccaguacaagauuuagacacaucuuuacacaugaacuucaacccuguuuccacucugauauaccaacagagaaaguagggccuaaguagauggaaaggaugggguugacgcuagaucagaguucuagaagagcaggagagagguguauacagaugacaaagaacauucuagauuacugugaaauaugcuccccugacccuuucuauaauuacaaauaaacgaccaccaccuacugcucugcagagaauaagcaaaggcaaaaacucugcaguuuagaccagggaacccucugcugugagguuacaggaagaaagcauaacauuccccgauuuccagaaccucagugagcggcguccacuuacgugcccaggucagaaggcuuguuucguagcugcucuaucagcucccgguagguaggaucacugaguaguguccuuguccugggaucacucuccaacuucugauacagauuaggcauguugaaaggguucaugaauuuucucucuguccaaauaaaggaaagcacaucacuaugaaaugaguucacuagaauuacugugucccauacccuaccagacugacauuucucaggggugaagacucaaaauuaaucacauuaauaauaagaaagaaaacugugcgugguaccuaccugccaaccuggccuccauauucuguaaacccucuuucaguugaggguuauuugccucguguuuuaagcccuccucauagguucgcuuggcuucuucaaagcgguuuaagaacucuagagcugcugcuuuucgugaauagcccuuaaaccaccaaagacagacacaaaauagagaacacccagagguaaaucuagaagacgaacucaaaaaagaacaauucuacuuuuaugggggaaaaaugaguauucacaugaaggccaaagagaaaaaaaggagaggaguaggcuacgaggccaaggcugcuacuguaaggauccauccaaauagcagaggcacauccgccccgccuuguucaccucugaucgacuguggucaguuucuuuggcaacacuuuuucccuuauuuuuuugguaaagacagggacuccuuauguuacccaggcuggucccaaaccuuugggcuccaguaauccuccugccucaaccucccaaagugcugggauuauaggcgugagccacuguaccgggccucuuccuuuuuuuuugagacagggucuugccgugucaccugggcuggaugcaguggcacgauuucagcucacugcaaccuccgcuugccaggcucaggugauccuccugccuuagucuccugaguagaugggacuacaagcacaugccaccaugccuggcuaaauuuuuuugcauuuuuaguacagacaggguuucaccauguuggccaggcuggucuugaacuccugaccucaagugauccgcccaccucagccucccaaaguguugggaucacaggcgugcgucaccgcgcccagcccuggccucuuccuucuuaguaccaaaaauaaagccuguauuacaacuaauggcuaccuuagauuugaugaaaaaugccauuucugaggaggauacucaaacagggagguggguagguaacuaucaguguaucaggacagguaaaccucaggccaccaaaaggcauuucuggaagggucugaagggccucucucccuccacugcccacagcugaccuugccccagucaggcuuuaggucgacagucuugcagccauccucauaagccuucugguagucuccuuucuuggcauaggcagcagaacgguugcuguacagcacgugguuguggggauccagcuuaauagcuucggaguagcacuguaaggcaucaucgauguuacccacgcucagggccuuguugccuuucuccuucagcucauugaccugaggggaaaggaacacacagcuucucuaugaugugcccauuuaaucccaagcuuuaaagacaacacucauucuuucauguaguuaccaacaaauaaauaggugacuuuacagaucagaagagagaaaaccgguucauuuauuuaauuucucacaccuucccuaaggagccagcaaagaaaaaauaagcaggggcaaagagcccaggcugcacuccacgcuggcccccaugugacgaacgagggcucugccacucuuccggucuccacauggagcucacgaagccacuccagaaugugccacaugcuccuuccauggaaaagucaauucauuugccacagauuuccaaagcauccaaaugacaaacagagcacagcccuagucaccccucacaggaagaaggugggcggaguggcacugauacaugcuccagugacccaaaggcugugggauggcagcggagacuucucuuucuugggagcggcaagaugcuugccuauggcauaguugucaucuccucccaucagggaagaaccagucuccauuuccugguguggcaacaugucaccacaggauagauaaauguucauuaauggguaacagucaagcuagcuccccaaauugauuccugccauucuuaaauauuacauuacaaaggggauggaggaugaagaaaugcuacugugguuuaaaccucucccuucucaaacauauaaagugcaagaaguaaggauacagcgggguuuuguuuuguuguguuuuuugagacagagucucacucugucacccaggcuggagugcaguggcacgaucucggcucacugcaaccuccgccucccagguucaagcgauucuccugccucagccucccaaguagcugggacuacaggcgcacacccccacacuuggcuaauuuuuguaauuuuaguagagacgggguuucaccauauuggucaggcuggucuuaaaacuccugaccucaggugauccacacgccuuggccucccaaagugcugggauuacaggugugagccaccgcgcccggugggauacagcaguuuuaaaaagugaggcagcucugccuggccgccccaccgacugggaagugaggagcgccucugcccggccacccaacugacuggggagagaggagcaccucugcccaccugccccaccgucuggcaagugaggugugccucuguugggccacugugcaacccuccaagugugaagugacagccuugugugugaucuuucugcccuccccaaguuugcauuuuccacauuaaauuuuacuuuuucauuaaaaaaaaaaaaaaagugaggcaggccuuggcccugucagaacaguguccucacuaaaggguuucuccuuacugagcugccccacaaaaggucaggugccccacagcagccuaccugagggcaggcaaccccuugagaagcucauuguauuuauuauuauuauuuuuugagacagagucuugcucuguccccagacuggaguguaguggcacaaucuugccucacggcaaccuccgccuccuagguucaagcgauucuccugccucagccuccugaguagcugggauuacagucacccgccaccacgcccagcuaauuuuuguauuuuuaguagagauggaguuucaccauguuggccaggcuggucucgaacuccugaccucuuaauccacccaucucagccucccaaagugcugggauuacaggcgugagccaccgcgccuggccauauuuauuuuuuuuuaaagauggcaucucacucuguuaccagccuggagugcaguggcaugaucacagcugacuguaaccuugagcuccugggcucaagcaauccuccugacucagcccuuuuuuuuuuuuuuuuuugagacagaguuucacucugguugcccaggcuggagugcaauagcacaaucuugccucaccacaaccucugccucccagguucaagcgauucuccugccucagccuccugaguagcugggauuacagacacgcacuaccacauccgucuaauuuuguauuuuuaguagagacgggguuucuccauguuggucaggcuggucuugaacuccuggccucaggugaucugccugccuuggccucccaaagugcugggauuacugguaugagccacugcgcccggccaacucagccuuuuaaguagcugggacuacaagugugugucaccaugccuggcuaaauguuuuuuucuuuuugugguagaaauggugucucaccauauugcccaggcuugucucaaacucuuggccuaaagcaacccuccugccucagucucccaaaggugaaccaccacaccaggccaaaauacacuuuuaagagguaaacguucugugagauagaguugucaccgaaguuacuaacucauucuauguauuauccacccacgacccaguaaauugaugcaagaaauaguuuugucaagagaaaugauuuuaggcuguaaucucagcacuuugggaagcugaggcggguagauuaacugaggucaggaguucgagaccagccuggccaacauggugaaaccccgucucuacuacaaauacaaaaauuagcugcugccgggugcaguggcucacgccuguaaucccagcacuuugggaggccaaggugggcagaucaccugaggucaggaguucgagaccagccucaacauggagaaaccccgucucuacuaaaaauacaaaaaaaauuagccgggcgugguggugcaugccuguaaucccagcuacuugggaggcugaggcaggaaaauugcuagaaccugggaggcggagguugcaguaagcugagauugcgucauugcacuccagccugggcaacaagagcgaaacucagucucaaaaaaauaaauaaauaaauaaauugcccggaugugguggugcaugccuguagucccagcuacucagcaggcugaggcaggagaaucaucugaaccugggagucggaggcugcagugagccgagauugcaccacugcauucucaccuggaggacagagugagacucuauuuggaaaaaaaaaaaaaagagagaaaugauuuuggaauccucaaauagagagaucaggaacuuccaucaaucagagaccuuacagaggcaagggcagaaggaaccugccaaauuaagcaaacaagggauaaaaaauccuagagcccaagauggaggccagaagacgaagaguuaacaaaacucaaguggugucaagaggcagcuggugaaguuccugccuaugcuuuagaaaagcauuuuucaaacagaguacugaucaacagugggucaggaaaucaauuuuguaggucaugaccagcauuuuaagagaccaaaugggacaaaaaaauaccagcacacagugcacauaacaguaaauacuguuuugcugaauguguuacauggcuguacgccuguguuggguuaaauguaagaaguguaucauugugggauuugaaaggccccuauugaaaaaaaaaagccugaacauucaaaaucuguccaacuuuuuuuuuuuggagaugcaguuucgcugucauucaggcuggagggcaguggcgcaaucuuggcucacugcaaccucgaccagccagguucaagcaauuguccugccucagccucccacguagcugggaccacaggcgcgcaccacaauguccgcuuauuuauuuauuuuuuuuuuuugagacggagucucgcuguuacccagucuggagugcaguggcgcaaucucggcucacuucaagguccgccucccggguucaagcgauucuccugccucagccucccaaguagccgggacuacaggcgcgugccaccacauccagcuaauuuuuguauuuuuaauagagacaggguuucaccauauuggccaggcuggucuugagcuccugaccucgugauccacccgccucaaccucccaaaguguugggauuacaggcgugagccagcacgcccggcccaguuuuucuuuuuucuuuuguauuuuuacuagagacgggguuucaccaugcuggacagguuggucucaaacuccugaccucaugauccgcccaccucggccucccaaagugcugggauuacaagugugagccacugcacccggcccaacuugaguauuuucuaaacugaaauacaaaccucacaguugaaaaugaaaacaaaagguagagaaaucguguuuguuuucaggaauggcuuccagauggugggcucaaacacaccugggauuaaaugccaggucaucuguacagcugccaugccaguuugcuguccuaagucaaauauucauucaccaucuaccuaccuguacauacacuucuaucaccaguagugguaauuuaaaaacaaacauuuuaagaccaggcaaggugacucacgccuguaauccuagugcuaaugaagugggaggccaaggcuagaggauugcuugagccuagaaauucgagaccagccugggaaacagcaagagccccgucucuacaaaaaauguuaaaauuagccaguugugguggugugcccagcuacucaggagagugaggcaggaggaucgcuugaggccaggaacuugaggcugcagugagcuaugaucccaccagggcacuucagccugggccacagaaccagacccugucucuaaaaaaaauacaaaauaaauuugguaacagaaaucguuucuuuucuuuuuuuuuuuuuuuugagauggagucucacucugucacccaggcuagagugcaguggcgugaucacagcucacugcaaccuacgccucccggguugaagcaauucuccuaucucagccucuccaauagcugggauuacaggccugcgccaugacccgcuaauuuuuguacuuuuaguagagaggggguuucaccauguuggccaggcugguguagaacuccugaccucaggugauucgcccaccuuggccucccaaagugcuaggauuauaagcgugagccacugcgcccagccgagauccuuuuuuuuuuuuuuuuuuuugagacggagucucgcucuguggcccaggcuggagggagacggagucucgcucuauggcccaggcuggagugcaguggcgcaaucucggcucacugcaagcugcccccaggguucacgucauucuccugccucagccucccgaguagcugggacuacaggcucccgccaccacgcccggcuaauuuuucuucuguauuuuuaguagagacgggguuucacugugcuagccaggauggucucgaucuccugaccucgugauccgccugccucggccucccaaagugcugggauuacaggcugagccacggugcccggccccagauccuuucuuaaagguaaaagagcaacgucuuauuccagaaaucuuuuccucaccuauacuacagcccauuuaacccuagauacaacugaaauauuauaugggcacaaaaaaguuuacuaacuucauuuccacucuuuuuaauacagcaaggaagcucgagcuuugccuaaagcagcaacugcuacaagagaccaaaggcucagcucuguagcucacaccaaaaaaaggaugguagucacuaguccaucgagaugucuuauuuaaggggagagugugggcgaucuuaguuuuauggcccugaaguaagaaccagauaccagguauaguuucagaauugucacccccaaguguuaugggcccggagcgaagacaguaguacucccgagcgggaggaugauuucucggagguugguagagguuucuuggagguuguuuuguccuuuuucuuccgaugaaucauuacagcucaaugacagcuucaaaucgaacaaaaccucuaggccuuucauaaccgcaagcuacugaggacauaaccaagucacugaaaggaagcagcaaccgcuucaaacucggccccucaaaugcucaguagaggcccauaacuuccagcgguugaucucuguaaauugucuacaaccacccccgggucgucagaaacccaucuuucagacccaccuuucggaaguguugguccucggucacucgacaaucacacacacaagcauacaaaaagagggggaggggccgcaauacauuuguaaaacacugucagagauggaauucgucccaaggacuuuugcggcacccuucccuuucccgcaucagguagagucggucugucgcuccucagacccccgcucaacgcucucccacccugaccuucucagauguagaagaguaacauuugccccaacugcaucccaggcugcuaagauccucggcuacucccaguguauccccguccccgcucccuggauccguccaaguuccucguggcuaagucccgagcgguuucuccgucggccgucugagaucucccggagggcuaccucgcgggugcggaccccggcccccggcccaccuccaccccgcccccugcggcccgcacccuccccaacauggcccgcagccgcccccucgggacgccuucagggcccggucgcgaccccucuucccgccgccggccggacucacccaagcuguggccuccgccgggcccuccucgcccaaccagggggcgaugggcgcuccccgcggccggccucgcuaaagaucccgcucccgcccgccgcccgcggcccucaccuccccgccgccgccccguccggccccagcgccgagcuccggucuccuggauccggcgcccgccccgccccccuaccgcggccuggccaccgccgguccccgagcaggcucggggccucagcccgccccucccccuucaccugcuccauagcgcagcgcgguccggaaccccguugaaucgaauccguccgcuccgcguucccaaccgcacgcgccgccuucuggaaccuacuagaagcuaccgggaccccggcucccgccccuuccucgccugcucacuggucgaguucuucuag

SEQ ID NO: 192779 - RNA, 1937 nt, Homo sapiens
ggccagcgcagccauuuuggcuuccugaccuugggcuacggcugaccguuuuuugugguguacuccgugccaucauguccguccugacgccgcugcugcugcggggcuugacaggcucggcccggcggcucccagugccgcgcgccaagauccauucguugccgccggaggggaagcuugggaucauggugaggaacgggccuggaagagcgcgggaggcgccgugggcugaccccuucugccuagcugaccucaggugguccugagaaugccucgcgccccgcagcguagcggggagcagcagugccgguuugggcaugucuggagggcgcgaacgacggggacagugcccgggcgacagucggggcugucggcguuaggucuuuccccacagccccaggaucucgggucugguccugucaggcccucccucuccugucgccuccucgcugcgccgccuccugccgacuucuuuagccgcucugagcccauuuucucguugguucacugggggaugccugacgcugucagcgacgaaaaugguuguuacugcuauuuauuuuauuuuauuuuauuuuacuuauuuauuuugagacggguucucgcucugucgccaggcuggagugcaguggcgcgaucucggcucacugcagccuccgacucccggguucaagcgauucuccugccucagccucccgaauagcugggacuacaggcgcgugccaccaugcccaacuaaauuuuguauuuuuaguagagacgggguuucaccauguuggccaggauggucucgaucucuugaccucgugauccgccugccucaaccucccaaagugcugggauuacaggcgugagccacugcgcccggccugggaggggguuuucaggcaaggaaggauagguaucguuuuggaguuacuggcccaugcaaggauccugggucuuaacauacaggcuuugcuuuuuuuguuuguuguuuguuuuuuugagacggagucuugcucugucacccaggcuggagugcaguggugcgaucucggcuuacugcaaccuccgccucccagguuuaagccaagccauucuccugccucagucucccgaguagcugggaucacaggcgcccgccaccacucccggcuaauuuuuuguauuuuuaguagagacgggguuucaccauguuggucaggcuggucucuaacuccugaccuugugauccgcccgccuuggccucccaaauugcugggauuacaggugugagccaccaugcccggcccagaccagcuuuaaaacagguuucaauaaauccugcuuccugucccuuccuuuaccaucugguggugcauuucucccugaacccuaaccccagcugucucuccuuccucucacucuucccccuccuuauaacugacccuuuaccucaaggguuagcguagcuuuggaccugcucugucugcuccguggagcguggauuccuuuaacgugaggaugcggggccucccacuugccucugaguccuggcucccugagcggggcuuucugcugccugggaacugcaaggacuuagagagccuaggggaauacugacuccgaggugccuucuuucuugugcucuguguaggaauuggccguugggcuuaccuccugcuucgugaccuuccuccugccagcgggcuggauccugucacaccuggagaccuacaggaggccagagugaagggguccguucugucccucacacugugaccugaccagccccaccggcccauccuggucauguuacugcauuuguggccggccuccccuggaucaugucauucaauuccagucaccucuucugcaaucaugaccucuugaugucuccauggugaccuccuugggggucacugacccugcuugguggggucccccuuguaacaauaaaaucuauuuaaacuuua

SEQ ID NO: 192780 - RNA, 5624 nt, Homo sapiens
ucaguaagcuuagauuuuauuuuuuuuaauuuuuaaaaaauguugaaaaauaaauccaugucugcauaaguucccaacccccauuucuccaaguuucuggaaggugggcuuggugggcacccucagcuccuuagcauuucccagcuggccccugaagacagagcuucucuuccagccucugcugcuguaaggccccucugcccaccucccccccugcagccucccuccccaccucaccccagacuuauugcuaaaagaagggaaagaggaaugagaacagccagcacacccaacugcccucuccccacuccacgcuaaggucacuaccccggacacacaaagggcaggacccagaggccaagccccagcagacuaggacacagccauuccaguaccggccaggaagcgaaagugcccucaggccagcucaaaggccccugagcccggccauggccccaggagacaggcccagcugccaggaacacaugcagaacccaaagggcggggcugggcuguccgaaacucuggucuuacaaagaccccgccagagcccuagucccuucuguccucagugacaccagagaugccuggggauggccagcaaagggguccuggagcccgugguugguggaggacgucagggcucagagugagggugcugggggcuccagagggguuccaaucagggugggugggggcugagggccagggcgggcgcuguggcggggggcagccagagcggggcggaugagaggcggugggggcugguugggggccagccggggcuggaggaagcggcccugcugcaguggggguggcugucggagcagagugggagccgugggcaaagguggccucagcagcggggguggcugggacagcgaggugggagguggagggggugguggcgcagggggcacugaucggggcacggacguggagaccgauguaaucuggaccugaggggagaggaaagagugagaagccaggcucuucccgcccucagcccagucuaaggaccaaggcggcgccucaccucgccucgccucuccucucugagggguuucucucacccccuucucaccucaucaucuuccucuagggcuggggcuggcaauggagccccucuccuagccuccuccauggggacuggggcuccaggggccccauccugcucagccucccauuccugcagcaccuccuccagauugaagcggcgccgguagcucacaaagaaagucuucaccugggucagagucuuguucccaaucaccucugcaauagccccaaagucuuugccauaccuacggauggcugcaagggucaaaagggcagcagcgucaauaccccuucgaacuaguuacuucccugacccuuccccucugcccccccacuccuuggaggguggggagauagauuccugggguccucucuucucaccacaguuuaacccaccuugaacagccaaaagcugcucaucugugguccagcgggaguugaacuugguguuggccuggaaagcaaggaacaacauauccuuuagacucaaaaccaugcaaauggaagcccugcuccccaagcaguacucuuucugcucugccuccagagagaaaccccccuuugcacccuaacuuaaagagcagccauaccuccggggggcguaguggaucaauaccgcccuccagggcuuggcgcaggcugcuguucgucugcuucaugcucuguaccugggaaggccaggaaguggaggaauaucagacucccaucucaggcaggccacuaugccccucacaggacccuacuucugcacagacaccagcaccacugccccggcaaagcuuucugccauccaccaucuggcuuguuccuccuaaacaacuacucaguaggggagccgcugggguucuccccuuucugcagaccaguuuauauuuuuauuuuuuauauauauauauauauauauauuuuuuuuuuuuuuuuuuugagaaggaguuuuauucuuguuacccagguuggagugcaauggcgcaaucucagcucaccaaaaccucugccucccggguucaagcgauucuccugccucagccuccugaguagcugggauuacaagcgccugcuaccacaccuggcuaauuuuguauuuuuuuuuaguagagacaggguuucuccauguuggucaggcuggucucgaacucccgaccucaggugauccacccaccucagccucccaaagugcugggauuacagguaugagccaccgugcucggccuauuuuuuuuugagacggaaucucacucugucgcccaggcuggagugcaguggugcaaucucagcucacugcaaccuccgccucccaaguucaagagacucuccugucucagccucccgaguagcugggauuacaggugugugccaccacgcccagcuaauuuuuguauuuuuaguagagacagguuucacuauguuggccaggauggucuugaacuguguaccucaggugauccgccggccucagucccccggaaugccuggauuacaggcgugagccagcgcacccagccugcagaccaguuuuuaagagaaggcccaaaaagaacaccacauuacucagagucccagaggauggggcucggccccugaaccaucucgcuuacaccucagcucccccuagacuucaguucccaggugccgaaugccaccuuugcauagcccguucauuucccagggccccaccuggcgcuugagggagaugagcugagagucaagaccucggagcgugagguuggcaagguccgggcuuccugacacugccgugaggccuucagggcucagguacaugcccuugggugggcgacgccggguucgcaagggaugguggcgguacugagacaccuggaccuccuuuuucccagggccugggcgugcauucaggggccgagaggguagaggcugccagugaaaggagaggcagguagguggugcagagccagagagaggcaagaggacaggcaggcagggcccagaggcucugggagcucaccucucucuugggaucugcaggaucgggcucucccucacucacgccuccucgacccucuucgagcucaucacugcugacacaggggccagggagggaaugaggcagcugccaggagcucuaccuacccccaugcccagugcuugcuccugcccccaccugucuucuuuguccuugcggccccccagccgccgggccugucuguccaucacacuaguucggcugcgggucuucuuccaagaguaguaguauuucaccaggcugggaaucaacuugucaggcagcuggaggaggcaacgccagaagcuggggaccacucaagacucugggccccagguaagcucuucagaaaggaggggcagaggagcgccggggaguggggguggaagggcuuuaccaucugcuggauccgcuggaagcauuugccauggaagccaaaggccuguucaaacagcaccuuguccucuacuguccacucgucagggaauggggugaaguuggccaggucggccagcgacuucuccacaucgugcuuaugccacagaagcaugcccagcgccuggcccggggcaaggggcagcugagccugagcugccccggcaccguuccaccccauucccaagucccugggggccaaggcucaccugcucaauguuguagccaugcuucuccuuggccaucgcaauguacuugucaacugcaggggcagcaggggcagggucuuggugaaggggguuauagcuccuaacccaggccuguccagaaagggaccaccccacaacggccaggucccugaacacgagccccagggcaaggguuggacccacgaacaccucagcuuccagcccccuucugagaagagcuagcuuggagcugggaugaacccaagcccccaccucccagggcugugccccacucacgcuuggcaucugacacacagugguugggugaccacaccagcauccccuucagcuccuuguugcuguagcgugcggggcucucugaaaggccgaggagcaggagggaagacacucagaucagccugguggcacaagccuagacccauggccagagggcagcagaggaguggagccagggagguugaggcccagaagggaaggaggggcagagacccagacaggaaggcagggcaggaaagcaaaccaugcuggggggccacccaccccugccagccugcccuuccaggggagccaaucaagggcgccccagguggggcugcaggccaagccccgggccuccacccccaccccacuucacagccuguccugcggcucaccaggcuugcacuccggaauuacggccugguaauugguuccaacgcggaucaugcugucuguggagccagggggaggcagucaggacuccagggagggcgggcgggagggaggauguggcgggcgggggagguggccggccuggaguucuccuuccugaccacccagggcccccaccuuccaggaggcucacuuuucccucauuguaccccaguuaccugcagccacagaagggacuggaagaggaaaagacccuguccagccauggccauuggggcuggaggguggacaaggggacaguuuuagagcccaggccaagcagggugcuuuguuccgggggaggggagcgggguuggagggcagccccuagaccuggaccacagcccugcaaggaacccaaggcuccuucccaccacaggagccucacagcucuguguggaggugucucuccagucccugcuccagccagaccucaguccccugcaagguggcaagguaugagggacccacucuaugcaagggagggaugccucggucccugagggggugagggcagggcaggggccggcaggacgccuccacagcagcuaggggcccagguuccagauuggcugugccggcagccuggguuugugggagaagcaacgcagaggcuccaauccaggagaggcaggagccaucaguguaacaggcucguggucugcaacucuucccccucccgccccacuccgcuccccccaggccggcgcgccuuuaacccuaggccaccgggcucaccgugcgagugcuccuccucgcugcugucauccuccgaguggggcuguccgccguugggcaccgucuuggcccggcuacgggacaggaucccagagcccgcgcucggcuucuccaucacugagggcauuaccccgcccagcugccccggggggcgcaggagccuucggagagcgacagugguugccgcacucgcuccgagugccgagcccggcccggccuggagaggucgccacugagguuaggagaggcaggaggucagcguggcuaggguccggcggggugggagcccaccugguagccccagcgcucuccacgacccccacgagccagggcgucagaaaaguuugugcagaagugggggacgcaagggaugagcgcaagguccggugcggcuggggcgugauuacuauguacgccccucaggguugggguuccccugaagucggggcccccuguccucggggcgcccuggaaccccaccgcccaccugcccacgccguucagcggcugggcgc

SEQ ID NO: 192781 - RNA, 78421 nt, Homo sapiens
gcaugcgcgcucgcgcucccgcccucuagcugcgcucggcugagucagucagucugucggagucuguccucggagcaggcggaguaaagggacuugagcgagccaguugccggauuauucuauuuccccucccucucucccgccccguaucucuuuucacccuucucccacccucgcucgcguagccauggcggagccgucggcggccacucagucccauuccaucuccucgucguccuucggagccgagccguccgcgcccggcggcggcgggagcccaggagccugccccgcccuggggacgaagagcugcagcuccuccugugcggguaaggcgcgcggggagcccccgcccugggaaagagggcgagcgggagccugggggcuggggggauuaggaggcgaggcgggaggaggacgaauuacccucgacuacugacggcuucagccccccggggacgagcguuuggaaaaugggcaaaggggaaggggaacguaagguugugcaggcggugaggaaauagcggggugugaggaaaacagguugggggcggggagauaguccagugggcguuaacgccaagacugggcagguggggaaaaauaccagcucgugggauaaaauggagaguugcucgaugcauauggugaaccugggugauuuagugaggauuagagagauugaaaggauacgggcagguggguggugggagaaacaauuuguuacuauuuuugaggggaugguggugaaaggguugcauugcagguuugcagacagguguugacauaaucaagcauucaugauaguccuccaaaauauuuuuggcugcccaugggaaggaugaggaaguuuaauggaagcauuguagccuguuuuuuuuguuuguuuguuuuguuuuuacuguuuucggcuagacuccaugaaugccggauuuuucugaggcuccgagguagaaggaggcgugaugagaauagcucagggaagauuugggagggagcugcuaaugguccaagauggauccguggcugcaucugcaacagccugcucuucccuggcgcugcguggggguggggacacgcaaucagucgcuuauauucuagaaaauagagucaugcuaagcuaucaacauguuuugauuucauguuuucugugggcuacuauugaucgaaguauaacaaagggggguguuuauugcagaaagggggagggggagaacauucagacaaagcaagggcugguugaguccccuucucccaucucugugaaagacuaagaacgaagcugcagaccuccuuuaguuugcauuguauacgcgucugccugcugguaagagcugccuggcaagcuccccuuaugcagaaaucugcagugcagaugccuucuuaaggggggaaaaaaaaaccaccaugggcaggugguaguucucaaaggaacggagucuuugaagggaaaaaaaaugccuuuugucaaaggcagggccguaaauucgggagaguagagauaauuuugcucucuauuuaguuauguuaaaggauuuugaucauuuuuuuuuaaugcuucguugucuccuuuggcagaaucuuggguucuaaagaaaaaauuucugaucuuaaccuuaaauguauuauucucuacguguuuuucuagcagugaauuuucaccugucugagagcuuuggagcccuguuggauuuuuucagugugguuauggccauuucaguagaaacaggcaguaucaggaagcuuuugcagauaaaagaaugaggcagcaaauuuagaacccugucuccuuuaaaccaccagccuuuucuccaaauuuuuguguucugggcuaagguccagaugaacagcgacuuccuuauaacuuagcaacuugaucuuuuugcuuuaaucacuugucauugcuuacuguuugguaggcccuuuuguacuuaccuuuuggguuuucuugauuuuucauuuuugauucagaccuaaguuuuagaaauuuggcucuguaagcucaagauaagacagauguuaaguguugaagagucauuuuaguuagcagauuugaaaauuuaguccuaguuuguuuauaacuaaauggugaaaucauuugagauucaacuuuuucauucuuuuaaugcacuuauggaagaacuggccuaguaggccaaugaaauaagaguauuuuguucacagacacacaggcauaccacaaccuaauuggcaccuaaauuggcaauacgaauuuaaugacauaacauauuucuguuuggcuuaccuuuuuuuaugucaucuacccuugucacaauuuuuaucuauuuauuguguauuuuuugcacuucucuuuauaauaguggaaaaggugcugaaauuauguguuuugucgaaaguaguagaauuauaucgugaagugcuguuccaaguacaugaguuugcauuacauuuuccgaauaauauuaaaugccgcgguuuccacucguuauuucuuucucuuuucuuuucuuucuuuuuuuuuuuuuuuuuuuuuuuuuuuuuagacaaggucuugcucugucacagacuggagugcaguggagccaucuuggcucacugcaaccuccaucuccgggguucaaaugauucucaugcuucagccacccgaguagcuggaauuacaggcgugugccaccacgcgugguuaauuuucuuuugguuuuuuuuuuuuuuuuuuuuuuuuugguuuuuuuuuugagacggagucucgcuuugucgcccaggcuggagugcaguggugcgaucucagcucacugcaaccuccaucucccagguucaugccauucuccugccucagcuucccaguagcugggacuacaggugcccaccaccaugcccggcuaauuuuuuguauuuuuaguagaaacaggguuucacaguguuagccaggauggucuugaucuccugaccucgugauccgcccaccucggccucccaaaaugcugggaauacaggcaugagccaccacacacggcccacaccugguuaauuuuuauaucuuugguagagaugggguuuugccauguuggccaggcuggucucaaacuccuggccucaugugaucugcccuccucggccucccaaagugcugggauuacagaugggagccacugugaccagcuuuacccauuauuucuuaguaaaauuuuauuacagaauuuguauuucuuagaugugcuguagacacguaucacuauuagcacuuaaaacagugauauauaguaguacuugguaaguauuuguugaauaaauuaucaaauuuacgagcuagaaaggcacacuugagaaauaaacuaaagagaaacucuuuuuggagucucgcucuguagcccaggcuggagugcaguggugugaucuuggcucacugcaaccucugucuccugggcucaaaccauucucccaccuuagccuccugaguaggugggauuacagacaugcaccaccacgcccagauaauuuuuguacuuuuacuagauaugggguuuugccauguuggccaggcuggucuugaacuccugaccucaagugauccgcccaccucggccucccaagguguugggauuacaggcaugagccacugagcccagccaagagacucuuaucuuaaaugcuuauccauugcaaaugugcauucauauugucuaaaaagcacuaauacaguuuuggugggcccaaugcaagauccucauuuguugggucacuacuugaacauaaaaguuuaccuuaagauacugcaguguggggccaggcacgcuugcucacuccuguaaucccaacacuuugggaggcugaggugguuggaucaccugaggucaggaguuagagaccagccugaacaacaugguggaacccugucucuacuaaaaaauacaaaaauuagccgggcacagugacgggcaccuguagucucagcuacucgggaggcugagacaggaaaaucacuugaacccaggaggcgggaguugcagugagcugagaucacaccauggcacuccagccuaggcgacacagcaagacuccaucucaaaaaaaaaaaaaaguuacugcaauguguuguaaucauuuuuauugcagaagccuuuccuccuugcuggauguuuuucuucaugucacaaaggaagugucucaggcuuuugcaccaugaaaauaagaugaaguuuguuauuccaaaauuuaacuuauuuaaaauguagaugcuaaaaaauuaccuuaauuguuuaaaaaaaaaaucuguacguauugcugucauccuccagcuucauguucuuucaccaagcuccucuugguuuuggagacuugucuugauuuuaguuaaagaaaaauaagugauugguugguguccuacagaaaacaauuuugucuugacugaccuguccaguaauuaauuuuagaaguauuaguuacuauauacaggucaagaaugagugauggcacucuguacuuuagugccuuagguucuaaugcagccagcaauguaguaugcuuagagauggggaucaggggucaggauggcuucccagauuucugccuuugaaggaaacugaagauaucagaggcaaaaauuugagguugagguaaaagagacugaaauauucaguguucauuucagagcaagaguugccuuuauuaggccucaaguauagagacacgucuaucaucugaacuuuaaaaguacuuuaauaguuuacugaugacacgauguugaaauucuguaacuuggccgggcacgguggcucacgccuguaauccuagcacuuugggaggccgaggcaggcggaucacgaggucaggagaucgagaucauccuggcuaacauggugaaacccugucucuacuaaaaauacaaaaaauuagccgggcgugguggcggggcgccuguagucccagcuacucgggaggcugaggcaggagaauggcgugaacccaggaggcggagcuugcagugagccuagauugcaccacugcacuccggccugggggacagagcgagacuccgucucaaaaaaaaaaaaaaaaaaaagaacaaauucuauacuugcuagagacugcuuuuuauuguuguuaugaaaguuggcugagucugguggcucacaccuguaaucccagcacuuugggaggcugagguggguggcuugcuugagcucacgaguuugagaccagccuggacaauaguggugaaaccccaucucuacaaaaagacaaaaaagcaagaauuagcugagcauggugaugugcgccuguggucccagccacuuaggagacugagguaggaggauggcuugagcugggggcagagguugcagugagcugagauugugccauugcacuccagccugggugacugagccagaacuugucuuaaaaaaaagaaaagaaaaggaaaaaagaaaaucaugaugccaaaauaaaacuacauuuuauauguuuguucauggaaauuagcucaaagcaaaaacagcuugggcaauuuuuugaaaaagguuuugcuuuaaauauuucuuuccucacucaugaaacuuaguuguucuguguacuuuuuauggcuucauuuucacacuuuguucuaccauauuaaucaaaugugaauauguaauuuguguuuugaguuaacccuuaaauaaaaaggaauguggcccccguccaacacugacaucaucugaguguuacauucgugucagauuaucaguggcaguguaauguguuaaaacacagacuugagcuccaggaaugccuagauuucaauccuggcccugucucuuaauaauuaugugaucuugugcaaguccugagccucaguuuccuuaacuugaaaauugggauaauaguaucuaucuuggaguugguaugaaaauuaaacacaauuuggcugggcacgguggcccacgccuguaaucacagcacuuugggaggccaaggcggguggaucaucugaggucaagaguucgagaccagccuggccaacauggugaaacccugccucuauuaaagauacaaaaaauuagcuggguguaauccuguaaucccagcuacucaggaggcugaggcaggagaaucacuugaacccaggagguggagguugcagugagccaagauagcgccauugcacuccagccugagcaacagggugagacuccaucuaaaaaaaaaaaaaaagugaacacauuuauagggcuuaacacagugucuugccuguaguaaauaacuguaccauuaaugugaagaaaugaaauauagaucaacaaugugaccuagacacauuugcuuuguacccuuaaauccugaccuuuauuaaauaacaauaccuaauguuugacauccauuuguagguuacaaacuacuugcacauauuaauagauaccacauagcaguucaaguacaaaugagaaaucugucuuccucacaaucaaagacuauuguuaugccuuuuuucccuuuccacaugugagucaguuguuucaguuuguggcccuucacauuaaugucauaaagcugccacccgcuuccacugagguggucuguuaaagagguagagggaggagucaagauguuucccagaaggcuuggcaugaaucaauaugcuuaaauacuuaugcagauucugacuaauaaauguuguuaugauacauuaggaaaccccuuucagcacagaggcaagcauacaggagacagcaagaauggucaugucaauauggccugcaaaugccugcugacuuggauuguuuuuauucuccaagaauaagaaguguguuuugcuuuuuuuuuuuuuuuuuugagacggagucucgcucugucgcccaggcgggagugcaguggugcgaucucagcucacugcaaccuccaucucccagguucaugccauucuccugccucagcuucccaguagcugggacuacaggugcccaccaccacgccuggcuaauuuuuuguguuuuuaguagagacaggguuucaccauguuagccaggauggucuugaucuccugaccucaugauccgccagccuuggcuucccaaagugcugggauuacaggcgugagccaccacgcccggccaagaaguuuuuuuuuaaugcuguuuuuguuuauugucaaauucacaaguaauggaaccacucugaucaaauuaaacaaccaaucuacauacauuuaguaggugcacccuuacccuaaauugucauuucuaagggguuguucauuaaguggcugguaagaaccucaguguuuuuauucuugguguuuuaaagaugggcugaaaauaaaaaccaauauuacugcuuuuaucaaauuauccugugaggaaauaauauauuuauccugauauaggaguuaccugucuaguccugugcauguuucaagccuuguaaaaugaaguuuggucaugaaggaauuggugacgucugguugaagggaaaagggaaaguugagcuuuccaauuuuguuugagucaagaguauauuuugcagaaagacacuucucuuuacccauaauccuagaauuuaccauuuuuguaauucugaacagaauuacaaaggcuucauuaaguaaguagguuuucuaauauaaaugugcauauuuguugugugcacuuagcuuauaguuuguguuaacuuuauuguugaugaugaauuuagccuccuaaaguauacaaacuugugaaaaauucaucaauuuuguaguauaacuuuuucucuuaauuuagcuaauacucuuuguauuguucuaauuuugguauaugugcugcugaaguaagcacucauaguaaaacuuuuuagacaaaaauuagcaggucgauauuuuguucuuauaauugacuuauucagaaguugcccagaaaacugacuuaaccuucuauucuguucauuuaugacagcuacuaguuguagaguuauuuuggaucauaggguaugguguugauguuuugaaagaaguguguguguuaaauaaguuuagcuguaaucaguauugcuugugauugcaucauugaagucuucugggcaucugugaguuuuguaagacauguuacucugugauauugcaaccucagagagaaucucuuuaaauacuguaacgggguuugcauuuccauuuuacguaugggagaagauuaucagcaaguggccugcucuugugauuuuuuuuuuuuauuucaaauaacuauucuuaccuguuuucuccaaucaacugauuuauuaucuccuauaaccauaucauuguaaccuaaccagagaagacagugagcuuaucagcaaguggcccacucuugugauuuuugauuuuuuuuuuuuuauuucaaagaacuauuuuuuugagacagaaucccccucuguugcucaggcuggagugcaguggugggaucucugcucacugcaaccuccgccccccggguucaagcgauucuccugccucagcccccugaguaggugggauugcaggcuugugccaccaugcccagcuaauuuuuguauuuuuaguagagaugggguuucaccauguuggucaggcuggucccgaacuccugaccucaagugaacugcccccgccucggccucccacagugcugggauuacagaugugagccaccacacccagucucaaagaacuauucuuaccuguuuucuccaaucaacugauuuauuaucuccuguaaccauaucaucauaacuuaaccagagggaacggugagcuuuuugaccuguuccucauugguagcucgcccuucaagauauauggaaggacauucuggaaaaccuuuuguuaugaaaauuguguccuguuauuugaacauauuucaguggagggcauugucuuuauuuuacguaugagauagaaguacuugauuuucacgauaucuuacauuuguguacugcuuuaugauuuaaguugugcccauauguuaccuuaauucaacaacugagcauacaugaaggcucuuugccaggugcuguggaagacagaaagguaaauaaaauauagaucauuccucuagaggccauauucuauagaggaaagacuuguauuauguuuaucugugagguagacagguagcgauauaacccccuucuuacagauggggacucaggcacagagaguuuaaugcccacgcuuuaagauuugaagcaacauguaguaaaaguggcucaguuacccuuuugaauucagugaucaguuuaauuuaaaagucuuaauuucuggcuccacgguucuuaagccaggugccuuuuuauuucacugcucuacagaaacuuucuagucaaguucaccagauauuuuccacauuguuaaauucaguggucacuucauccuccucuuaacaugcuuucacaacagcuuuugacauaauugauuauucucuccuugaaaugcuuuuuuaauuugucuucugugacaccacauacucacucucacuggcuuuucauccucugucuccauaaaauucaccauuuuaagguggguuuuaguguaugcacaagguuguacagcuaucuccacuaucuaauuccagaacauuuuuauuaccccaaagagaaaccccauaucuguuagcaguaauucaccguucuucccuccccucaauucucugacaacuauuaaucugcuuucugacucuguggauuuccuuauucuugagauuuaauauugcuaauucuuuuuuuuuuuuuuuuuuuuuuuugagauggagucucacucugucacccaggguggagugcaguggcacgaucucugcucacugcaccauccgccuccuggauucaagcgauucuccugcuucagccucccaaguagcugggauuauaggcaugugccaccaugcccagcuaauuuuuguauuuuuaguagaggcaggguuucaccauguuggucaggcuggucuugaacuccugaccucaggagauccacccuccuuggccuccuaaaaugcugggauuacaggugugagcuacugcguccgaccuaauuauuuuuauuuugauagagacgaggucucacuauguugccuaggcugguauugaacuccugggcucaagcgauccuccugccuuagccucucaaagugcugggauuauaggcaugagccacagugccugucccaaucuuuccuuuuaaguucguucuucucacagucuucucaaucucaauaaauggccauucuguucuuuccuucuuuugcucaaaucaaaaaccuuggaguuauccuugauuccuuucugucccucauagaagccaucagcaaaugcucuugauucuaccuucaaaaagauauccaaagucugaccaauucugucaaucuccauugcuaccacccugguccaggcuagcucucuuggguuauuguagaugccgccuaucuggucucccugcuuucuccuuugccucucuucaguccauuuuccacacagcagcugguauaagccugugaaaaugcaaguuggaucaugucacuuaugggccaagugcuacaguggcuuccuguuacacuccguaaaugcugauauccucagaagacuuauuaauaaauacccuguaauaucuggccucaaccucccccuuucucaccuggcuucaaccauacuggccucuuugucucacucuguugcccaggcuggagugcaguggcgcgaucuuggcucacuucaaacucugccucccagguucaagcaauccucucaccucagccucccaaguagcugguauuacaggugcgcaccuccaugccuggcugauuuuuguauuguuaguagagacaggauuucaccauguuggucagacugguuuugaacuccugaccucaagucguccaucaaccucggccuccaaaagugcugggauuacaggcaugagccacugugcccagguuuccuuguucuuuacaccagaaauaacccucuaccucgggguuuuauuugcuguucacucugccuagaaugcucuucucucauugcaguagacucaauguuuauguccccaccccugcaacccggccaaaucauauguuaaaaccuaacccccuggccgggcgcgguggcucaugccuguaaucccagcacuuugggaggcugaggcagacagaucacgaggucaggagauggagaccauccuggcuaacauggugaaacccugucucuacuaaaaauacaaaaaaaaauuagcugggcgugguggcaugcgccuguaguuccagcuacucgggagacugaggcaggagaaucgcuugaaccugggaggcggagguugcaauaagccgagaucaugccacugcacuucagccugggugacagagcgagacuccgucucaaaaaaaaaaaaacaccuucagaaggaaggaaugcuuuuauagaccacuuugguuuucuuuuuugcaugucauguggcaguuuuaaguuauuaaaauaaguacuuuuuaaugggaacaacuugaccaaauuugucacaauuugucacagaauuuugagaccuauuaaaaaaguucaaugagaaagaaaaaaagagagauggggucucaccauauugcccaugcuggucuugacugaauuccugagugcaagagauccuccuuccuuggcuucucgaugugcugggauuacaggcauaagccaccaugcccagcuuccuuauugguuuuguccagcaacuaaaacaagcccuuggcucauaagagguguucaauaaauauuuaugggaagaaugaguggagaaacucuucccagaaaaacaugcauauuaacaaaguauuguggccagaugcaguggcucacgccuguaaucccagcacuuugggaggccgaggcgagcggaucaccugaggucaggaguucgagaccagccugaccaacauggagaaacgccaucucuacuaaaaauacaaaauuagcugggcaugguggcacaugccuguaaucccagcuacuugggaaggcugaggcaggagaaucacuugaaccugggaggucgagguuguggugagccgagaucgcaccauuguacuccagccugggcaacaagagcaaaacuccaucucaaaaaaaaaaaguauugcauaguuuucacaggguucaugaacugcugucaaauucauucauaaacuuuagguuaagaacauuugguuuuugaaagucaaauuguaaacuuuguuacaugcuuauaauucguaauuucuauaagaccucuauggaaauggauguauccauuuaagugcugaggagagaguuuuccuguaagcccauaaaacuguaucuguaauagaaauauguuuaagguuagccucuuuuauuucuucuggacuguagguauuuucuacuaacaacuuuaauccagaaaaacaucuuuucauaaccacuugaaugccacauucuggcauauuagaaagagacucuggccgggcacaguggcucaugccuguaaucucagcacuuugggaggccaagaugggaggauugcuugagcccaggaguuugaaaccagccugcacaacauaaugaaaccccaucucuacaaaaauuaaaaauaaucuggguguggugguauaugccuguagucccagcuccuuaggaggcugaggugggaguaucacuugggcccucaaggucgaggcugcagugauugcacuaccacugcacuccauccugggcaacagaagacagaagacccugucucaaaaaaaagaaggcugggguauuaagauauauuuguaaccaguuuauuaauuaauuaugguuuuuuuuuuuucugaaauggaauuuuguucuuguugcccaggcuggagugcaauggcgugaucucggcucacugcaaccuccgccucccggguucaagcaauucuccugccucagccucccaaguagcugggauuacaggcaugcgccaccacguccggcuaauuuuguauuuuuaguagagacgggguuucuccauguuggucaggcugcucuugaacuccugaccucaggugaucuuccugcuuuggccucccaaagugcugggauuacaggugugagccacugcgccuggccuuuuaauuuacuuuuaagacaaggcauggcucugucacccagucuggagugcaguggcaugauaucggcucacuacaacguccauguccugggcucaagccguccucccaccucagccuccggaguagcuaggacuguaggcguggcuauuuuuuguauuuuucuagagacgagguuucaccauguugcccaggcugaucuugaccucauaagcucaagugauccucccaccucagccucccaacgugcugggaucacacgagugagccagcgcgcccaaccuuuaaccaauuucauaucuacauaguccauuuuguuucugucaggcuuucuaauuuucuuuugcaacaagaguucugcuuuguucuuccucuuagauugcauaugcauuuacucuaauaaauggugcaaagaaagcuuuccagcucuuuuuagugauguaacagaagagugggcaucuuggaaauuagcacuguuuugacuuauaugagagggaacugcugucuuaguaacuacuacauuaauaagacaaauguccaguuacuaguuacuacucagucuaguuuugaaauaacaagcuaaaucuaaaaaucucuuagaguuuggguuucagcaaacauuuaugaagcuccuguaauauucaaaccuccauauucugugauuucugcuauaugcuggucaaucugaaagauacgaagauauguaagagggcuuuaacccucaggugcuuccaaucaguuuguaauuauuuuccaacaauaaauaaauugaauuuauuucauuagauauuuugagaacuaagauauuaauaauuuuuuucuuuuuuuucccccugaaauuccugagcuucaacuaguuggucuguuuuuauaguaguuauguuagcuauaaaugaauaaauaaaaaucagccugccaguuuauguagauucuccccucgaggagguggagcuuaacuccuccaccacuuagggguggaugaugagcuuaaugacuuguuuccacagaguacaguguggaaggguggggagaaguacugcuuccuccaaccagguggagaauccuggcaagcacuaccucagccagggaucagguuaacaucaucaguugauaagucauguugauagucuguacucuugauaugcugugaugagcauggcccuugguauucuucccgaaaagccaucacuccagucuaaccaugagaaaaacaucugacaaauucaaauugagggacauucuguaaaauaucugaccagagucuuauuaaaacugucaagagaagucugagaagcugacaguccagaaaaggcuaaggagacaugaugacaaaaugugauaugguauccuggauaggaucuugggaagagaaaaggggcguuagggaaaaauuaaaggggaucaagaaagaaggacagagugagaccuuacuucucuaaaaaauaauaaauaguaaguaaaaauuaccuuuguaauauucuuuuuuauuagaauacgaugaacaucucuuagugucaauaaauucccaucuacaacccaguuguuaaugacuuauccuauuguuuggauauaugaaacuuaaacggucuaauuauuagaccuuuguuaaguuuccuuuaaaaaaaaaaaaaaaaccuauuuuaaggaauauugugaugaggccgggccugguggcucaugccuguaauccuagcacuuugggaggcuuaggcggacagaucuugaggucaggagcaacauggugaaaccccgucucuacuaaaaauagaaaaauuagccagacgugauggugcguaccuguaaucccagcuacucaggaggcugaggcaggagaaucacuugaaccugggagguggagguugcagugagccgagaucacaccacugcacuccagccugggcaacaaaacaagacucugucucaaaaggaaaaaaaaagaauauugugaugaagccaggugcgguggcucacgccuguaaucccagcacuucgggaggcuaagguaggaggauggcuugagcccaggaguucaagaccagcuuggauaacauaguggggcccugucacuauuuuuuuuuuuuuuuuuuuggagacggagucuugcucuguugcccacguuggaguacaguggugccaucuuggcucacugcaaccuccaccucccggguucaagcaauucuccugccucagccucccgaguagcugggauuacaggugccugccuccacacccagcuaauuuuuguauuuuuaguagagacaggguuucaccaugguuggccaggcuggucucgaacuccugaccucaggugauccacccuccuuggccucccaaagugcugggauuacaggcuugagccaccacaccuggccccuguugcuauuuucuuucuuucuuucuuucuuucuuuuuuuuuuuuuuuuuuuuugagauggagucuugcucugucgcccaggcuggagugcaguggcgugaucuuggcucacggcaaacuccgccucccggguucacgccauucuccugccucagccuccugaguagcugggacuacagacgccugccaccauacccgacuaauuuuuuguauuuuuaguagagaugggguuucaccauguuagccaagguggucuugaucuccugaccucgugaucuguccgccucggccucccaaagugcugggauuacaggcgugagccaucgcgcccggccccguugcuauuuuaagaaaauuuuaaaaauaagaauaucgugaugaauaaucuuauagccacauauuugcacugguuauuuauuggaauuagauuuucagcagguccacuuaugcuuuuuuuuuauuuuuauuuuuuuuugagauagagccucacucugucgcccaggcuggggugcagugguuccaucucagcucacugcaaccuccgugucccagauucaagcaauucuccugccucagccucccaagucaaguagcugggauaugugccaccacacccagcucauuauuauuauuauuauuauuuugagacgaaguuucacucuuaucccccaggcuggagugcaauggugcgauacuggcucacugcaaccucugccuccuggguucaagcaguucuccuaccuuggccucccgaguagcugggauuaugggcaccugccaccacgccuggcuaauuuuuguauuuuuaguagagacaggguuucacuauguuggccaggcuguucuugaacuccuucccucaggugaccugcccgccuuggccucccaaagugcuggcauuacaggcgagagccaccgcgcccggcccaccugugcuuuuucaaucccauaucuucuagcaauuuugugggcuuuguuccagaaaaaauuguuucuuuuuuauguauuuucagacuuuuuucuucauuggcuccuuucugucuuucuguaaauauacuugucauuuucauuucuaaaaaacuuucccucaacguugccucucccuauagcugcugcccaguuuuuaguucuucccuuuaucacccguauuucccauacuuuuuguuuucaguguuuuuuaaacuuaccuucacuccucagucuucagugucuguucccucccccucuaccacucucauuuuagucaucaaugcgaaauuaauuucugugacccuuuucauagucuuuuuuuuuuuuucuuuaaaacagugucucacucuugcccaggugccauggcucaaucucagcucacugccaccuccgcuuccugggcucaagugauccuuucagcucaguccccccaaguagcugggacuacaggagcaagccagcaugccugguuaauuuuuguauuuuuuuguagagaugggauuucaccauguugcccaggcuggucucaaacugcugaggucaagccauccaccugcuuuggccucccaaagugcugggauuacaggcaucagcuacugcgucugauuguuuuucauagucuuaauuuagccauucaauggcuuugacucuuaaccauucucuaaagcauucuccaaauggcaccauuuuuuccuuucuugacuucuuucuguuuucuucacuggucuuucuuucuugauccccuuuaaauacacauauuuuaaaauuucucuucaugccaucugguaagaucaaguggccaaucucagcauaccugggaaacuuaacaugaucuaagaucacugaggaaccauugacuccagauacugucuuguacaugaggcaaggcugggagagguuguuccgacugacugccagcaccugcucccgagcuccuaccacuggccccuuuaaauauugagauaccucaagauucuuuuguaaaacuucuguauuucuuccuggaugaagguauucacugcaguggugucaguucucacccaaauguuaauucccagauauuuaucuacagcauuuaccucucuccugagccugucccuauuacugcacugccuguucaacaguugccacuuauauaugccuuaggcaacuuuuuuauauugaaaguuaauaauauaagggauuccuggccgggcacaguggcucacgccuguaauccgaacacuuugggaggccaaggugggcgggucacuuuaggucaggaguuugagaccagccugccagcauggugaaaccccacuaaaaauacaaaaccccuacuaaaaauacaaaaauuagccgugugugguagcaugcaccuguaaucccagcuacucagcaggcugaggcaugagaaucacuugaaccugggaggcggagguugcagugagcugaaaucacaccacuguacuccagccugggcgggcgacagagcugagacuccuucucaaaaaaaaaaaaaagaauuccuucuguguucccaaccauggcauuucauuuagucccucagugaucuuuuacuucuccagucuuuaacauccaggcagauggucucaagaccugucuucucucuugucagcaguccucucauucccauccucacugccuuagugcgagcccuuaucucuugccaagauuaugcaguagcuuuucaguuccguccaugcucuacccugcugccagaguucuuucuaaaacacgugauauugucacacccuuacuuaaaaaccuucagugauuccuuauuacacaaaggauauaauccagauuacauggcauuuaaagccauuuggaaucuggccaauuguuccuucuccccagaaugccuuucccuuccuuguucaccucaugaacuuaaaucuuuaaaaccaagcuuaccaccucuucugaaacauucuuaauuuaccauaguggcugucucugcugcauucccacaacucauacaguuuuacuggugcauauuugauuuucagcuacuugugggcacuguauuaccaguacuaacacagguccuggacuucgcuacuuaaugaaaaugguuucauuaauggcauuugaggauuaagaucauucugggguucaguucccugugacacaaauacagaauaugaauacaaugugguuuuguaaguuagaaaccucauggaauauuguaccagccauuaccaguuaucuguguucugcaucugcauaacaauuugcauguugaaauuuuccauuaggagggagugguguuaggugaaggugaaaaggcaaacagcuggcaugcucauaggcucuucuuuggcauugggcuugaaguauuugguuuuucagguuuguugggauuuaaacgcaucauuggcagagauuuaauguugauaguaaaugcauguagaaauggauccaucuggaaacauagagauaggaaaacaugauucuuuuacuuuuuuuuuuuaagguaaggucucacucuguugcccaggcuggaguacaguggugugaucacgguucacugcagccucagcuuccuggccucaaauaauccucuuaccucagccuuccaaguagcugggacuauaggcucaugccaccacacccagcuaauuuuuuuuuuuuuuaauuuuuuguggagacaggaucucaccauguugcccaggcuggucuugagcuccugggcgcaagcgguccaccugccucagccucccaaaguguggggauuacaggcgugagccaccucaccugaccuguuucccugcccccauccuuuuuauuuuuuuuuuuuugagauggagucucacuuugucacccaggcuggagugcaguggcaugaucucagcucacugcaacugcccucuccuaggcucaaaugguccuuccaccucagccuccugagaaguaaaggauuaauugaaauguuauuuuuuauuugaucuucuucauuggucacuguguauccugauaagaauuuucaggccaggcuugguggcucacaccuguaaucccagcacuuugggaggcugaggcgugcggaucacgaggucaggacaucgagaccauccuggccaacauggugaaacccugucucuacugaaauacaaaaaauuagccaggugugguggugcgcgccuguagucccagcuacucgggaggcugaggcaggagaaucgcaugaacccaggaggcagagguugcagugauccgagauugcgccacugcccuccauccuggugacagagcgagacuccuucucaaaaaaaaaaaaaaagaauuuucagcuuuuagugcucauauauaauuuguuucuuacaguacuucucuuccaaauuuuuauacuuucuaaacccuugcuguuugaaguauugauaucauuuuguuguuucuguuuuuuuccugauaucaaauguacagcucuuuuccagaaugucauauaguuggacugggccaguauguugcccuuucauacugguuucuuucacagaccaauaagcauuuaagguuccuucaugucuuucugugucuugauagcucauucuagaauaucuuuuaacaucucaauuucuaaauuuaaucagcuaaaaagucccauauuuuauuuaaaucaucuacauaaaguauaaugaaacucaggguaugagccagagaguaaaauuucucucuauuugugaacaguucuacaggcuuuauagggagcaaagugccggaggcuccucaguuucuggggaggcuucaggaagcuuccaaucaugcagaagacacagggggcacaggcaugucacauggcaaaaacaggagcaagagagcuacccuugauuaaaguaucacuuagaccugggugugguggcucaugcuuguaaucgcagcacuuugggaggcugagugggaggacugcuugagcccaggaguucaagaccagccuaagcaacauggcgacaccugucuccagaaaaaaauaaaaaauuaucugggcguaguggugcacaccuguagucagugcuacucgggaggcugaggcaggaagaucacuugagcccaggaggucaaggaugcaguaagcugugaucaugucagugcacugggcagcagagugaaacuuugucucaaaaauaaauaaauaaggaaaggacaauuuuuuaauuuguaggaguagaugugguacuucauuuucauauaauuaaaaagcagcuuuauauuugaaacuaaauaguuuucaugaauuaguacuuauagcuauagcccuguccuuuaaagcaaucuucuagcuuaaauauauuucuaauauuugugaaaauauuuuuauaauugcaagauaaaagggaguuaauauguaaaguucaguauuuagggacaauuuuggaggguuuuguuuuucacauggcuuuuuuauucuuuuuucaucauuuuuauugaaaaagucauuuuauguucuuagugugugguuuuuuuguguuuuugguuuugguuuuuuuuguuuuuuuguuuuuuuguuuuuuuuuugagacagagucucgcccugucgcccaggcuggagugcaauggcgugaucucagcucacuguaaccucugccacccggguucaagugauucuccugccucagccuucggaguagcugggauuacaggcacgugccaccacgccuggcuaauuuuuuguaucuuuaguagagacagaguuucaccauguuggccaggcuggucuugaacuccugaccucaugauccaucugccuccaccucccaaagugcugggauuacaggcaugagccacugcgcccggccgucccuuuguuacuuaacaaaugggagcacacugcuuuuuaagcacacugcacuuuguuuuuguuuuuuuguuuuuuuguuuuuuuuuuugagacggagucuugcucuguugcccaggcuggagugcaauggcgugaucucggcucacugcaaacuccgccuccuggguucacgccauucuccugccucagcuuccugaguagcugggacuacaggugcccgccaccacgcccagcuaauuuuuuguauuuuuaguagagacgggguuucaccguguuagccaggauggucucaaccuccugaccucgugaucugccugccucggccucccaaagugcugggauuacaggugugagccacugcgccuggccugcacuuugcuuuuugaguuuaauucguagauggacuaugucuacguauacacuuagccuaccuuaucucagguucuacaucuguggauucaaccaauuguggaccaaaaauauuuuuuuaaaaaacaacaauaaaaaaaaacacaauuuuuaaaaacaauacaguguaacaacuauuuacauagcauuuacguuguauuaggugucuaaagaauacuuaaaguauaagggaugauguguguagguuauaugcaaauacuaugccauuuuauacacaggacuugagcaucuucagauuuugguggugggggguggugguuuuagaaccaaucccccucagauaccaagguauagcuguaccucauucuuuuucauggcagcaaguguuucauaguuugcauguaacuuuaaaaaaaaauaacuuuaggggccgugcuagucuucuguguaucccuccaguuuuaguauauguguugccaaagcaagugauagguguaacuuuagaguauuccuaauauuuauaaccagagcuuuuaugaauaucuucauacacauauuuuuuuucuuuuuuuuuuuuuugagacgucucacucugucucccaggcuggagugcaguggcgcgaucucggcucacugcaagcuccaccucccagguucacgccauucuccugccucagccucccgaguagcugggacuacaggcgcccgccaccacgccuggcuaauuuuuuguauuuuucauagagacgggguuucaccguguuagccaggauggucuugaucuccugaccucgugauccgccugccucagccucccaaagugcugggauuacaggcaugagccaccacgccuggcaacacauaucuuuguacauguaugcaaauauguccauaguauauauucuuagaaguguaacuguagaguuaguauugugcagggggacugggaggagaauaugugcauuuuaaauuuugauacauguugcugaauuagaggaguauaauuuuauuuaauuaauuaauuuauuuuuuuuuugagaaggagucucacucuauugcccaggcuggagugcaguggcacaaucuuggcucacugcaaacucugccuccuggguucaagugauucuccugccucagcuucuugaguagcugggauuacaggcgugcacugccacgccuggcuaauuuuuguauuuuuaguagagacgggguuucaccauguuggccaggcugguuucgaacuccugaccucaggugauccaccugccucagcuucccaaagugcugguauuacagaugugagccaccaugcccagccuagaggaguauaauuuuagaagauagauuucucauguaguccugucuuccccauggauuaauugugauuuuuaaaaaaauauuuagggucaacuuugcauauuugccaauuagauauuuucaaaugcuuauauuagugacuuaccuccucaaaaugcauccaggaaugguuaaaagcaaauauuaauuaguauucagauacuuauuuuccccuucccacacagaguagcagagcagcagcaucuguucuugagguugugcuuaauguaaaaugcuagggguuccucuuuucuuuuuuugaaggugagaauguuugacuaaaaaaaaaaaaaugaauggauuaacuuuuagaaaugcaucuugaaaauaaaauaagguuuugcuaccaggugagugaaaacaauaauuggaaauaaagauuugaguuuuccuccuuguuaaacccaaugaaauuaugaugcuuggcucuuccuccccaucaaaaagaaaguuaaaguuaaaauuccugugugagguugucauauucucaugcuguauauuuucuuucagauuccuuuguuucuuccucuuccucucagccuguaucucuauuuucgaccucacaaggcaagucuguaauuuuuuugugugcauugguaaaagaaaaauguugagaaagaggcuguaacuggggauacgaggcacaagucuucuauugccccaaauccccuaaaauaaaaacuaauuacaagcugauucuuucuauuuagcaguuuccaguggguuucguguaaugguuaauaaaguaaaaugaggcuggguggacccuguaacauagcauaaacuucaggaguaguuuugaguauuucuuuaaaauuaaaaacuugcccaccagaauuuggagcagauagaauuguggcucagaggccaggugcaguugcucacaccuguaaucucagcacuuugggaggcaaaggcgggcagaucacuugaacucaugaguuugagaccagucugggcaacauggugaaacccugugucuacagaaaauauccgggcauagguggugcaugccuguagucccagcuacucaggaggcugaggugggaggauugcuugagcccaggggcuggagguugcagugagcgaugaucgugccacugcacuccccgcugggugagagagcaagacccugugucaccaucaccaccaacagcaacaaaauuguggcucaggaaacacccaaccccuagaaugcauuuaauauauuguuuuggagcuaugaaacugguuuacagagguagcagauuggaaaaacaguauaaaagugugcuuccacugaacuagaaaaauaccagccuagcuaggguauuuuaaugugaauuuaucugagacacgucauaaaagcuaggcuaguuccaaauugccuacaaacauugaacaagucaguuaugugacuuuuggcaagcaaggcuucuuguccuagagauugaguuguggcuuuguuuuguuuuguuuuguuuuuaaucugucagucuguagggaagggaaucaguuuguggaggcaacauugccaagaagcugaaagagaggguacuaugugcuucaucaauuuauacuaauaauaaaguauuauuucauucgugcuguuuuuacuagacccaaauauaugucaauugagaaccuuuauuuuaaaagaggaaaaaguaauuaaaaucacuagacagauugauagauuuaagaagucuugugcaaacaguuuguuguuacagguggaguucucuagcugcaaaagacuuuuauaagaauaaaaacauaaugggauuuaaaaaaauuaguaaaacuuuugccugguuaaaucugcuucuuaggaaacaugguagggaauuuuuuuuuuaauuuguuguuguuguuguuuugagauagggucucacucugucacccuggcugaagggcaauggcacuucauugaauucauaguucacugcagccucaaucuccuggguucaagcgauccccccaccucagcuuucugaguagcugggacuacaggcacaugccaccaugcccugcuaauuuuuuaauuuuuauuucguagagacauuuugcuauguugcccaggcuggucucgaacuccucagccagucuggcucagccaguccuuccaccuuagccauccacagugcugggauuauaagcaugagccaccaccacaccuggccaacaauuuguuuuaauuuaaacugaugacauuagaacccccaauuccuuuauaaugugucucauugugugaauuuggguaucuugugggccaaauaaugaccucugaaauuaacauguuuacauuaaaagauagaaauuuuguuaauguuagaaaguaacucaaacguaugaaguaguuauauuguucuugacauuuggaacuugacaauauuuuuauuuuuaaggauuuuuuuuucucaugagaaaauaauuuaagcaaauagguauuaaauuauucuacuguggaagaaaaauaugguauaaauagaacaaauaauuauuuccucucuuguaaguauuucagaucuuuaagaauacguucuaaccuuaagucacuauuuuuuuucuuuucuuuuuucuuuuuuuuuuuuugagauggagucuuacucugucacccaggcuggagugcauuggugugaucucagcucagugcaaccuccacccaagaaucgcucaagcaguucucucgccucagccuccugaguagcugggauuacaggcgugcaccaccacgcccagcuaauuuuugcauuuuuaguagaaacgggguuucaccauguugaccaggcuggacucaaacuccuaaacucaagugauucgccugccuuggccucccaaagugcuggcauuacaggcaugagucacgucgccaggccaagucacuuuuuucauauagaaaagggauaguugauacucuaaacgguguaacgguguaacccauggcuuacauaccuaauguauaacguugaaaagauaacugucauagcuuuaaaaauuauuuuaaucccugguuaacaacacuuacauguacacucaaguagaagggagguaaauaaaaaugauuuaaauuaaaaaugaauguuuuaauaggcuucaguuucacaguguguauuagaauuugcaagacagcauacacuuauucuuccuuuuugccuacaaaaaaaauuuuuugaccaauguagauugagaauagucuuauuguagaaagguaauuaagaaugcccuauccgacugugcgcgguggcucacaccuguaauccuagcacuuuaggaggcugaggcaggcggaucaccugacgucaggaguucgagaccagccuagccaacauggcaaaaucccgucucuacuaaaaauacaaaaauuagccaggugugguggcaggcaccuguaaucccagcuacucgggaggcugaggcaggagaaucacuugaacccgggggacagagguugcagugagccgagaucacgcuauucauugcacuccagcuugggcgaaagagcaaaacuccgucucaaaaacaaaacaaaagaaugcccuauccucgaauggguuucauuuaaccuauauuaguagcauuuucuccugcaacaaacaaauaaacaaaacacaugauggaaaaguagcccaguggggcccuacgucauuggcagucuagagguuagccuguucaguuguuugaaggaacaccuuggcagaugauuaguuguuuucuaggguagccaagacugguagcuuccagucugccuuaguaaaaauaagggaagaggaagcuguugauacauaguugguuaacuguauuaaaacccugaauggagaugagggcucugggaacaguccacuuccacacaggccuuugaaagugacugcugccaccugcaugcacuuugaguccgucacugacacuaacccaacuaauuucuuuggcuucauauaccuuagcuaucuagccuuagggaaauugugucuauuuuuauauaccccaaucauauuaagcaauauguaguaauaauaggacuuaaaaaaaaaauagagacaaggucucacuagauugcccaggcugaacuccugagcacaagcgguccuccuaccuuggcuucccaaagugcugggauuacaggcaugagccaccauaccuggccuaaauaggacauguuaagauuuaagugacuuuuuuuuuauccugaaauacauauuuaucauuauuggguuucagguagaugcauguauaaaaaaugucauugauucagacugaguuaaaggcaguuaaaguuuuuaaaaguaaauuuugugauauuuacuaaguuguacugcuuugagaauacagcuacauaagcuaggaaguuaaacuucugauaugaauagauuucuaguuagaaugucaguggaauaaucaguuccuucuucaauaaguuguaccccugaguaguccuuguccuugcagucuuuugcuuaugguuuccuuuuuccaucaagcaacaauuauauuucagccuaaucccugagaguuucaaaauaguggauuacauuuuaaugauguuuuccuguacuucauaaaacauacaaagauauugacagaaguauagauguaguauguggcuaauuuuuauugaacuuuuacuaugcccaguaaacuucacaugaaucaucucauuuaaucuucauaagcaguucuaugaagggaagggacuagcucuuuuaccaauugaaaugacuugaaaauggugaaaucacuugcucaagguaacacagcaaguaagugauagagggaggaugccaaagccguggucauaacugcuguaccuauaauaaagaugaucaaauaaacuagcuguauuuuaggguuuagacuucuuuuuagagauggcauuuugaaguuaauauuaaaaucaugacagcagaagaggcagauaccauuguuuugaccauauuaucacuauuagugauauaauuuaguaucaucugggguauaugcucccuccaacaaaaucaaaaucaaacugaaauuuuguuuuacuuuucaaaacccuugagaguggaagcuagaaaauacuguuucuuuagaaaacauuggaagaaaaguaggugaaaaugagauuggaaagaggauccauccaccaugccgcauuggaagcauugcauuaaugaaugcuugcauucaauuugacuaaugcaguaggcaucuggaauaggaaguuacaacccugaacuuugggggcaagcauugaggaaaaaauaaauuugccaguuacagccuuuuuuuaaaaaaaaaaaaagaaaaacauuuuucuuuguacaaaagagacguuuuguuuaggaucuagcuuggcugcagaaugucugcuggcuaacuuccuauuuugaugcuguggcugcaaguuguugauacuguuuugcacgaauuugucuuguuuugugaacaugagaaaauucaaguguaggaaaaccuauaccugaauauuucaaaccucccucaaaugaauaugcauaguauggauaugaaaaaguaaguuaguggcuacuacaggcuggcacccauucuucacugauguauauaguuauuccauguuauagauauccuuuuaguaaaaaguaaugaauuucuuaggugagcagguaauuaaucacaugguaacuauaaccuaguuuuaaacuauuuacucuuuuuaggaagaacucuuugauauaggauauaacauuccuuauuccuuaauuauagaucacauuuuguuuuuaguaauuaaguuauacguacuugaauagaugaguacuaaaucuuuaucuaagagacacuuuggggaaaaagaagcagaauaaacaguauaugaaggguuuucaauucaaauguauuuacucauaaguauuuuuuguugguuguuucuuuguuuuuuaagagauguggucucacuguguuucccaggaugaucucaaacuccuggacucaagcaaucuucccgccucagccuccugaguagcugggacuacaggcgggcaccacugugcccagucuuagacauuguaguuuuuuuguuuuuuuuuuuaucauguuacuuuaaacuccccaucuugcucugaaagauaaaauacucuaggcauaaaagagagaaauuucuuccucaauucccauaccagauuuucuagucagauguguuuuuuuccuuauuccaauaaaaaugcagaauuacuguacuuuagaauuaguauauggaaguguuuaaaguaggcacgggaagaccgcuccugcuguaugccuugguacucuuaaguugugcaagcccaucuaugugaggagaagccgugacaguggcuccuccugugggauuuuuaugggacuagagcucugaaguauggcccuuaucuuucugcucuccaacacauaccaaauguauuaaggcugugguucugaaaccaguuucguugccugggaaacuuguaauacagauuccugagcucuguccuccuuaggaaguucugaggcaguaaaucagagauaaagcccaugaagaacuaguaguugcucuuaaguuugagagggauugugaaaaauugugccaaaggcugucuuugugcucgguuauuaaauuguucagcugguuguacauugaacuaaaauaugcuuugacccugcuggugguaaagaucauuugugaaacauuuuguugaggaaaauuuacuggcugggugugguggcucacaucuguaaucccagcacuugugggaggccgaggcggguggaucacuugaggucgggaauuugagacaagccuggcugacauggcaaaaccccaucuccgcuaaaaauacaaaaauuagcuggguaugguggugcacgcuucuagucccagcuacucaggaggcuggggcaugagaaucacuugaaccggggagguggagguugcagugagcugacaucaggccacugcacuccagccuggucgacagagugagacugagacugucucaaaaaaaaaggaaaaguuauuuaucuuucaguguuggcuuagaauuucuuauauguuaaguucucuugugggguuuuugguuuuguuuuuuggguuuuuuauuuuuuuuuuguuauuuuuuuuugagacagggucucacucuguugcccaggcuggagugcagugggucaauuagggcucacugcagccucaacuuuccaggcucaagcaauccucccaccuuagcuuccugaguagcuggaaccacaggcgugugccaccacaccaagcuaauuuaaaacaaaaaauuuuauuuuugagacggaguuuucguucuuguugcccaggcuggaaugcaauggcgcgaucucagcucaccacaaccucugccucccagguucaagugauucuccugccucagccuccugaguagcuggaauuacaggcaugcaccacuacucccagcuaguuuuguauuuuuaguagagacaggguuucuccauguuggucaggcuggucucgagaucccaaccucaggugauccaccugccucagcaucccaaagugcugggauuacaggcgugagccaccgcgcugggcccuacaauuuuuuauagagaagggaucugucucauuauuuugcccaggcucgucuaacuccugggcucaagcaauccucccaccugggccucccagaguguugacauuacaggcaugagccacuaugccaggcugggcucucaagcaucuuuaucugcauagaaccuagcacaauucuuaggaugccauaggcauuugguuuguaccaacguauucagacguugcaucaccuaagauuuugaaguagauaaaagcucuuugaauuaucuuccuuaauaugugaaugguaggagggaaagugucuaaagcucuacaugaggauuuucuguauuauauaccagaugaaggugguuacaguuugccaauaugccuuuucucucccuaguaaaaaggcauguggucuggagucucuaugucaagagaguuuuuugagaaugugguguuuggggacauuuauuggggauuuacuaaguggcagcuacuacugugaacauguauuaacucauuuaauccucacagcaguucuaaaguuaggugcuuuaauuuucccauuuugaugagauuggauuaagcaguuuacucaaggccacacgauuaguaauugugauuaaaggacuuugauuuuuuuuuuuuuuuuuuuugagauggagucucacauuguugccugggcuagagugcaguggugugaucuuggcucaccgcaauuuccaccuccuggguucaagcgauucuccugccucagucucccgaguagcugggauuauaggcaugcgccaccacacucggcuaauuuuuuuguauuuuuaguagagaugggguucuccauguugauccggcuggucuugaacuccugaccucgugaucaggaccagcucggcccccaaagugcugggauuacaggcgugagccaccgugccuggccgacuucgaauuuuuuaauaagaauuuuuuggccgggcgcaauggcucacacuuguaaucccagcacuuggagaggccgaggcaggcgaaucaccugagguugggaguuccagaccagccuaaccaacguggagaaacuccgucucuacuaaaaauacaaaauuagcuaggccugguggcgcaugccuguaaucccagcuacuccggaggcugaggcaggagaaucgcuugaacccaggaggcagagguugcggugagccaaggucacaccauugcacuccagccugggcaaaaagagugaaauuccaucucucaaaaauauaaaagaauuuuuuauuugggucuaaaaauuuagaauuuagaauaugacuaccaacuuaauuucuuagucuuuguuucagauaauauaucucaguggaguauuuagaguuuaagaagaugaguaaucauggagcugaguacuugauaaguuugagaacauguucaugaucauuguggggauaugacauuuuuuaccucuuaccauauaucgauucucacccaccccccauuuuuugaaacaaggucuugcuuugucacccaggguggagugcauggcucacugcagccucgaccuccugggcucaagcaguccucccacuucagccucccaaguagucaggaccacagguguaugccaccaugacuggcuaauuguuuaauuuuuuuguagagauggggucgcacuguguugcccaggcuggucucgaacuccugggcucaagcugucucccugccuuggcuucucaaagugcuaggauuacaggcaugagccaccacacucagcugauucccuuuuuaguaaaucuacuagaucuaugacuuuauuuguuaauaauuagaguagcaccauguuuuuaagugauuagaacucuugaaaaugaauauccacacuaaauuccauuauagcaaagaacuaauuuagaaaauguucauaaugagaguuuugauggcgauuuguuuugaguaguguugaaaggcucuuagagugcaugugaagggaugaaucuuuugagaaaagaaagauaguagacauuuucugagacauaaaauaauccagauuuauuccaccagacagcuuuacaguguauaguauuuuaagagcuaacugccuucagauucacuggacuuuucuguccuuuugccagguacugacuugggcaacagcagugacuacaagugccauacugaccaauuggaagagucuuugcuuaucggagcuguucuaaaaggcuuauuaguuuuuggucuucauucuauuuaauguuuucaugccuuuauaaacuuuuuacuuccagcccaauuuuucccauugucuugguacaggucagcuguguccaaguuuguuaggguuucagcuagccaaaaaugguauuuucauuugcugaaauucuaaacaaaauaauuaaaguuaaagcacagaugaugaugcuaccuuauuuuucuacaugugggaaagcuugauugauaguaaugauuagcgccugcaucucacaaucacugagaaaugaaugcagcacugagcucuguuugcccucuaagcuuguccccagaaaaaacaagauauacccuaaauaguaaguuauaauauuuuuauuagggaacauuauuagaguuuuuuuuuaauauaucucguagccaugucauauuaaucuuuuuucuuuuuuccuuuuuuucauuuuucucuuuucucuucucuucucuucucuuuucucuuucucacucugucacccaagcuggagugcaguggcaugaccauggcucacugcagccuugaccucccagacucaagcaauccucccacuccagccucccaagugacugggacuacaggcacgugccaccaugcacggcuaauuuuucuauuuuuuguaggggcaggaucucagcauguugcccaggcugaucuugaccucuuggacucaagcaauuuucccuccugugccucccaaaguucuaagauacaggcaugagccaccacacccagccuagagaauccuuaauguuugaagucugucaggcuaucauggugcucagcagaggauguguuaguauucugagaauaggacuucuaacuuuaguuuuaccugagauuauucuacaccuaacuugaaacuuuuggaguauuaaagguucaaagaaguuaagagaaaagcaaagcuugauaaacugaccaguuuguguccugcuaaagcauagacaguuuuaccaugcucuucccagugacaugaauauucuuugguuagcauucaauuugguugcuuucuuuuuuguuuaaucaggcacugucaccacuguauuauugucaucauuuugcuuauugauuuugcuuauugucugccuuccccucuguguuguaagcuccauaaaggcaagaaauuuuuucuguuuuauucacugcuuuaagcccaguuucuaaaacagugucugacacgugguaggcacucaauaaauaccuguugaauuauuacuaauucauuuuguagacuuucaucuguaagaugacagaucugaaucaucugaaaucuccaucuccauaaaacauauaagcuggcugggugcaguggcucaugccuguaauccuaguacuuugugaggcugaggcgagcagauugcuugagcucaggaguucgagaccagccugcgcaacguggugaaaccagcucucuacuaaaaauacaaaaaauuagccaggugcgguggugcacgccuguaaucccagcuacuucggaggcugagucaggaaaaucgcuucaaucuggggggcggagguugcagugagccgagauugcaccacugcacuccagccugggcaacagaacuagacucugucuaaaaaaaacacacaaaaaacacacaaaaaaacauauaagcugaaccuccccugugggguggagucaguuugacucaccucagaguuguuugaagagagagguucccaaacaguuuuaccauaaccuuaguucacugaauguuuugugguagaaacacugacuaguaaguucaguaacaaugcauggcucagauuguggaauauuucugauuuaaauguaaucuguaguacuucacacuucagauuuuugaaccuuuuaaccuacaauacugggcuucauuucuguuaugcccuaaucuagucaugcugaauauccauacuguauaaugguagaugcaaaccauguuuacuaaauuagaacuacauaugaauuacaguuuacuucaaguguuuuguuuugguaauauagcuuugccaccaagcuuuuacaguuuuccuugaauguacaaagacuuuuuauucuaauaaccagauuacaguuauacuauuucuaaagcucagcucuuauuacaucaaguuucagugauguguugaaguaggggaacuuuauauggcauuucaaaacauuuucauaauacuggaauuuuauuuauuguaaaauauuuuugucuuuaauaaaauaauuuugaaugaagucauaauuuugcuuuuaucugguauuuggauguuuacaugaaaaagggaacauaagcugaauaaagguaaucccaaaagaacuucucugucacauuuucccaguuacucauucaugcucaaggcauugcuguccugagccuacuuaggucucagcugaccaagcugaaucuuugauucacuuauuuggggcuauuuauuuaagacccacuuugucccagcuccaaagauacaacaguaugcaagaaagacagcgcccagggugggcgugguggcucaugccuauaaucccagcacuucaggaggccgaggugggcagguugcuugagcccaguaguuugagaccaaccuggcaauguagugaggcaccaggucuguagaaaguuuaaaaaucaggccaggcgcgguggcucaugcguguauucccagcucuuugggaggccgaggcaggcggaucacggggucaggagaucgagaccauucuggcuaacacggugaaaccccgucucuacuaaaaauacaaaaauaaaauuagccaggcguggcggcgggugccuguagucccaacugcuugggagacugaggcaggagaauggcgcgaacccgggaggcggagcuugcagugagcagagaucgcgccacuacacuccagccugggcgacagagcaagacuccgucucaaaaaaaaaacaaaaaaaaaaaaaaaagaaaagaaaguuuaaaaauuagccaggugugguggcaugugccuguggucccagcuacuugggaggcugaggugggaggauagcuugaggccaggaggucaaggcugcagugagccacaauuguaccacuggcacuccagccuggaggacagagggagacccucucucaaauacaaacaaacaaauaaaugaaguaagaaagcaccagcccuugggauauuuguuuugauccuuuuccccaguaaaaauuuguuagagugggaaguuagaaaacagugugguagauugauggcuacuaugguauuaacugauaagacuuaacguauuacuuugagaaggauauuuucuauuuuaaaaguaauucuggaguuaacucugucuuuuuuuuuuuuuuuuuuuuuuuuuuugagacaguuucacucuuguugcccaggcuggggugcgauggcgugaccucagcucacugccaucaaugucugccuccuggguucaaaggauucuccugccucagccucccgaguagcuggaauuacaggugccugccaccacgcccggcuaauuuuuuuguaucuuuaguagagaugagguuucaccauuuuggucaggcuggucucgaacuccugaccucaggugagccacugcacccagccaaguuaacucugucuuaaccaaagaaaucaauuugcacaguacaauauugauuuaaaugacaaguuaguacaagagauuuuggaggggccaggcguagcggcucacaccuguaaucccagcacuuugggaggccaaggcggguggaucacuugaggucaggaguuaagagaccagccuggccaacauggugaaaccccaucucuucuaaaaauacaaaaauuagcugggcuugauggugccugccuguaaucccagcuacuugagaggcugaggcaggagaauggcuugaaccugggagguggagguugcagugagcugagauugcgccauugcacuucagccugggcaacaagaaaaagacuccguaucaaaaaaaaaaaaaaaagauuuuggaggggguccaccuuuuucaguacccuuuaguuuagaacaucacagcuauuuauuuguacaugggacagauucucccuguggauagaauagaauaauucuagucucauuuuucagauucaggaagggcccauugcaucuccuaaaaaucaaaaaagucuggccacuaguuuuuuuccuuuucagauugugagacuaacagauuuauagaggcagucugugcucugaauuguucagcuuacagauugaagucuaucaacccuuuauaguaucagguuauuuguuuuguauaaauuauuuugcuuuuguugauuagcucuaucaaagaauaaaaaaccucccaagauuucucaaucuuaccgcccuucuuuaugcuuucucuguacaauggaaaaguagaccaaaaguauuugucaugaaaauuuuuuaucauuugcaguuuguggcaugauauggcuuuucuguuucacuguuggcaguuuuaugcauguccuguaggauaacuugaucguuuuguuacauauuuauguguguauauauacauccuguguguguauauauauauuuauguaauuuaaaaaauaaaaagcaugcugcuuggcuuggcuagcuaauguguaauuguaccugguaaacaauuuuuuucuuugaaauucugaucauagagggauugagcucucuuugcucugaugagccaucuucagaaauuaugacuucuuccuuucuuucaucuucugaaauacauaacacuggccuuacaauacuacauggagaaaaaagccauguguuagggagccagccuauuuuagccaaagaaggaaaagaccacuuggaucuucuagauaugaaaaagauggaaaagccucaggggaccagcaacaacguaucagacucuucaguuucucuugcagcaggaguucauugugaccguccuucuauuccagccaguuucccagagcauccugcuuuucucucaaagaaaauuggucaaguggaagagcaaauagauaaagagaccaagaacccaaaugggguaucaaguagggaggcuaaaacugcauuggaugcugaugacagauucacuuugcugacagcccagaaaccaccuacugaguacucuaagguagaaggcauuuauacauauucuuugucuccauccaaaguuucaggagaugauguuauugaaaaggauuccccugaaucaccauuugaaguaauuauugacaaagcagcauuugacaaagaauuuaaagacucauauaaggagagcacagaugauuuugguagcuggucugugcacacugauaaagaaucauccgaagacauuucagagacuaaugacaagcuuuuuccacugagaaauaaagaggcaggacguuacccaaugucugcauugcucaguaggcaguuuucacacacaaaugcagcacuggaagagguguccagaugcgugaaugauaugcauaacuuuacuaacgaaauacugacuugggaucugguuccccaagugaaacaacagaccgauaaaucuucugacugcaucacaaaaacuacaggacuugacaugagugaauauaauucagaaauuccaguuguaaaucuuaaaacuagcacucaucagaaaacuccuguauguucuauugaugggagcacucccaucacuaaaucaacaggugauugggcagaagcaucucuccagcaagaaaaugcuauuacuggaaaaccuguaccugacucuuugaauuccacaaaagaauucaguaucaaaggugugcaaggcaauaugcagaaacaggaugacacacuugcagaauuaccuggaucuccaccugagaaaugugacucuuuggguucuggaguggccacagugaaagugguuuuaccugaugaccaccugaaagaugaaauggacuggcagagcucugcauugggagaaaucacagaagcugauaguucuggugagucugaugacacaguaauagaggacaucacagcagauacaucauuugaaaauaacaaaauucaggcugaaaaaccuguuuccauuccaagugcuguuguaaaaacaggugaaagagaaaucaaagagauucccaguugugagagagaagaaaaaacaucuaaaaacuuugaagaauuggucagugacucugagcugcaucaagaucagccugauauucuuggaaggaguccagcuagugaggcagcauguucaaaaguacccgauacgaaugucuccuuagaagaugugagugaaguugcuccugaaaagccuauuacuacugagaaccccaaacuuccuucaacagugucuccaaauguuuuuaaugagacagaauucucauuaaaugugacaacaucugccuauuuggagucauuacaugggaaaaauguuaaacauauagaugauuccuccccagaggaccugauagcagccuuuacagaaaccagagauaaaggaauaguagauagugaaagaaaugcuuuuaaagcaauaucagagaagaugacagacuuuaaaacaacuccuccuguagaagucuuacaugaaaaugaguccggugguucugaaauuaaagacauuggaagcaaauacagugaacaaagcaaagaaacaaauggaagugagccucuagguguuuucccuacccaagguacuccaguagcaucucuugacuuagaacaagaacagcucacaauuaaggcucuuaaagaauuaggugaaagacagguugagaagucaacuucugcacagcgugacgcagaauugccuucugaagaaguacugaagcaaacuuucacauuugcuccagaaucuuggccacagagaucauaugacauccuagaacguaaugucaagaauggaucugaucuugggauuucccagaagcccaucacuaucagagaaacuacuaggguagaugcuguuuccagccuuagcaagacugaauugguaaaaaagcauguccuagcaagacuucugacagacuucucagguaaccauuuauauuagaauacugcaugugguuaauucugugauugauuacuuaucagcgugccauuuauguuagucugauuuauaccuacaaaauuauggcuaaaauacaaaaacaauaugcuguaugaugggaaaggcagauucuucuccugucuuuuuuuaaaugauugcuugauuugguuuccuuaauaucaauauuucccaaagcaguagaccacuuuguaacauuaaucuuccccuaaauauuuuuucuaugcucgcuggguacgguggcucacgccuauaaucccagcacuuugggaggccgagacgggcggaucacaaggucaggagauugagaccauccuggcuaacacggugaaaccccgucucuacuaaaaauacagaaaaauuagcuggacgugguggcgggcgccuguagucccagcugcuugggaggcugaggcaggagaauggcguaaacccgggaggcagagcuugcagugagaugagaucgcgccaguacacuccagccugggugacagagcaagacucugucucaaaaaaaaaaaaaaaaagaaaauuuuuuuucuaugcuccaguuauauuucaagguacuucuuuucuuauagguugccccuaaggugauauuaggugagaaucuaauaucaucagguucuuacuuauuuacaaagcuuguuuuuaaaucuccauaauugucauacuuuuuagcacuuggauuuuuugauaugugcuuuguggaaucuuagcaaucaaagauaaaggaauuccugcugggaaagauaguaaaugaaacuuuuaauuaaugugaucguauacuauagagauuuuaugcucugaaaguagguaaccaguauuguaguacuauuuugugaguaaugcuuaggagaacucaugcauucuucuacuuucuaucuuauuuaauauucuucaggccaaaacucauuauuagaugguaccagaaaccccuucucuugucuuuuaucuauuucaaaugaucacuuuucuagcaaguggcuuucaguuagauuacugcaaaugcugucuauucugggaucuuggaaaguacaagaaaaaaaaaggaucuuucaagccccucuacaagggacccccauccuuuaauguaauaccaaguuuuacaucuacuguauggucaguguuaggugcuauguagaggucugugguuuuuaaacuauuugauuauagaucuuuuaucaaaugaaaucauacacagaguuguaguauuuacaagaaaauuagauuuuuguuaggcuaaauguauuuuguguuugauuuugugccuuuuuauaaaggcauuuucuuacuggaaacuguagguagauuuaucuuuuuaaguuuuaauauuuaaaauagauaaauuguacuuaaccuuacaaugguauugugaggauuaaauaugaaaaugcagguaauacagugccuagcacauaguaaauaugcagucagauuuagcaccaaauacagggccugccacauaaguaguacuggauaauuauuuguugaaugaaugauaugaauuauuucacuaacaauuaucagugaaagacauugaggcuuuuugauaaaccaaaaauuuugaauuaccaauuaaggauagcucuuauacucuagcauuugaagcucacugaauuuggauuaaagaguacuagguucuaauucuugcugugcugugucuagaaguaugacuuugaacaaguaacuuacauaaccuuucgggggccucaguuuuaauaucuguaaagugaggauguaaagugaaguagauggucuucaauuaucauuuaaauaauaugauucucuggcucugguacauucuagauuucuuccucaguugucauaauucuuacagguaguaacuuuugggcaauaaggcauauaggaauuaugcuacaagaacuccagugucuaauucuggcaaauuccuguuuuagcaugaccuuagaugacuagucuaauugguucagcaucuuccuuuguuaaugugaugaucauuauuuugcccugcuuuguauguugcaguaaauaaagugcuguguaaaugcuaauuauuagugauuaucaacugaauuauuuaaucuagcgugagagauguaaagggcuauggaaguucaggauauuugucacugaccaaagucuaugauuaguguauguuuuuagauuguaauuaaagaagaccgguauaguuagaccaagaaguuuaaaggccuuucuugcagcuuucaaaagugaaaaccuuuuaaaauugucuuauuuaugaauaaaucuuuaaaaauauaauccauuucauugcagugaaauaaauaaauaaaaacauaaaccauuucaguaaaaugcaucagugucuaguuuuauuuauuuaucuuuuuuuuuuuuuuuuuaauuuuuugagacagagucucacucuguugcccaggcuggagugcaguggcgcgaucucggcucacugcaaccuccaccuccaggguucaagcgacucuccugccucagccuuccgaguagcugggauuacaggcgugugccaccacgcccagcuaauuuuuuguauuuuuacuagagaugggguuucaccauguuggccaggcuggucucucaaacuccuggcuucaagugauccgccugcguuggccucucaaagugcugggauuuacaggccugagccaccacacacagccgauugucuaguuuuaaauacguguaucugcauauucuuccuuucuaagguaaaaacagugcuuuaauuauauucugccuuaaguuguuugggaaaauaggcaaaagaaacaaugaaagaauuagugguuuucuguuuguuuuugcuauuuuaugguauauuauguaacagcuuguaaugaagccuuuaucauauuauaguugguugcugaguaauuaaguuaugauagacucucauaguuuggggaagaaaaucagaucccugccucucacauaccuaguguagugaagauaguuuuuuguguuuuaguauccagauuggcaggaugcaaggaaauaagcauauaguuuggugaaguacauguaaauuguuacagccuuucuggaaggcaguuggcaauauguaacagaccuagaacugcccuagcaaucuuguuuuuaggaauucuuuuuuuuuuuuuuuuuuuuuuuuuuugagacagagucucgcucugucgcccaggcuggagugcaguggcgcaaucucggcucacugcaagcucugccucccggguucacgccauucuccugccucagccucccgaguagcugggauuacgggcgccugcuaccacgcccggcuaauuuuuuguauuuuuuaguacagacgggguuucaccauguuagccaggauggccucaaucuccugaccuggugaucugcccaccucggccucccaaagugcugggauuacaggcgugagccacccgugcccggcccuuuuuuuuuuuuuuuuuuuuuuuuaaagacagagucucaccguguugcccaggcuggagugcaauggcacgaucucgggucacugcaaccuccaccucccggguucaagcgauucuccugccucagccucccaaguagcugggauuacaggugccugccaccacgcccggcuaauuuuuuguauuauuaguaaagacggaguuucacuauauuggccaggcuggucucgaacuccugaccucgugauccgcccgccuuggcuucccaaaauacugagauuacaggcgugagccacggaacccagcuggaauuuauccuuuuuuaaaaaugugcaaaaauaacuacacagauguucauuauagcacaguuuaugauaguggcagauaucucggugucuuaacaauuagagauugguugaguauauuaugguauaacugugcaaucgaauauuacacagucauugaaguuguuaaaguuuuguuuuuuuuuuuuuuaagaaauggaaaaauauagaaaaguacaaaggcagccuacacccauaucuucucuauauguagaauuaacuuauguuaauuguuagcauugguagucauauuugcuuccaaacuaaaggacucuuugauuaccaccuggccacgcccuccaucuccccuuccccagacguaacaccgucauggaccugguacauccuuccaguuuauuuuaaauaaauguguuuguauuguuuuaugcuuuuuaaccauucauucauguuaucauguuuguuguauaacguuuuccauucaacauuagguuuuuaaacuucuuucauguuggaauuuauauaauuuauucauuuuaacagcuauguaguaauccauuauaugaauauauuauuuucuuuugguaaggauuuagauucuuuccuauuuuuugcuauuauagacagcgcugaaguuaacauucuucuuuuuuuuuuuccuuuuucuuuuucuuuuuugagauggaggaguuucacucugucgcccaggcuggagugcaguggugcaaucuccgcucacugcaagcuccgccucccggguucaugccauucucccgccucagccuccugaguagcugggacuacaggcgccugcuaccacgcccagcuaauuuuauuuuuguauuuuuaguagagucgggguuucacuguguuagccaggauggucucaaucuccuggccucgugauccgcccgccucggccucccaaagugcuggaauuacaggcaugagccaccgcgcccggccuuaaguuaacguuguuauacuugucuguuuuuacacauaugugacuauuuccccagcguuagggugcuacugcuuaucaguuucacuucuagcucugugccuuauuuuucuaguuacugucaaaguuagugucuucuguuauguaaaaauguucguaauuuauuaguaaaaacuacauuguucagcacccagcagauggugggugcuaaaguggaaugaaaagaguuaccaaacaaggaauacaaaauaauuccuaucuugguaucauuuaaagugaaucuaugcuagaaagauuccauaaagaaaaaaaaugaaucuauauaccuacauauacagggaaucugaaguaauuuuuaaaagcaaugucagaaugguuuucuuuucuuauggccaaguaggcuuuuacuggaccugaccuuccugcauauaacuggacaaaauuuuuaaaaaacaaagacccgaaggcacuggaggaugaacgggagcagucagauucugaaagagaguugacacauguaagaagagacagcaugaaauuaguuuuuuauuuuuacugcuuuuagcuagaggacaggcugaagugggcaccugacaggcuggcuuaaaccuucauagaaaaccuaagcaguggacagcauuugggucagccacaaccacugagucaguggaauguaaggggaggaggaaucuuggaagggagagauccagagagugacagccuaaaauucuguagauaaaauaaacuguguuuaagccucuguuuaauuguaaaccacacuuaacacaaaagauuauaagcagcacaacuagagaugaaagaagugaacugggccgggugcaauggcccacgccuguaaucccagcacuuugggaggccaaggcggguggaucacgagaucaggaguucaagaccagccuggucaagcuggugaaaccccaucucuacuaaaaauacaaaaauuagccgggcacauuggcaggcgccuguaaucccaccuacucagguggcugaggcaggagaaucgcuugaaccccuggggguggagguugcagugagccaagaucaugccauugcacuacagccugggugacagaguaagacuccgucugaaaaaaaaaaaaaaaaagaagaagugagccgaguuuguaguuugaaggccaggcacaguggcucaugccuguaaucccaguacuucaggaggcugaagcagguggaucacuugagcccaagaguucaaggccagccugggcagcauggugaaaccccaucuccacuaaaaaauacaaaauuaagccaggcaugguggccugugccuguagucccugagcccagggaggucaggggugcagaucgcaccacugcacuccagccugggugacagaguaagacucuaucuugaaaaaaaaaguuugcaguuugaaucuaaccaaauuuauuacauguuaaaacaaaaguaaugauacucuccagaggaauagaacacagucuggaauuuguacagcauaauauucacaauguccaggauauaauccaaaacuacauguuuuaagaaccaagaaauuauaacucagucugaagaaaaagagacaaucgauagaaacuaacugcauguguuggaauuaggagucaggauuuuaaggguuuucauuuuaaucacucaaagaaguaaagggaaauauucuuguauugaauaaaaaagaaaaucucaaccuagaaaucgaaacaaaaaagagucagguggggauucuagaacuguaaaauauaaccacugaaauuaaaauucagcaggugaccuuaacagcaaaauggagaugacaggggaagaagcuggugaacuugauagcauacuaaagaacagaaagaacacauauuuuuuaaaagugucaccagagcuucagaacccugugggacaauaucaaaagaccuaacuuuggccaggcacaguggcucacgucuguaaucccaccacuucagcacuuagggaggccgaggcaggaggaucacuugagcccaggagugcgagaccugcaaaaccuauuuuuuauaauuggaguccuagcaggagaggaaagugagagagagacuggagaaggacauauuuaaagauaaaauggcugaaauuuucuuaaauuuuaugaaaggcacauuuacugaugaaagacgcucaucaaacaccaccuacuaggauaauuacaaagaaaaccauaccuugguguaugugucgggguccccaagauaaccaucagggccagugauuugcuagaaggacccauaggacucauaaacuguaaacuagcaguuaaugguuuauuacagcaaaaggacauagguuagaauuggccagaggaaaagacacacgggauaaaaucuaggagagaucagaugcaagcuuccagguauugaauggagucauacagggauguacuuaauucuuuuacagugaugcgugauaacaugugcaaaggauucccaaccaaggaagcucuuucaaucuuuggugucuagcacggcaugcagugcccauaugacugaacucagcuacucagaccccagacccccagagcaaaaacauguacuggcaauaaaucauauuguuaggauaaauuuaucugauacagcauggccuaagaccucaggcaugcaaaaauacuuaugaagcagaauauucaaagggcucagaggccaucuccaaggagccagcaaagggcuaguccugaagacagaccuuucuuuggcaugugcagggcuuggcauucuaggccugcugaguuuucacccuuuccuauacaguguaucguagucaaguugcugaaaaccaaaaauaaggagaaaaucuugaaaguagcuagagaagaggcugggcgcgguggcucacgccuguaauccccacacguuggaaggccgagacaggugggucacaaggucaggaguucgagaccagccugaccaacaugguaaaaccccaucucuacuaaaaauacaaaaauuagccgggguggcagugcacaccuguaaucccagcuacccaggaggcugaggcaagagaaucacuugaacccaggaggcggagguugcagugagccgggauugcgccacugcacuccagccugggcgacagagcgagacuccgucucaaaaaaaaaaaaaaaagaaaaaagaaaagaaaguagcuagagaagaaugacacagggaaaugacaauuauaauuagagcuuacuucuuacuagaaaccacagauguuuaaaaggcaguagaguaacaucuuauaaagugcccaacagggaaaaaaaaccugucaacccagguuucuguauucaggaaaaaaacaacaaaaaaaacaaaaaaacugcaagauuaaaagacauuuuuagauaaaagaaaacuaaaagaauucuaccagaagaccugcacuacaagaaaugcuaaaggaaguuuuucagauuaaaggaaagugauaccaaauaaaaacucagaccuuuaggaaggaaugaagagaauuggaagugguaaacaccugggugaauaugaaaggcuuauuuuuuuccucuuaauuucuuaaaauauauaggauugcuuaaagcaaaaauuguaauaacguguauagagguuaugauguuuauuucuuaggacaauuauaacagaaaaaaacgaguauauggacuguacuauagcaaagguuucugcuuuuuuuuuuuuuuuuuuuuuuuguuuguuugagacaggaucuggcucuguggcucuguaucccagucuggagugcaguggugcaaucaugacucacugcaaccuagaccuccugggcucaagcaauccucgugccucagccucccauguaccugggaccacaggugcaugccaccacaccuagcuaauuuuuuuauuuuuuuaguagagacagagucucauuauguugccaacacuggcauugaucuccugggcucaaguaauccucccaccuuggucucccaaagugcugggauuauaggcaugagccacuaugcccagccuguuucuacauuuuuaauguaaugguacuauaaauauauauauauuuggagacagggucucgcucugucacccaggcuguagugcagugaguggcaugaacacagcucacuguaccucaaccucccaggcucaagcaauccucccacuucaccuuuuugggacuauagguauaugccacgaugcccaacuaguuuuuaaauuaauuuuauuuuuauuuauuuuuugagacagagucucacucugucacccaggcuggagugcaguggcgugaucucagcucacugcaaccucugccuuccggguucaagggauucuccucccucagccucccaaguagcugggauuacaggcacucaccaccacgccuggcuuauuuuuguauuuuuaguagagaugagguuucaccauguuugucaggcugaucucaaacuccugaccucuagugauccacccuccucggccucccaaagugcugggaucauaggcgugagccaccgugcucggccaaaagauguuauuuaaauauaaagacacagguugaaaguaaauggauggaaaagauaucccaaaaaauuuauaaauguaugccaugcaaacaguaagcauaagaagaugaaagcuuuuaucagaaauaaauaagggacaucuuaucaugauaaaagauaccaggaagucuugacaguuauaaguguguaugugccuaauaauggcuucaaaauacacaaagcaaaaauugacagaauuggcugggcaauggcccaugccuguaaccccaacauuuugggaggccaaggugagaagaucacuugagacuaguuugagaccagccugggcaacauaacccuuaacccaacauaacccuacccuggaguuuuuuuguagagacccccaucucuacaaaaauucaaaaauuaacugguuugguggcaugcaucuguagucccagcuacucaggaggcugaggcggaggauugcuugagcccaggagguggaggcugcagugaaccaugaucacaccacugcacuccagccuggugacagagugagacccugucucccaaaaaggcagaauuaaggagauauauuggcaaucuguaauaauuggaaaauuuaauaccucuuucucagcaauuaacuagacacacccagguaucugaacaguacaaucaaugaauuugacuuagauggugguuauagaacacuacucccuacaauagcagaauacacauuauuuuacaaguguauaagguaugcauucauugguaucgauaauauacuacuaggcccacaaaacaacucagcaaauuucaaaggauuuuuuuuuuuauuuauuuauuggagacacaguuucacucugccucccaggcuggagugcaguggugugaucucagcucacugcaaccucugccucccggguucaaaugauuauugugccucaaccucccgaguagcugugaucacaggcgcguaccaccacgcccacuaauuuuuguauuuuaaguagagacaggguuucaccauguuugccagguuggucucgaacucccaaccucaagugaucugcccaccuuggccucccaaaguacugggauuauagaugugagccacugugccuggccaaauuucaaaggauuuaaaucauacaaaauauguucuaaggccauaaugaauuuaagcuuuaaauuaaugaagauaucuaugaugaagacaacaucuaggaaaauucccaaauauuuggaaauuaagacaguuuuaccuaaucuauagauaaaagaagaaaucacaagaaaaauauuaagugauuuaaacugaaucacuuaaacugaacaaugaaaauaaaucaaacuuguggaauacagugcugagagggaaauuauauagcuuuauuuauuuuuuauuuuuuauuuuuuugagaugaacucucgcucugucaccaggcuggagugcaguggcacaaucccggcucacugcaaccucugccucccggguucaaacgauucuccugccucagccuccugaguagcugggauuacaggcgugcgccacuacacccagcuaauuuuuguacuuuuaauagagaugggguuucaucauguuggccaggauggucucgaucucuugaccuugugauccguccacguuggccucccaaagugcugggauuacaggcuugagccacugcgcccagccauguauauagcuuuaaaugcuuauauuggaaaagacaaaaaucuaaaacagugaucuaagguucgaacuugaaaaucuagaaaaagaagagcaaaguaaacccaguaaguagaaagaaaaaaaaagagcugaaaucaauggaauaaaaaaacaaacaauagaaaaaauuaacaaagccaaaauuugguuccuggaaaguucaacaaaauuauuuuuuauuuuuuuggaaacagggucuugcucagucacccagacugaagugcaguagcaugaucauaguucauuguaaucucaaacuccugggcuucagcgauccuccugccucagccaaguagcuaggacuacaggcaggcaucuagggacuacaggcacgcacuaucauacuuuauuaauuuuuaaaaauuuuuuguagaaauggggucucauguugcucgggcuggucucgaacuccuggccucaagugauccucccaccuuggccuccuaaagcgcugagguuauaggugugagccacuuuuggccaaaauuauuucuugacuggacaagaaaaaaaaaaaagcacagauuaccaauaucaagcaugaaaaaaggguuuuccauucagauccuacagauauuaaaagaacaguagauuauuaugaacaauuuuaugccaacagauuuaucaacuuagagaaauggacaaaauccuugaaaaaugcuacuuaaugcuaacacaauuuauauuaaagaaauuaaauucaguaucaaaacucuuuccacaaagaaaauuccaggcccagaguuuucacuggagaauucuucgaagcauauaaggaaaaaggagaggagaauacuucccaauuuauaaacuaguauauaugucauauauaauacauauguauagaguaauaccaaaacuggacaaagacauggcaaauacaauuauagacuaauauuauucaugaacguaaaugaaaaauccuucagaagauauuagcagaucauaccagcaacauaauaagauaaugaaugcaucaaggcuaauuaggguuuguuacaggauauacaggauacaagguuguuuuaagauuaaauaaucagggcugggcucaguggcucacgccuauaauccuagcacuuugggaggccgaggcagguggaucacuugaggucaagaguucaaaaccagccuggccaacauggugaaacccuaucucuacuaaaaauacaaaaaaaaaaaggcugggcacaguggcucacgccuguaaucccagcacuuugggaggaccgaggcaggcacaucaugaggucaggagggaggaccgaggcaggcacaucaugaggucaggagaucgagaccauccuggcuuacacggugaaaccccgucucuacuaaaaacacaaaaaauuacccgggcgugguggcacgcgccuguagucccagcuacuugggaggcugaggcaggagaaucgcuugaacucaggagguggagguugcaguaagccaagauugcaccacugcacuccagccugggcgacagagacugucucagaauaaaaaaaaaaaagauuggauaaucaauauaauucaccacauuaacaaugaagaaaaacuauggcauaaguucaguucauaaaaaguguuugaaaauguuuggcugagugcaguggcucauuccuguaaucucaacacucugggaggcugaggugggagacuugcuugagccuaggaguucaagaccagccuggacaacaaagugagacccugucucuaccaacaaaaaaaaaaggaaaagaaaaauuagcugggcgugguggcggugguggugugugucuguagucccagcuacucgggaggcugaggcaggaggauugcuugggcccaggaagucgaggcuggagugagccaugauuguacaacugcacuccagccugggugacagaacaagaccuugccucaaaaagaaaaaaaaacaccacauacauacguauguauauauguauauacacacagacacacauauauauauacacacacacauucagugagauccuguuucuaaaauuuuuaaauaaaaaaaguucgauauccuuuucugauagaauuuucuacaaacaaggaauagaagguaauucccucagucuaauaaacagcaucuguugaaaacuacagcugaugucauccuuaauacugaaaugcugaacacuuucuccugaagauuggguacaauguucacucucaccauuuguauacaacauacuggaggucacuuugggaggccgaggugggcaguucauuugaggucagaguuugagaucugccucaccaacauggugaaacccccaucucuacuaaaaauacaaaaauuagccaggugugguggugcacacuuguaaucccaguacucaggaggcugaggcaggagaaucccuugaacucaacaggcaaagguugcagugagccgagaucacaccacugcacuccagcauggguaacaaaucaagacugucucaaacaaaaauagccaggcacaguggcucaugccuguaaucccaguacuuugggaggccgaggugagcggaucacuugaggucaggaguuugagaccagccuggccaacauggugaaaccucuacuaaaaauagaaaaauuagccaggcaugguggcacacaccuguaaucccagcuacucaggaggcugaggcaggagaauugcuuaaacccaggaggcggagguugcaaugagccgaguucacgcuacugcacuccagccugggugauagagggagacucugucucaaaacacacacacacacacacacacacacacacacacacacacacacacaccauacuggagguccuagccacugaauuauggcaauaaauggaaauagaaggaaucaggauuagaaaggaagaaguuaaacuuucuucauuugcagaugacaugauuguuuacauagaaaauccuaagaaauccacaaaacaacuauuaggauuaauaagugaacuuagcaggauugcgggauagauauuagguugauaaacaaaacucaauuuuguuguuauauauuaauagcaaaauuugacaauaaaaaaaaaacuuuuuuugagacagccuuucucugucgcccaggcuggagugcaguggcgcaaucucugcucauuguaaccuccgccucuagcugagacugcaagugugcaccaccauacuuggcuaauuuuuguaauuguaguagagacaggguuucaucuuguugcccaggcuggucucgaacucccaaccucaagugaucugcccaccucagccucccaaagugcugggauuacaaggugugagccacaaugcccgaccuagaaaauuauuuuuuuaaauaaguaguuccauuuacaauagcaccaaaagcauaaaauacuuggaauaaauuuagcuaaaaaaguacuuaagaccgcaguacuaaaagcuaccaaacacugcagagagaagcuaaagaaugacuaagaggagagaggugcuauguucaugaauuggaagacucaguguuguuaagaugucaguccuacucacacugaucuauggauucaagacaauucaaagucccagauucuaacauuucucucucucucucucucucucucucucucucucucucucucucucucucuuucuuucaaccccuguuuccugggcucaagccauccucccaccucagccuccugaguggcuaggauugcaggcauaugccaccacaccgagcuaauuuuuguauuuuuaguaaagauggaguuuugccauguugcccagguuggucuugaacucaucagcccaagcauucugcccaauuuggcuucccaaaguguugggauuaccagugugagcuaaagcgccucaccaauucuaacauuucuguggaaauacacagagcaaagaacaaaauuggagaacuuggaacauuuauuuaaagacauuauaaaacuccaguaauaaagacaguaugguacugacgagucuacaaguaaagaaacagagaacccagaaauaacaaauuagcacaaauuuagcaacuuaaauuuauuaucucacaguuuucauggaucagcauucuaggcaugggcuagcugauccuccugcucagggccucacugggguugugauaccaucugagacucagggaccucuuucuuuccaagcuggcugguuguugacagaauucaguuccuggaaguuguggaaugagauacccacuuucuuucucccuggaugucagcuggggaaaucaugcucagcuccuagaagcugccugcgggugcuaaccucauggcccucucacaacaugguagcuugcuucuucgaagcuaucaagagaaucuuauacagucaguccucugcauccgcagguucugcauccuuggguucaaccaaccucggauugaaaauacaaaagaaaaaacaauaaaaaauaauauaaaggccaggcgugguggcucaugccuguaaucccagcacuuuaggaggcugaggcagguggaucaccugagguaggaguucaagaccagucuggccaacauggugaaaccccaucucuacuaaaaauacaaaaaauuagcuggaugugguggcacacaccuguagucccagcuacucgggaggcugaggcaguagaaucgcuugaacccgggaggcggagguugcagugagccaagauugcaccacugcacuccagccuggaugacagagacuccgucucaaaaaaauuuuaaaaaauaaguauccaaauggauaugucuagguuauaugcaaauaccaugcuauuuuauauaagggacuugggcuuccauggauuuuuauauccuuggggauccuggaacgaaucucauucagauacugagaaaugacuguuuauauaacucaaaugcaaaaacuagaaugacuaucccaucauauucacagguucuguccacaguuaggggcaggggaaaguguuauacaaggcauguacaacaaggggcaagagucuuggaagcuaucauagaauccuuuuuuuuuuuuuuuucccugugauagggucuugcucuguuccuaagccagagugcaguuuugcaauccuagcucacugcugccuccugggcucaagggauccucccaccucagccuccugaguagcugggacuacggguauacgccgccaugcccagcuccaucuuagaauuccgccugccacaauucuaacuucacaugaugugcagaaauuaaaaugaauuagaucucugaacauaaaaacuaaaaccaaaaaacuuuuccaagaaugcauaggaaaacaucuucaugacauaggguaggcaaagauuucuuagguaaaauacacuaaccauaaaauuaaagauugauggccaggcaugccggugucucaugccuguaaucccagcacuuugggaggccaggguggguggaucacuugaggccaggaguuugagaccagccuggccaacauggugaaaccccaucucuacuaaaaauacaaaaauuagccagauguggugacgggcacccguagccccagcuguuaaggagacugagggaagagaaucacuugaacccaggaggcagagguugcagugagcugagaucaugcuacugcacuccagccugcucaacagaaugagacucugucucaacaaaagaaaaaaaaggaaaauacuuuuuagguaacuaaggucaaaaguucacauuuuuagauccauacuauucaccuggagagggguagacaaugccauuuuguuuucuguuuuauaaaucugaaauugagggcaaaggggaugguagguuauuuuaaugaacaaacaacuauuuuuucugagagugugagaugaacauuaguuugaaagggguuccuacauauuucucuggccugcugccagacuuaucuauggccaaaaguaugugugucugucuuugacagugacagcuuuguauucugucagugaucuuucugugccuuuugaggggguggauuuccuugguuaaggauaaaucuguagcagagcagagucuuaacccauuucagcagccacaaaauuugggccugaguuuacaaacacaucaccugacgucucuuuugcaacucaaaaguggcuucauuuauuauaacuauuaaugugaaaguaaccaaagaaaagaaauaaucuguguaaaaaugucugcaucuuugucuuuacauaaauuguucauauuaaaaagcuuaacuguuuccccuuuauuaacaguuuccuuuuugagguuauaaaacauggccuuuuuuuuccuuuuaguuauuucaggcauguuugaguguucuuagggauguguuauagacaaguuuuaagaaacuguugcaaggaagguggaaugaauuggagauuuauuuguucuuaaaaaaugaaguggcuggguucagugauucacgccuguaauuccagcacuuugggaggccaaggagggcagauugcuugagcccaagaguuuaagaccagcgugggcaucaaacugagacccccaucuguacaaaaaauuuaaaaaauuagccaggcaugguggcauguaccuguagucccaucuacuugggaggcugaggcaggaggaucaccugagcucgggaagucgaggcuacagugagcuguagucacaccagccugggugacagagugagacccugucuuuaaaaaaaaaaaaaaaaagaagguaaagcugacagacuacuaaaccuugaaauuucuuucacauuuguuccuuuucagaauaaguauuugaacagcucuucuuuucuaccuuugagguguauacuugggagaauaaagucaauugacuuuuggaaauggcuaguuagaaucaaaacaagagcuuuccccaaauucgguaauaaaauuaacgggugaggaaucaguaagguuuacugcuguuccuccuggaaauggcacaagacugauuuccuuuuuccuuagccugagauuaccauuggauguguuagugcccucuucagguguaacuuggguacugcagccggcguccuuaaauaacagggacaagaaauagauacuuuaauaaaauaaaacuuuaaaauaaauaccuuaaaguuuuuaaaauaaaaguaauauggccacauuacaaaagauuuggaaaauaaaaagaaggaaucagucguaauuccaccagcaacguaaacucuuggugcagacauuccuugucagauguuucaucugucauuagcaaaauaauauaacugaaaaauuagugauuuuacuuauguaaugaaucacgaaaagagaaaaaaguaagguccuuuaaaugaaaaaaaauuaagugauaugauauuaaagauaaaguuguaaccugaaaaguaagggaacauugacuucguucuuuugagaauuuuuggcuuuuuauuuuuccaguaccuuuugaacuagcuugggucacuucccuguaggacuuuaggaagagacuagccaaggcuucauucuuucucuauaagguuguguacuaguguggcaguucguuagcccauugccucacaauucucuucuguuuuagaacacccaagauaacacauagcacacccaaagaaaaggacauucccugucuguaucaguggcucucuccaguagugauucucuaccugacacauaaccagaaucaagcaauaauuuguccauagcuuuaaaaaggugacaugcaccaucaggagucaggaucuacuccccaucccacguccuuuaucccaucucacaugcagcugagagucacugacuuggacagucuucucuaaagagucugcucauagaagguaaauuuaagacauaaaaauguuuaagacucuuaaucaaaagacuuuaauuuuuucugauaaauucaaaaagauagacuuuaaccagcccugauguuugaguguagaugaugagggagaaagaagagugaacccuauuucuguauuugucuuggguuucuggguggaugguagaacuauuuucugaucagggaagaaugucagucagaaaugauguuuucuuugauguguggaauuugaggggcugagaugccucaaagugaucccuucuguuuccguagcuucaaauuacuaccuacauguugauaacucccaaaucuauacucuauguuggucuggucugccccauaggugauguaucauacugccucuaucuccugguccucugucuccguauaucauuuacacaccaaucuauuuaaucauaguucugauagcgcaacacuuuuucauagaaaaguuuauauggaaguuugauacauaaaauagauuugguuaauaaggccccuucuaaccuccccaucuuaguuucuuuuuuuuuuuugagacggagucucacucugucacccaggcuagagugcagcagugugaucuuggcucacugcagccuucacuccccagguucaagugauucuccugccucagccucccaaguagcugggacuacaggugccugccaccaugccuggcuaauuuuuuuuuuuuuuuuuuuuuuguauuuuuaguacagacaggauuucacuauguuggccuggcugaucucaaacuccugaccucgugauccaucugccucggccuccuaaagugcugggauaacaggcaugagccaccgcgccuggccuuuuuuuuucuuuuaauagagauagggucucacuauguugcccaggcugguuucaaacucuuggaauucaagcgauccuccagccuccacuucccaaagugcugggauuacagucaugagccaccuuuaauuucuuuguaucuuacuggcaacaaagaggaaaggaaaaaaucuuguugcucuauagcuaacuuuaacuucaauucuuaaauuuucuguuacaauuguagcagagguuggcagucaaaugaauaauaauagcugauauuguguuacuaucuaaucaauaguauucugagcacuucuacacauuaauccacuuaauccuggcaacaucccuaugaaguugaucuuguauuauccuauuuuacaaaugagggacccgaugcacagagagauugagugucuuguccaaaaucacagagcuggcaaauggaagaggauacaaacucaggcauucuggagccagagucauuucugugcuguacuaacucuaaagcuggggauaaaguauuuuacuagguagggauccauggccaaguggaagccaggaagcauuaaggggugaaauaaucuuuauuuuauuauaguuauuuauuuauuuauuuauuuauuuauuuuuugagauggaguuucgcucuugucgcccaggcugcagugcuguggcuugaucuuggcucacugcaaccuccgccuccuggguucaaucaauucuugugccucagccuccugaguagcuggggcuacaggcgugugccaccacgccuggcuaauuuuguauuuuuaguagagaggggguuucaccauguuggccaggcuguucccaaauuccugaccuuaagugauccacccgcuucagcuucccagagugcugggauuacaggcaugagccaccgugcccagcauuuauuuuuuuuuuuugagacagcgucucauucuauugcccaggcuggaaugcaguggcaugaucuuggcucacugcaaccucugccucccggguucaagugauucuacugccucagccuccccaguagcugaaacuuacagguauguaccaccaugcccagcuaacuuauguguuuuuaguagagaugggguucugccguguuggccaggcuggucucgaauuugugaccucaggugaucuucccgccucagccucccaaagggcugggauuacaggcaugagccacugcgccuggccugaaauaaucuuuaaacaucucuuaaugcacaauugucuguuucuggauuuucuauaccauucuauugcucuauuaucuuucgaccaguacuauagcaucuugauaaugguagcuuuauauuuaaaaucaggucauguuaaucuucuaacuuuauuuuucaaaguuguuuuggcucuucuagguuuuuuuuuuuuuugagauggagucucgcucuguugcccaggcuggagugcaguggcgcgaucucagcucacugcaagcuccaccuccuggguucacgccauucuccugccucagccucccaaguagcugagacuacaggcaccugccaccacacccggcuaauuuuuuguauuuuuaguagagaugggguuucaccguguuagccaggaugaucucgaucuccugaccuugugauccaccugccucggccucccaaagugcugggauuacaggcaugagccaccgcgccuugccuggcucuucuagguucuuuacauuugaauuugcauaggaauuuuagauuagcuuguccauuuuuacaaaaaccuacuaggauuguaggccagcgcaguggcucaugccuguaaucccagcacuuugagaggccaaggcugguggaucacuagaggucaggaguucgagaccagccugaccaacauggugaaaccccgucucuacuaaaaauacaaaauuagcugggcaugguggcacacgccuguaaucccagcuacuuugggaggcucaggcaggagagucgcuugaaccuggaugcggagguugcauugagccgagaucaugccacugcacuccagccugggcaacaagaacaaaacuccaucacacacaaaaaaaagaaaggauugugauuaaagucgugaagaauuauaggucaauuuggggauaauuaaugucuuggcaauuuugagucuuccaaccuuugaaaacagauagcucuccauuaauuuagaucuuuguugguuucucucagcaauguuuuauagauuucacuguacuggucuuauauaucuuuugugagauuuauaccuaaguuuauauauauauauuuuuguuuguuuguuuguuuguuuguuuugagauugagucccacucuugucacucagguuggagugcaguggcgcgaucucagcucgcugcaaccuccaacuccuggguucaagcgauucuucugccucggcuucccgaguagcugggacuacaggugacugccaccaugucuggcuaauuuauuuuauuuuauuuuauuuuuuguauauuuaguagagacgggguuuugccauguugaccaggcuggucucaaacuccugaccucuggugauccgccugccuuggccucccaaagugcugggauuacaggcaugagccaccgcgcccagccuguuuuucuugacuuagugagcuggcuagaaccuuuaauacaguguuaaacaggaguagaggcagagagaacuucuugccuucuuucaguaaguacgauguuugcuguaaguuacugguagauuaccuuuaucaaguugagggauuucccuucccuaguuuccugagauuuuaaaaucaggaaugaauguuggauuuucucaaaugcuuuuuucuguaucauaugguuuuucuuuuuuaguuguuaauauggugaauuauggaauucuuccuugguggaauucuuuaaaauggagaauuauuuugauuauugaauguuaagccaauccuguauuuuuucaaaagaaacaccucagucaugauguaguauugcguuuauuuauuguuguguuugguuugcuaaauuuuuguuaagaauuuucacaagcugggcacaaaugucaaguggcucaugccuacaaucccagcacuuugggaggcugaggcgggcggaucaucugaggucaggaguuggagaccagccuggccaacauggugaaacccugucucuacuaaagauacaaaaaaucagcugggcgugguggugcgcgcuuguaaucccagcuacucaggaagcugaggcaggagaauugcuugaacccgggagccagagguugcagugagccgagaucucgccauugcacuucagcgugggcaacacacugagacuccgucucaaaacacaaacaaaaacuugaugaaggaagauaaaggugggaaaggggccaggcacaguggcucacgccuguaauuccagugcuuugggaggccgaggcaggcagaucacgaggucaggaguucgagaccagccuggccaauauggcaaaacccugucucuaauaaacauacaaaaaauuagccgggagugguggcaggcaccuguaaugucagcuacucgaaggcugaggugggagaaucgcuugaaccugggaggcagagauugcagugagccgagaccacaccauugcacucgagccuggcgacagagcaagacucugucucaaaaaaaaaaaaaaaaaaaaaaaaaagugggaaaggaaggaaagauaacacauuaaaaaauaaauaauuuccuguuuuaaaaaguaguuaugcauugauuaccagugggauacauucugagaaacgucauuaggugauuucaucauugggcaaauaccauaguuaacuuacauaaaccuagaagguauacuacuacauaccuaugcaauaugguaucaucuaucgcuccuaggccacaaauccauacagcauguuacacuauauuggauacuguaggcagugugguacagugcuuaguauuuguacaucuaaacauuaaaaaaauacaguaaaaauacaauauucuaaucuuaugggacuacagucauauauguggugcuuuguuguccacaugucauuuaguacauaacuguacuauacucagccagaacagguacaugaaaauaaaagagaaugaaaagaaaguuucugcuggucgcugugguucacaccuguaaucccaguacuuugggaagccaaggccaguggauugcuugagcccaugaguuugagaccaacaugggcaacaugacaaaacccugccucuacaaaaaauagaaaaaucaaccgggaaugguggugcacgccuauaguccuagcuacuugggaugcugagaugggaggauggcuugagcccaggaggcagagguugcaaugggucaagauugugccacugcacuccaaccugggcgauacaaccagaccuugucuaaaaaaagaaaagaaaauuucauggacgcaaaccaugcagccucuugcugguuaugaaauacacacuagaacuaguguaagucuaguggcuucauuuuaaacuauuggcaacugccucauuucucacuuuuucuucauauuuuucauccucuucucccccaagguauuagagagggaaaaguuuccaaaaaccaugccaguuuccuuccuuugguguucuauacuuggaauccuuagucuucuguggucaauagagucaugugcaaaaacuugacuaguuuaaggggaauuauuaggaaacaaaugguuuugcugucuuuuggucauuagcuuggccccauguuuaagcauucgguaacaacugugaagagccugcuacaaauaaagugguaggugcucugaagaaaaauaaagcuguuaaagggaauagaaagugaugaaggcaggggcuguuagacaggcuggucagugucugaggaaguagcccugcacugagaccugaaaaguaaagaagcaagccauggggaguuggggaggagcauuccagacagaggcuugauguguugaaccaucuuuuccaagcucuuccucuguuaccuucucuuuagucacuauguccccuuucuaucccagaccauaauuccaccauuuaucuuaaggcugagcccagggccuauauuauuaugcagguuguuuacugcacacaucuaggggcacuguuuacacuuguuaucuuuguagguuugaauauuucuauuucuuaugaguuuuccagcagauggcaguaacacgcaugaagacagggugacuuuuucuaguuugcacaaaggucuuuuuugagacggagucucacucuuucacccaggcuggaaugcaaaggugcgaucucggcucacugccaccuccgccucccagguucaagugauucuccugccucaaccuuccgaguagcugggaguacaggcacgcaccaccaugccuggcuaauuuuuguauuuuuaguagagacaggguuucgccauguuggccaggcuaguuucgaacuccuaaccgcaagugauccacccaccuuggccucccaaagugcugggauuacaggagugacccaccgcaccuggccuaaagguguagacacucugauuugcaucuaggcacaugucgucuuuaucccuuuuccuucucugauacaucaagguccuuuucucucuggguccuagccucauucucuaaguuuccucuuccugucuuucaaauauuuugaauguauagaagaauuacaguugugcuacaaggaagucccguauaaucugcacucuaguucaccaguuguuaucauuuggccacaugugcguuaucauccccucccucucaguauagauagauguuuuuuuccugaaccauuugagagcugauugcaaacauucugccucuuuaccccuacuuuggaguguguuuccauugaacaaaacaucuuuguuuuacguaaccaacgaaaguuauuguuaaggaaauuuugcuuuuuguuuuuuguuuuuuuuuuuugagacggagucucgcucuguugcccaagcuagagugaaguggcgcaaucuuggcucacugcaagcucugccucccagguccacgccauucuccugccucagccuccugaguagcugggacuaugggcacccgccaccacgcccagcuaguguuuuguauuuuuaguagagacgggguuucacgauguuagccaggauggucucggucuccugaccucgugaucugccugccucaaccucccaaagugcugggauuacaggcgugagccaccgcacccggcuguuaaggaaauuuaacaguaauuuaggaaauuaaacauugauaaacaguacuuuugucaauuauauaguacacauuuaaauuuugucaguuguaccaaugaugucuuuauagcuguguuuaccccuuuuccagaguccagucuaggaucacacuuugugccucauccugucuccuuacucuccuuuaaucugagaauuaagauuaaaagaaguaaguuccucagccuuucucuuucacaccacugacauuuuugaagacuauaggccaguuguuuuguagaauauuucucaaucuggguuggucugguguuuucugauuagaugcagguuacauguuuugggcgggaauaccauagaagugauguugugucuuucucagugcaugcacuaugucuggaggcauaugguaucuguuuguucuacuacugaugacgucggcccucuaagccuucuguguugaaacuguuccuuguaguuauaugaauucuaacauguauaugcuugaacucugacuauaggaauucuccuacuuacaggaauucacucuuaaguaggcaguauucuauuaaguucuucuguucaaucucuuaguucaucaagugagccugaguucccucccaauucuuucucuccuuugcagcaucacuaucugggacucucggguucccaucaggagucauaauaccuucucuuucuccuaguaaguugcaucccuuagccagacucuuugaaccagugauuacuucuuauauacaaucagcauauuuuuaguguuuuauugaaucaaguuaagguucuuuggcucuaggaagguuagucuucaaagaaaugguuucagaagagagcuguauagcugaauguggggaagaacuagguacccucaagacaacuugaaucacacccaguucauuuuaucgcaaauaagucuuuuccgcuaaccuuauuugaauuacugcaugucauuuacacugucuuagccucuuuauuccuuaaacucuaggagguagauuucauuuucuucauuuuucagaugugaggaaauggaggcuuggaaagguuaaaguaauauagugagaaauuaccaggacuuaaacucaugucucuccaacuccaaagcccuugcucuuuuuugagagcagagaguggcugggaggaaaguccucuagcuauucauggugaaauuagccuucauagacagaaauacaaaagguaauggcagccacgugcagaggcuuaugccuguaaucccagcacuuugggaugccgaggcgggcagaucacuagaggucaggaguucgagaccagccuggccaauauggugaaacccugacugugucucaaaaaaaaaaauaaaaguaaugucacugcuagauuggaggugauugccggcaccugccacucagagaguuggaggugucuuuaaaccaggaccauccugggcaacuagaucuuacaguuggggacuuacaaacugggaaaaucgaaauacuucuacuuaaacucauuuccugacauaauuauuaauagugccccacucacuuuuuuuuuuuuuuuuaaacagucucauucugucacccaggcuggagugcaguggcacgauguuggcucacugcaaccuccgccucccagguucaagugauuucucgugccucagccucccgaguagcugagauuacaagugugcaccaccaugcccagguauuuuuuguauuuuuaguagagacaggggucucaccauguuggccagucuggucuugagcuccuggccucaagugauccaccagccucggacucccaaagugcagagauuacaggcgugagccccugcacccugccagccccacucacuuuuuuuuuuuuuuuuuuuuuuuuuagacggaguuucgcucugucacccagacuggaaugcaauggcgcgaucucggcucacugcagccuccgcuucccggguucaagcgauucuccuaccucagccuccugaguagcugggacuacaggcacauaccaccaugcccagcuaauuuuuauauuuuaguagagacuggcuuuucaccauguuggccagguuggucucgaacuccugaccucaggugauccgcccgccuuggucucccaaagugccaggauuacaggcgugagccaccaugcccggcccccacucacuuuuuuuaagaguacugcagcuuggccaggcaugguggcucaugccuguaaucacagcacugugggaggccacagcaggaagauugcuugaagccaggaguucgagacuagccuggcagcauauugagacccugucucuacaaaaaagaaaaaaguaccuggacaugguggcacauaccuguaguccuagcuacucagaggcugagguaggaggcuugcuugaacccaggaguuaaaggcugcagugaguaaugauagugccacugcucuccagcccaggugacagagugagacgcugucucaaaaaagggaggagguaguauuguggcuuggauaauuauaugguccccuauacauaauccuuccugaauucuuuucagauuaacauugagacugguguuucuuuauaacuagcacuaauagugcuuggucuauuuuuauuuaccacuuucuuugccccugccccaauuuauacacuggggcaaaauuagcuuugguuuuauagucuguucaccuaacuaauuuauaggccugguuugcauaauuuaguuaacagcaagauuuugccacaccugcuuuaucauccuuucugccaaacuauuuaagguaaauggcacuuuaccccgguguauuuccauagcugaaauaagcucuuaaauuuuuauaauccuauccugaaaccuaaucgguguagcagaagaacguuuugccucgugaguuaucaccccugacauaauuugauuuucauuuauaagauucucuuagaaccaaguacaguggcacacaccuguagucuggcuacucaggaagugaaggcaggaggaucacuugagccaagaguuccaggccagccugggcaacauagugagaccccaucucuuuaaaaaaacaaaaccagauuaucuuaaaguggggcauaccuguauuugugugcuaaugugaggcuccacagguaugcaagacauaguagcuguggauguuucuuauaacuuauauucccuuuucuuuugucagugcacgaucugauuuucuggagagaugugaagaagacuggguuugucuuuggcaccacgcugaucaugcugcuuucccuggcagcuuucagugucaucagugugguuucuuaccucauccuggcucuucucucugucaccaucagcuucaggaucuacaaguccgucauccaagcuguacagaagucagaagaaggccauccauucaagugaguugaagucuuaaaagcaacauucuacauuuuaguggaaggguucacugaagcugauaggucuaaaacucagaccugacuaaaaaucaagaauuauggggccuaaugcagcugauugguggcaugaagcauccccuagagaccuugaaaucaccuuaagaaguggccaaguuagaagccaagaacuuuuugacaaauuagaggcucauacuugaaguucaaagagggaguccuucaaagaagacucuaaauucuuuuuuuuuuuuuuugagacggauauugcucuuguugcccaggcuggaguacaguggcgcgaucucagcuuaucgcaaccucugccucccaggugaaagcgauucuccugccucagccuccugaguagcugggauuacaggcaugcgccacuaugcccagcuaauuuuguauuuuuacuagauacgggguuucucuauguuggucaggcuggucucaaacuucugaccuugggugauccgcccgccucagccucccaaagugcuguuuuuuuuguuuuuuguuuguguguuuuugagacagagucucacucugucgcccaggcuggagugcagcggugcaaucucggcucacugcaagcuccuccuccuggguucaugccauucuccugccucagccucccgaguagcugggacuacaggcacccaccaucacgcccggcuaauuuuuuuguauuuuuaguagagacaagguuucaccauguucggcaggauggucucgaacuccugaccuugugauccacccgccucugccucccaaagugcugggauuacaggcgugagccaccgcucccgaccauaauguuuguauuuuuaguagagacaggguuuuaccauauuggucaggcuggucuugaacuccugaccucgugauccacccgccucggccucccaaaucaugcaugggauuacuaugcaugagccaccgugcccggcaacucuaaauucuugagcagggcagggaaagcagagcaccuagagcagcgcucgguuagaugggguuccaagugcauguuuaaucccccacauagguaagacuugacaugacuuucaaaccuuguugugucugugcuuugguaauaccagaacucaguguuuucauucuugguuuauuacugauuuccuccguaucucuuacuaguuuucuuaacgcuggaggucuuaaugaagucaguaaucuucugacuacauuucuaguauacaauuucuagcuuuuuugauugugcuguaacuuuaacuaauguuuucuucacacuuuccucuugaaaaucuuaccccauaaacaauguugacuuuaacgugagcaaaugacaguuuuuugaaggcucuuuuuucauagagaaggagacccugcugugaccucucaggacuacaacagaauagguuucuggccacaccugugcuccuuguauuuucucuugguggaaauagaaggaauaacuuacaacuuuauguggcauuaaaaauuuuauugcaguucaggugcggugacuuacgcauguagucucagcacuuugggaagcugaggcaggcagaucgcuugaggucaggaguucaagacuagccuggccaacauggugaaaccucgucuuuacuaaaaauaugaaaauuagccgggcaagguggcaggugccuguaaucccagcuauucaggaggcugaggcaggagaauaucuugaacccaggagguggaguuugcagugagcugagauugugccauugcacuccaaccugggcaacugagcaaaacaccaucucauaaaaaaacugcuaaaaaaaacccccaguacccuguuuuuauguguucugggcuguuaauuacaaauacaaaugugguuuuccaaaauguuuuuuuuaaaaaacaaaaacagcaaaauuuuagcauaaacaaaauauaguuuuagaaacuccaggauauguuaauguuaaaacugcuaaaaaaaaaaaaaaaaguaccuuguuuuuauguguucugggcucuuauuuauaaauggauuuaccuucaugaauauccaaugagguaguaaaagugacacagaacauaggucaguucuuuacugugcuugacugucccaugcuuugcagacaucuggcauauuugccucugcccacuaaaugacagugugucuccaccccaccugaugacaacaaaaaaaugcuccuacagguucuaacaugcacccugggaaccaauuuuacauucucaguaacuacugugcuaacaaaaucuucuuccaugucaaauguaugacuguuauuucuucuucuggaagagccuaccuggacguagacauuacucuguccucagaagcuuuccauaauuacaugaaugcugccauggugcacaucaacagggcccugaaacucauuauucgucucuuucugguagaagaucugguugacuccuugaagguuaguuguuucugcagcucuuggugguaaaacagaaaaagcagggacuggguuauaauuuggaggaaaaacaguacauaggauuuuaucagacaaaaaugaacguaugcuuagcucagucauucuauaaugggauaggugucacuagagaaagguauagccuucugcuggggaacaaauaucagaagagaggugauauaauuggaagcagugcaguuucagucuuuggaccucagaaaacuacagacuucacucacauaccuucaaauguauaacacaaguagggaaccuucauuuggaaauuguccaugucacacaucacuaaauuuaugcagacuuaauuagcuggaggagaaugacaucaguuaaugugaauuuugccuuacgguuauuccugcuuaacuuuugauauggccuucacagcuggcugucuucauguggcugaugaccuauguuggugcuguuuuuaacggaaucacccuucuaauucuugguaagguggcaaggagaaugugcccaugcucuuugaaguaguuuguaagaauaagagugaagagaaagcccagcauggcucuacucauucuucauugcccagucuugacccauagagaccugggaguagaggcacuggaggaaccggaguuuguggucacagguuuaugaaauggucucaguuauaaauuaagaaauaucaaaacagcuggaaguaaaggacaguugucuagauuugguuuacguauggggaucuuauuuacagaaaccauuuugguaauuuggaaauuguuauuugugguacaaagaagguagccuguauaccugaagagguuuuuuuuguuuuguuuuaacacuaccuuaaauuagcugucuuaauugggagugcuaaccaggauuucucauuuugaggaaugccuguguuuuccuguauuuuuugaggaaaaauguauauguuacucugagucuuaagaugugacugucucucauauacacuugccaugucccaugauucugucuuacagcugaacugcucauuuucagugucccgauugucuaugagaaguacaagguaagcauuuaucuguuccaaaucaaaugugccaguugauguaugacuaguuguaguucauuucugagacauugaauguucagagcagucuuuuuauaacuauuucuacaaucuaauuuugugagucaagugccuauaagaaacugguggcaguaguuuccuccaaggagagaaacuggauauuuaggagagagaugacuaggaaagagaaacuuccuuuuuauacuugugugccuuucgaguuuuuaaucauguagauguauuuucuaugcaaaaguaauaaguugaaaaaaugcuuaggccaggggugguggcuugugccuguaaucccagcacuuugggaugcugaagcgggagaaucccuugagcccaggagcucaagaccagccugggcaaccuggcaaaaccuugucucuaaaaaaaaauagccggaugcaguggccugcaccuguagucuaagauaggagaaucuacuugagccugggagacagagguugcagugagccgagaucaugucauugcacuccagccugggugaugggagugaaacccucucucaaaaaggccaggagcaguggcucaugccuauaauccuaacacuuuggggggccgaggcaggcagaucacuugaggucaggaguucgagaccagccuggccaacaugguaaaacuucaucucuacuaaaaauauaaaaauuagcccaguguggggccaggcacgguggcucacgccuguaaucccagcacuuugggaggccgaggcgggcagaucacgaggucaggagaucgagaccauccuggcuaacacggugaaaccccaucucuacuaaaaauacaaaaaauuagucgggugugguggcaggcgccuguggucccaguugcucaggaggcugaggcaggagaauugcuugaaccugggagguggagguugcagugagccgagauugcaccacugcacuccaaccuggaugacagagcaagacuccaucucaaaaaaaaaaaaaaaaaaacgcuuagaugggagauugagaccacggugaaaccccgucucuacuaaaaauacaaaaaauuagccaggcaugguggcgggcgccuguagucccagcuacucagagaggcugaggcaggagaauggcaugaaccugggagguggagcuugcagugagccgagaucgcgccacugcauuccagccugggcgacagggagacucugucucaaaaaaaaaaaaaaaaaaaugcuuagaugaauaaaagccgggugucuaaaaggaaacuuuaaacucuagguuauucagguaauccaucagugugaugagguguuugcauuguuggaugauguguaccaaguauacuagaugccaugagauuauucuuuauggauuaagucauccaucaagagacuuuuuggcuuuuugguauuaagugaauuaguguuacacaagagccauaacauauuuaugaugacagaaaauagauuagacacacaguuucuagucauuggaaacuguuauauacuccagugucucuaaagaaaauacuuaccaaguaagacuuaaccucugcaaaagaugagugauuuuuucacuuuaacaaagugugggguguuuaugguguaauuuggauucuaaaaccagagguuuuaaaaauacuuuuaaggcuaggugugguggcucaugucuguaaucccagcacuuugggaggcggaggcagguggauugccugaggaugggaguucaagaccagccugaccaacaugaagaaacccugucucugucucuauuaaaaauacaaaauuagccaggcaugguggcgcaugccuguaaucccagcuacuuaggaggcugaggcaggagaauugcuuaaacccgggagguggagguuucggugagccgagaucacaccauugcacuccagccuggacaacaagaacaaaauuccaucucaaaaaaaaaaaaaaaaaaaaaaaaaaggcugggcacaguggcucaugccuguaaucccagcacuuugggaggccgagguggguggaucacgaggucaggaggucgagaccauccuggcuaacacggugaaaccccgucucuacuaaaaauauaaaaaauuagccaggcgugguggcgggcgcccguagucccagcuacucgggaggcugaggcaggagaauggcgugaacccgggagguggagcuugcagugagccaagauagcgccacugcacuccacccugggcgagagcgaggcuccgucucaaaaaaaaaaaaaacuuuuaaaaacuggguguuuucauuuucuacacuggucagucguguuuaaaaaaugguuaaacuagacaaaagagccgugccuucaggaaaauuggugaucuguauguuaccacaacugaauuuauuuuccuuccuuaaagacccagauugaucacuauguuggcaucgcccgagaucagaccaagucaauuguugaaaaguaaguacauuuagagaccacaucaucaugagguaugcuuccuuccccccaauuaucuuuagucccuuguacaaaaugcagaugccaaggaaaguaauuuucauuuugauaaaaaccuuaguuaauaguuucauuuuacuaaaaauuauuauagcugcuucuauaaaaaggaaaaaaaauccuuuauaucuuuuucuggcccugccuucuggaccuuuguaggccaggcauuuugacucacaucuguaaugccagugcuuugggaggccgagacaggaggauugcuugaucccaggaguucaagaccagccugggcaacauagcuaggccuugucucuacuaagaauaaaaaauuagcugugcaugguaacacgugccuuuagucccagcuacuggagaggcugagacaagaggaucaaugggaaaaaaaagaucaguggaauuuuuuggagacagggucuugcuuugucacccaggcugaagugcagucucgaccuccugggcucaggugauccucccaccucagcuucuccaguagcaaggaccauaggcuacucugccuuuuugaacuggcuuuuaaauguucuucauuacaggcugggcacgguggcucacaccuguaaucccaacacuuugggaggccaaggccgguggaucacgaggucaggaguucgagaccagccuggccaacauagugaaaccccaucucuacuaaaaauacaaaaauuagccaggugugguggcaugcaacuuuagucccagcuacucaggaggcugaggagggagaauugcuugaaccugggaggcgagguugcagugagcagagaccaugccauugcacuccagccugggugacagugagacuccgucucaaaaaaaaaccaaaaaguuauugguugcuuccccaccuucauuuauuuucacauguauucauuuaagccaaacguaucccucucagaaacaaaaguucuaguaaauaaguaacuuaaggaucaaaguugucuuuucuaagauugccaaaucucuguucccauuuuuuuaaaccaauuaauaaaucaggaaauaaaauauugacaaacaucuuuaugacucccuauaucaaagaguuguuuucuucuuuuuacuuuuuuuccccauaccuagaggacaguauuuuuuuucuuuuuucuuuuuucuuucuuuuuuguuuugcuuucuagagacagggucucacucugucacccagguugaagugcaguggcacaagcugaaagcucacugcagccuugaccucugaccucccuugcuccaagugauccucccaccccagccuccugaguagcugacacuacaggcaugugccaugcccuggcaaauuuuuuauuuuuuauagagaugggggucucacuauguugcccaggccaggcuuuaacuucuggcuucaagugauccucccaccuuggccucacaaagugcugagauuacaggcaugagcccugcuuuuauuuugaauuauucauagcaaauacugugaaccuaacgcuuugaauuuguuaacauuuuucuuuuuuucuuuuuuuuuuuuuuuuugagauggagucucgcugucacccaggcuggagugcaguggugcgaugucugcucacugcagccuccaccucccggguucaagcgauuauccuucauucaccugccucagccuccugaguagcugggauuacaggugcacaccaacacgccuggcuaauuuuugcauuuuuuaguagagacaggguuucaccacauuggccaggcuggucuucaacuccugaccucaugaucugccugccucggacucccaaagugcugggauuacacgcgugagccaccauacccagccgggagaaugcauuucacauugcuuaugcaaguccaggacuguccucuagcaucacaguuaaaauaaaaaccuagagcaaaugcuaauguuuucacuuucuuucuuuuuccccuccuuuucucaauaggauccaagcaaaacucccuggaaucgccaaaaaaaaggcagaauaaguacauggaaaccagaaaugcaacaguuacuaaaacaccauuuaauaguuauaacgucguuacuuguacuaugaaggaaaauacucagugucagcuugagccugcauuccaagcuuuuuuuuuaauuugguguuuucucccauccuuucccuuuaacccucaguaucaagcacaaaaauugauggacugauaaaagaacuaucuuagaacucagaagaagaaagaaucaaauucauaggauaagucaauaccuuaauggugguagagccuuuaccuguagcuugaaaggggaaagauuggagguaagagagaaaaugaaagaacaccucuggguccuucuguccaguuuucagcacuagucuuacucagcuauccauuauaguuuugcccuuaagaagucaugauuaacuuaugaaaaaauuauuuggggacaggagugugauaccuuccuugguuuuuuuuugcagcccucaaauccuaucuuccugccccacaaugugagcagcuaccccugauacuccuuuucuuuaaugauuuaacuaucaacuugauaaauaacuuauaggugauagugauaauuccugauuccaagaaugccaucugauaaaaaagaauagaaauggaaagugggacugagagggagucagcaggcaugcugcgguggcggucacucccucugccacuauccccagggaaggaaaggcuccgccauuugggaaagugguuucuacgucacuggacaccgguucugagcauuaguuugagaacucguucccgaaugugcuuuccucccucuccccugcccaccucaaguuuaauaaauaagguuguacuuuucuuacuauaaaauaaaugucuguaacugcugugcacugcuguaaacuuguuagagaaaaaaauaaccugcaugugggcuccucaguuauugaguuuuugugauccuaucucagucugggggggaacauucucaagaggugaaauacagaaagccuuuuuuucuugaucuuuucccgagauucaaaucuccgauucccauuugggggcaaguuuuuuucuucaccuucaauaugagaauucagcgaacuugaaagaaaaaucaucugugaguuccuucagguucucacucauagucaugauccuucagagggaauaugcacuggcgaguuuaaaguaagggcuaugauauuugauggucccaaaguacggcagcugcaaaaaguaguggaaggaaauugucuacgugucuuggaaaaauuaguuaggaauuuggauggguaaaagguacccuugccuuacuccaucuuauuuucuuagcccccuuugaguguuuuaacugguuucauguccuaguaggaagugcauucuccauccucauccucugcccucccaggaagucagugauugucuuuuugggcuuccccuccaaaggaccuucugcaguggaagugccacauccaguucuuuucuuuuguugcugcuguguuuagauaauugaagagaucuuugugccacacaggauuuuuuuuuuuuuuuaagaaaaaccuauagaugaaaaauuacuaaugaaacuguguguacgugucugugcgugcaacauaaaaauacaguagcaccuaaggagcuugaaucuugguuccuguaaaauuucaaauugaugugguauuaauaa

SEQ ID NO: 192782 - RNA, 42647 nt, Homo sapiens
cacgcggcaggcgguggcgggauucugccgcgugcgcuuucccgccccgccucgccuagccucguccugcgcucgccacgccucgggcuguccguugggccacgcagaccgcgcugcgcucgcuccgucgcggcuccgcgugccccaccuucuggcuaguuuuuucuagagcccaggcuccgcccguuucccgcuuccagggcccgguucguucccgcccgcacccgucccucuccucugcaccccugcugcuucugcuuugaaggcggaggcuccauguuguccccucagcgaguggcagcagcugccucaagaggagcaggugaggcgccgauuuucccuggaucgccccgcggccacccccgccgccuucccugcuguaguucugaaaagaacccccgcccgcgccgccgcccuuccucgucccggggcugggaccgcgcgucccucgccggggucacucgguuuccgaauuuguggugggggggccccucuucgggcccagcugguccagcgagggcggcaccuuccuuacuuuucggccgggggcggccgccgucagggcucgggcccuggugccgccgggggcuccuccagcuccuccccugggcugcagcugccccugggcggcccaagggccggugguccccgugggcggcguccggagcuucggccccgccgagccccgcccugggcagagccgggcgccccagggcgcugccccuccgugcccgggcacucagcgcccucucuggucggagaaucggggccuggauggagcgggaaggugaaugcugguuuauuuggccuuucuggaagugcuggaaggcugcgaagugucuuggaagcuuuauuuuuauccuaacgaccuugaggcacugaccacaaguauuaggaaaguugguuuucaacccauacuuaacgcuguaaagaauuggucuaaauugguuuuucguaaguuagugcuuuuggcacaguacguuguucuuuugcuuucccgaagacaugaaacauagugaaaguauuaaaaaccaaauaaggagucaccguguauucacggaucugauuuagucugucauuuuacuuggcuuuauucuaguguaaugugugugcuguugaaaugaccguuucacuugcgaaaucgaagagcaaaaaggaaaagaacagugaagaauuuuuaaaugagucucaguucucaaauucaaauacgaagcaauggaacguuuugucagucuuagaauaacggaccaaaaauguacgauuucacauauuggcuuacuuuuggagauuuaagaagcauaaccuacggaguacuaaucccugucaagaauuuagcauugcaacauagguacugaaauucaaauuagugcuuuuuuuuuuccauucccacagagauuagcuuguacuccagaaauuccuguugccgcucuaacaccuguaaacacuuggcugagaaggaucucaguauugcaguaguccagcacauuguuuuauuauuauuuuuugagacggaguuuugcucuggucacccaggcuggagugcaauggcgcgaucucggcugauugcaaccuccgcuuccuggguucaagcaauucuucugccucauccucccggguagcugggauuacaggcgcucuccaccaugcgcggcuauuuuuuuuugagacggaguuucguuuuugcuaccuaaacuggaguacaguggcgcagucucggcucacugcacccuccgccuccuggguucaaaugauucuccugcgucagccucccgaguagcugggauuauagacauccgccaccaggcccagcuaauuuuuuguauuuuuaguagaaacgggguuucaccacguuggccaggcuggucucgaacuccugaccucaggugaaccacccuccucuccucggccucccaaguacugggauuacaggcgugagccaucgugcccggcccauuauuguauuagcuacaguuuacuaccucauuguaguagaauucaugaaauagaaguaacgggauagaugugguguuguguacuagcuuaauuuucuuuuucuuuucuuuuuuuuucuucuggugagaaggagucuugcucucucgcccaggguggagugcaauggcgcgaucucugcucacugcaaccuccgccucccagguucaagcgauucuccugccgcagccucccagguagcugggauuacaggcgcccuccaccgcgccuggguaauuuuuguauuuuuaguagagacgggguuucaccauguuugccaggcugaucuugaacuccugaccucaggugauccuccuagcucggccucccaaagugcugggauugcaggugugagccacggcgccuggcccaguugcgugguauuucgauugucagaacaccuuagauauauuucacagcugaaguauguuaacagauuagaagacaggcuuuccugguauaguaggcgcuaauuaggaaauccuuacuuggccgggagcugugguuuacuccuguaaucccagcauuuugggaggcugaggcagguggaucaccugaggucaggaguucaagaccagccuggccaacauggugagacgcccccccccacccaaaaaaaaauuaaaaaaaaguuagccaacgugguguugcaggccuguaguucuggcuacucaggaggcugaggugagaggauggagugagcccaggaaguuggcugcagugagccuuuuuuuuuuucuuuuuucugcagugagccuuguucuugccacugcacuccagccuaggcaacagagugagaccuugucucaaaaaaaaaaaaaaaaaaaaaaaaggaacacagcuaauucaaaccuuugguggcauucuuauucuuaggaaagagauacaaaaguguuacugagcucauuccauuaaaaagguuuuuuuccuccacuugugauauagccuggcaucauuuucagauucagcccucuccuuggauuuucugaaucuucaguaccauuuagucauagauaauuuuuguaaaccuaugaagcauuacacaauccuuagucaacaacaaaaaauaugguuuuguucagccuucugugcuauggcgaaaagauuuucuacaacagacaaauauaaaauuugcccaguauucugguuaauuagauuuaaauaguauuuucacugaaacagccuuaagcguauugcaguguaucuacuggcacaaucacugccuuaagacaaaacgguauauaaaagcacccaccccuccaccaccagaaggaaccacacccagcaguucuagaguuggcuaaggucuuaguauacuuacucuugccugugaugauguuuucucuggcuuugucaguuagaaaccuuaaagacugccagcaagaacaaggcaugaaaaugguaugccucuguuuuggguguguugcucuugcccuuuggagaauaugauauuuuauaaggagacuggaaaacucaggucauaacuuuacccugagucauacaugaaucuacucagcaaaguguuucugugacugguugguuacuuuguauucagaacucuuugaaugguaaggauaaacaccaaggcugacucuacucagugguucuuaaccuaugguaauauugccucuuccugccccuggagcauuuagcaaugacuggagacguuuuuuggguguuagaaccuguuguggggaguguuacugguaucuaguggguagaggccagggaugcugcucaauagccuguagugcguaggauagccccccacaacaguugugcagcuccaaugucaauaugucaguagugcugagguugagaaacccuagucuacacugucauuuuuuuuuuuuuuuuuugauacagagucucgcucugucacccaggcuggagugcaauggcgcgaucucagcucacugcagccuccaucucccaaguucaagugauucuccugcuucagccucccgaguagcugggacugcagucaugcaccaccacgccuggccaauuuuuuugaauuuucaguagagucaggguuccacuauaucggucaggcuggucucaaacucuuggcugcaaaugauccauccgccuuggccucccaaaguggugggauuacaggcgugagccauugcacccggcccacuucucaggaauccuaaacucuugggaggcugaggugggagaaucacuugaaccugggagguggagguugcagugagcaggaaugacgccacugcucaccagccugggcgacagagcaagaaucugucucaaaaaaaaaaaaaugcuuucuaauuauacaaagauuuucaacauuuucuacauacuugaacugaugagugauagaauauuaucaugagcuauuuacagcaaugaaguaguccccauuaucugaggggcauauauuguaaggcccccaguggaugccugaaacugcugauagcacugagcccuguauacacuacguugaucagugagaaggcuacuaaauaacuaaugggcaugguagcauauacaguguggauacucuggaaaagggaaugauucaugucccaggcaggauagcacaagauuucaucaugguacuaagaacugcguugcaaucuuaagacuuacgaauuguuuauuucuggaauuuuaaacauauguuguaaauucacauaaauacauaugaaugauagauguaacagugguccagcuguagcuuugugucugugcaaaaacaucacguuauccauauucauguaaguaauguaauacagcauuaacuguuguugcaguaugcagaauuagaccuuggaaaauaauugcuucucuaaagggacaaggcauguaaaguugccacuuacagauauuuuuaguacccuccccggagacuagaucuccagaguuuaagauuccugacaaguggaccgggcacgguggcucaugccuguaaucccagcacuuugagagucugagguggauagaucacuugaucgcacggugugcgauccaccccccucggccucccaaagugcugggauuacaugcaugagccaccacacccaguuagcacuugacccauuuuagugaugaaacugaaaacuagacaugcccaggaucacacagguuguuaguggcagggcuggaacaggaacuuguguuuugaguccuaaauuuguauauuuccacagguuacuucugagaguaagcaggugaaucugucccuuaggcaguuguacauuuagacuaaaugcaaguuagagaucugugaaguuguaucauccaaauagaggguaggccgggcgcgguggcucacgccuguaaucccaguacuuggggaggcugaggcggguggaucaccugaggucaggaguucgagaccagccuggccaagguggugaaacgccaccucuacuaaaaauacaaaaauuaggcguggugguggguaccuguaaucccagcuacuuaggaggcugaggcaggagaauugcuugaacccaggaggcagagguugcagugagaugauacugggaggcugaggugggaggauugccugagcccgguagguugaggcugcagugaaccaugauugcaccaccgcaccucuagccugugcaacagagugagacccagucuuaaaaaagguguaauauauaagcagcuccauuuaacuugcauuauugguguguacagcucaaaauaauucuucccuuacauaagcccaaacccaaggaucacugucagugaacaacaucuuuuuuuuuuuuugagacagggucuugcucuguuguccugauuguagugcagugguugacuuacugcaaccucugccucccagguucaagugauaccaaguagcugggauuacaggcgcguuaccaccaagccugguuaauuuucauauuuuuaguagagaugggguuucgccguguugcccaggcuggucucgaacuccugaucucaggugaucugccugccucaaccucccaaaagugcuaggauuauaggcgagaccucccaugccuggccaacaagaucuuuuuuaaucugguggguguugauaaucaugcuuauauuacuggugugaagagaaaugcagaaucaccccagcucuuccaacuaaacagagccugguucccuuccuuuauucuuggguaccgugcuacagggagaggaagagaugaguaaggacuuuucccccauagcuguccucaguagucuucagcuucucuugaagugcaguucacuguacacaacuguauacauucuucuuuuuuuuuuuuuuuuuugagauggagucucacucugucacccaggcuggagugcaauggcuuaaucucagcucaccgcaaccuccgccucccgggguucaagcgauucuccugccucagccucccgaguagcugggauuacaggcaugugccaccacgcccagcuaauuuuguauuuuuaguagagacagaguuucuccauguuggucaggguggucuugaacuccugacuucaggugauccacccaccuuggccuuccaguguugggauugacaggcaugagcccccaugcccagucucaacuguauacauucuuaucauuggauuaccccaucuuguaaccacguaacuuuaucuuccaugucuacugcucugacaaugccacuuggauccuuuggguuguagccuucaaccacauuaugguacaugucauucauucauuuuacaauaguuuauuggccgggugcgguggcucacgccuguaaucccagcacuuugggaggcugaggcagguggaucacaggguuaggaguucgagaccagccuggccaauauggugaaaccuucuaucuacuaaaaauacaaaaauuagccgggcauggaggugcaugccuguggucccagcugcucgggagucgcuugaacccgggaggcggagguugcgcugagccaagaucgcgccacugcacuccagccugggcaacagagcgagacuccgucucaaaaaaaaaaaacaaaaaaacaauagcuuauuguaugugcugugugucauuacauugauauugcucauuacauucacauugcucaguacgcuuuuuuuuaaaagacagaguuucgcucuguugcccaggcuagagugcaguggcgcaauguuggcucacagcaaccucugccucccggguucaagcgauucuccugcuucagucucccgaguagcugggauuacgggugccuaccaccacgcccagcuaauuuuuuauauuuuugguagagaugggguuucaccauguuggccaggguggucucgaacuccugaccucaagugaccugccugccucggccucccaaggugcugggauuacaggcaugggccaccgaggcuggccucgcucaguaaacuuuuaauagugaaauagauaaaacaaaaagaucugguaugaugaacuuaauuguaaaguccuggaagacuguuguguuggcugcuaggcuuggcuguauuugauggagccuccaaauaagugauuuaagcaagguagacauuuauuuuucuuucacacagaagugaaccaauauggcaguucugcuauacgaaaucugaccucucuuguuucuccagcauuccugggguguugcccucauaugccuggcccaagaugauucacucccacuuuuacaucuagccagcaagcagggggaaaaugccugaucuggaaguugugucuguuauuuccagucacuucccauuguucagaauuuagucaccuggucauauccuagcuauaaauuuggguuggaaauguguuucuucugggcaguuguaugcccagcuaaaaaucuauuauauagcaggagggagaaauuaauauugggggaacaaccagacaucucugccacaaucaagacuuuguuuuguauuucuuugagugcuacacaguacuuaacacuguggcuuaucccugaagucugaauaaauucuucucauuaguucuuuguaugaaagacugaaggucuuuggaucuuggauuuaccugcugcuggggcaauaagaacccuaagagauuauucacagaaguguuuccuuuuuaauccaggcaauaacaggaaagaaaaguauuaguauacauugauuacaaugauagcaugacauuuaaccuauauuuauaacuuguuuuccaauagucugcaaaaacuuaaaaaguaggaagaagccagccacaguggcuaucauccacauucacaguggccuaucaucccagcauucugggaggcugaggugagaggaucacuagagcccaggaguuugagacuaaugugggccacauaaugagacccccaucucuacaaaaaaauuaaaaaauuagccaggcaugguggcacacaccuguacugccagcuacucugguggcugaggugggaggauugcuugaacccaggaguuugaggcugcaguaagcuaggauugcaccacugcauuccagccugugugccagagcaaaauacugucuccaaaaaaaaaaaaagugcgaagaacccuucuguugcuaucugauacuauaaauguaaaaagugagcagcaauuccaguagcuugaaggggagagagucuugcagucaaacuguuuugucugcuuugccugccaugaucguguagccuucagugcugguuagacaaagucauuuuggaaccaucuuugugauuuuggccaugucugccugucaguacuaagcuuuacuuacuaugucuccuuaagucuacuuuaaauggacuucuuggcuggguacugugucgcugugauuuuggccaugucugccugucaguacuaagcuuuacuuaauaugucuccuuaagucgacuuuaaauugacuucuuggcuggguacggugucgcuguaaucccaacacuuugggagguugagacgaguggaucauuugagcucaggaguucaagacgggccugggcaacauggugaaacacugucucuccaaaaauacaaaaauuagcuggguguggugaugaaugccuguagucccagcuacuugggaggcugaggugggaggaugacuugggccggagaggcagagguugcagugaggcaagauugugccauugcacuccagccugaguuauagagccagaccuugucuuaaauaaauaaacagacuucuuaaacuuagcauccuucuaaagaauaauuuaucaaaauacagauuuguuguuuuaaaguauacauuaacaugcauaauuauuaaaauuacuauguccuuuuaacuaccuaaaaacaucuuuaauaccagugacacauacucuuagggaaauaguucuuuauucauuccuuacgccccacugguaguuuuuugugaacuucccauaaguccacagcuacuaaguggcucugaauuucuuucuuucuuucuuuuuuuuuuuuuuuuugagauagagucuugcucugaaaucuaggcuggagugcaguggcacggucuuggcucacugcagccuccaccgugcagguucaaguaauucuccugccucagccucuggaguagcugggauuacaggcacccaccaccacgcccggcuaauuuuuguauuuuuaguagagauggaguuucaccauguuggaccaggguggucucgaacuccugaccucaggugacacgccugccuuggcccccaaagugcugggauuacaggugugagccaccaugucuagccugaaugaauuuccuucuugcuuucuuuucacuuuuuuuuuuugagacggagugucacucuuuugcccaggcuggagugcaguggugcaaucucagcucaccacaaccuccaccuacuggguucaagcgauucuccugccucagccuccuaaguagcugggauuacaagcacgugccaccacaccgggcuaauuuuguauuuuuaguagagaugggguuucuccauguuggucaggcuggucuggaacucacaaccucaggugaucugcccgccucggccucccaaagugcugggauugcgcaggugagccagcacgcccggccccuugccuucucuucucuucucuucucuuuaagacagucucucgcuauauuggccaaguuggucuugaacuccuggccucaagcaauccugccaucucagcuucucuaagugcuaggauuacaggcguggaugcugugccuggccugaauuucaaauuaauuaguuaucuuugugcuuugguagggaaacucugguaaggaaaguauaauauaguuagugcuuaauuuugaacuauagaauuaauagcuucuaaaacuuuuugaguuauuacuagugauaugcaaaauacaaccaccuaaagaucuuuuugagcuuauaucuaggaccuguugggcaauaugcugaaccuucauaagccuucauuuccuucuuuuuuuuuuuuuuugagaccaagucucacucugccacccaggcuggagugcaguggcgcgaucacggcucacugcagcuucugccucccgguucaagcaauucuucucccucagccucuucaguagcugggaccacaggcgugcgacaccacgcauggcuaauuuuuuuuuuuuucuguauuuuuauagagacggggcuuuaccauguuggccaggcugguuuugaacuccugaccucaagugaucagcuugccuuggccucccaaagugcugagauuguaaaugugagccacugagccuggccauuuccuucuucuuaaaauggagcaguauuauuuacaucaaagaguuguucugaggauuaaauaauauauauauauguguauauauauaucuaaauaaagcuuagcaguggcaaacacuauuauugauagacauuguuuuauuuccacuuuuggacuguuuugaguaaagcugauaaugaacuuucuguuuuugagauagagucuugcaauauuguccagguuggucuugaacuccugggcccaaguaauccuccugccucagcucuccaaguagcugggacuauaugugcgagccaccaugcccagcucaacauucuuguauauauguuuuuugguggacauaggcauucauuucucuuagguguauaccuaggaguagaauugcuggaucacagauauauuuaauuuuuguagauacagccaaacaguuuuuugaaguggcuuuaguauuuugugcuccuaucagaaugugugagaauugcgguugcuucauacccugucccacaguugauauugucagucuuuaaauuuuagccauucugaugggcagguagugguaucuuauugugguuuuaauuuagauuucccuguuaaguaaugauauggaaguaccuuuuaauaggauuuguauaucuuuuucuuacaaagugccuguuauuuuuuucuuauggauugcuauguugaugcuggauguggguccuuuggaaacagauauugugaauacucuucccuagcccauggcuugcauuuuuacuuauugaagucuuuaagugaacaaaguuuuuaauuuuaaugaagucuguguugucauuuuauuuucuuuuauggauaguacuuuuuuucuuugagacagggucuuuuuuuuuuuaacaacauuuuauuuuauuuauuuuuuauuauuauuauacuuuaaguuuuaggguacaugugcacaaugugcagguuaguuacauauguauacauguuccaugcuggugugcugcacccauuaacuugagacagggucuuaucugucacccaggugggagugcaauggcaugaucucggcucacugcaaccucugccucccaguuucaaguuauucucgugccucagccucccgaguagcuaggacuuacaggugcgugccaccacacccagcuaauuuuuguauuuguugguagagaugggguuucgucauguuggccaggcuggucuugaacuccugaccucaagugauccacccaccucggcuucccaaagugcugggauuacaggggcgaaccacugugcccugcccuuuuaugguuaguauuuuuguguccguuuuuuguuuuguuuaguuuugucacccagguuggaguacagugguguggucauagcucacuguaaccucaaaccccugggcucaagcagucuuccugccucagccucccaaguagcuaggacuacagguauacaccacuacauauggcuaauuuuuuaaauuucauagcgcuggguuucaccguuucccaggcuagucugaaacuccuggccucaaguaaucuuucugcuuugguuucccaaagugcugugauuauaggcaugagccauugagccuggcccuguccccuguuuaagaaguuuuuguuuucccuauauucaaaaacauauuuuaaauauuugacacugauuuuuuuucucugcaugaacauagaugaugccauggagagcagcaagccugguccagugcagguuguuuugguucagaaagaucaacauuccuuugagcuagaugagaaagccuuggccagcauccucuugcaggaccacauccgagaucuugaugugguggugguuucaguggcuggugccuuccgaaagggcaaguccuucauucuggauuuuaugcuacgauacuuauauucucagguaagauagaauuauuuuauuucaaguaaaaagugagacuuuaauguccaaaaaagcgaaauaagcucauagauuauccuugaugcauaaaauuuuuaauuuaagauuuaauagaaauuucuuacuucuguagaaggaaaguggccauucaaauugguugggugacccagaagaaccguuaacaggauuuuccuggagagggggaucugauccagaaaccacugggauucaaaucuggagugaaguuuucacuguggagaagccaggugggaagaagguaaggaugaaaaugaccuuacagauuaacaacaacaacaacaaaauaugaacuucagcauguacuguguuaacccaauuaaaaaccuuuuaucaaagaauuuaaaauggguaaaguaagaaaaguuaaaaagucccuguuuuguccugaaauuuuagucuguuguggauaaauaggauuuucugacacagguaugcgaaguuguagcucugaugucuagcuguagucuccuuggucugcugauugcauuauuuuaauuuucuuuucuggaaaaacauuuuugcuaaaagcuauacagacuuuuuuguuuguaccuagcaguacuuuauguaguauuccuuagggcuauguagcauuuuuagacucaguuaaaaaauauuaaucuguugcugacucuguuaauuccuauuucaacauguguuuccuugaauaauucaggauacaacuuacuguguaugacagcuuuccuucacacacuauuuuuguggguguguguauauccaacuuggggagaauuuaaaaaacacauagcuuuuuaauuuguuugaaacagaccuucugccuguuacauuuugugcucuuaaccaauuaaagaagccaguggcagccgggugcuguggcucacgucuguaauaccaacacuuugggaggccagggugggcagaucacaaggucaggaguuugagaccagccuggccaacauagugaaacccugucucuacuaaaaauacaaaaaauuagcugggugugguggugggugccuguaaucccagcuacuugggaggcugaggcaggagaaacgcuugaacccgggaggcagagguugcagugagccgagaucacaccacuguccuccagcucgggcgacaguacgagacuccgucucaaaaaaaaaaaaaaaaagccaauggcauuuuuaguuucauauuguguuuuccacugguauauaccuguugauuuguuugugucuuuuaugaacuguuauuuucugaaauuuuuuuucaauaaaaggaaggaagaugugaaaacaacuuuuuaucaaagugaaugauuuaaaauuaauacauauugauuguuuuuaagauucuuaaauaaaaugcaugaauauaguuuaaaaggucagguacuacuguaaggcuucuaacagaaagcagcugucauguguguuauucuccucucuacccaguuuucacuucccagaggcugaugcucuuauguguuaccacuucuguucuuuacuuccuuacuccuguauggguggcacagaccuggcuguuguucugggaguugagcagggaaauggcauuggggaucucacuguucagaaggugggcauucacuauccccuagcuaucaguagggcuucuuagccccagucucaucuaugccuuguaagcuaugggcauagagccucuccacagauuucuuuguaaggaucgggagggguaagucauguguuucuuauacagacuuucauccauuacuucuguuuuuagcccaauccuauaagcaugccuucacaccuguuuguccuuuuuuuuuuuuuuuuuuugagauguagucucacucuguugcccaggcuggagugcaguggcaccaucuuggucacuacagucuccgccucccagguucaagcaauucuccugccucagccuccucauuagcugggaguacaggugcacaccaccaugccuggauaauuuuuguauuuuuaguagagacaggguuucacaauguuggccaggcuggucuggaacuccugaccucgugauccgccugucucagccucccaaagugcugggauuacaggggugagccaccacaccuggccaccuuugauauuuugaagugcuggaguguugguacugaauucuuuuagcuuucauacaucugaaaaaucuuuauuuugccuuuguuuuggaaaauauuuacucuuaguguagaguucuaggccaacguauuuuucucaguacuucaaagguguugccccuuugccuuuuugcugacauuguuucuuuuuuuuuuuuuugagagggagucucucuguugcucaggcuggagugcaguggugcgaucucggcucacuucaaccucugccucccggguucaagcaauucuccugucucagccuucugaguagcugggacuacaggcgcgcaccaccacgccuggcuaauuuuuguauuuuuaguagagacgggguuucgccauauuggucaggcuggucuugcacuccugaccucagguuauucaccugccucuguuucccaaagugcugggauuacaagcaugagccacugugcccagucugcugacauuguuucugacaagaaauacacuguuauucuuauuuuuguucuuuuguaccuaaucugucuuuuuugucugguugcuuuuuucuuuaaauuaaaaaaaauuuuauuuucguggguacauagguauauauauuuauaggguaugucugguugcuuuuaagauuuuaucacuguuuuugagcaaauuauuauguguuuugauguaguucuuuuuuuuuuuuugagacggagucucacugugucgcccaggcuggagugcaguggcgugaucucggcucacugcaagcuccgccucccggguucacgccauucuccugccucagccucccaaggagcugggacuacaggcgccuaccaccacgcccggcuaaguuuuuguauuuuuaguagagacgggguuucacuguguuagccaggauggucucgaucuccugaccucgugaucugcccgccuuggccucccaaagugcugggauuauaggcgugagccacugcgccaggcugauguaguucauguuauuuguauguggguuuuguugagcuucuugaaucugcagauuuauaauguuuaucaaauuuggacauuuuaagguuauuauuucuucaaguuuuuuuggucuguuacucccuuuggagacuccuauuacaugugccucuugcugcuugaaguuguuccacaagauguucauuuaaaauucuuuggccggcgcgguggcgcacgucuguaaucucacacuuugggaggccgagguggguggaucaccugaagucaggaguuugagacuagccugaccaacauggugaaaacccaucucuacuaaauacaaaaaauuagcugggugugaugggucaugccuguaaucccagcuacuugggaggcugaggugggagaaucgcuggaacccgggagguggagguugcagugagccgagaucgcaccauugcacuuccgccugggcaacaagagcuaaacuccaucuaaaaaaaaaaaaaaaggccagaugcgguggcucacgccuguauucccagcacuuugggaggcuggggugggcggaucaccugaggucaggaguucgagaccagccuggccaacauggugaugcccuguugcuacuaaaaauacaaacauuagcugggcgugguggcgcccaccuguaaucucagcuacuugggaggcagaggcaggagaauugcuggaaccugggcggcggagauugcagugggauuaggaagaguacucagucuugccucaguaaugaggaauaacaacacucugguuccauuuaacaaaucuaaacagcaagaacagaaaaaaccagaguuuccaaauuacuuaacuacaucucagaauaaagcuagauauuuuauaggaaugcaaaaauaaccagcacccaacaagggaaaauccacaagucuacauccuaucaaaaauuugcagacauaaaagaagcagaaaaauauaacccaaaugaggagaaaaaucaaucaaaacugucucagaacuaacacagauauuaaaauuaacagaaaacaacuuuuuuuuuuuuuuuuagacagucuugcucaacuaaaaauacaaaaauuagccggguaugguggugugcaccuguaaucccagcuacucaggaggcugaggcaggagaaucgcuugaaccugggagguggagguuguggugagccgagguugcgccauugcacuccagccugggugacgagcaaaacucugucucaaaaaaaaaaaaaaaauaggccagacaugguggcuuaggccuguaaucccagcacuuugggaggccgagguggguggaucaucugaggucaggaguucaagacgagucugaccaacguggugaaacccugucucuacuaaaaauacaaaaauuagccgggcaugguggcucaugccuguaaucccagcuacucgggaggcugaggcaggagaaucgcuuggaccugggagguggagguugcagugagccaagaucgugccauuguacuccaaccugggcaacagagugaaacuccguaaucccagcacugugggaggcugaggcgggcggaucaugaggucaggagaucgagaccauccuggcuaacacagugaaaccccgucucuacuaaaaauacaaaaauuagcugggcgugguggcgggcgucuauagucccagcuauuugggaggcugaggcaggagaauggcgugaaccugggaggcggagcuugcagugagccgagaucgcgccacugcacuccagccuggccacagcgcaagacuccgucucaaaaaaaaaaaaaaaacaaauuguaucuuuauuuuguuuuagguuuucaggaaaauuaauugcaaccugcccaguucccacauucuccuucaguuugcucuguuguuuacaucuuguaauagugugauacauuuguuacaauuaauauuugaaccaauauauugucauuagcuaaaacccauacauaguuuacuuuagggcucacucauuguguuguacauuggauuuugacaacuguauagugacacaugcccacuauuacuguaucauacggaauagucacacugcccuaaacauucucuguaauguaccuaucuguuccucucuucccuccccacaaacuccuccacugaucuuuuuacugucuccauaguuucgccuuuaccagaaugucauauaguuagaaucauacaauaugcagccuuuucagauuggccucuuucacuuagcaaugcaauuuuaagauuucugcaacucuuucgugucuugauaguucauuucuuuuuauugcugaauaguauucuacauuaugaaggcaccaguuuguucauccauuugccuguugaaggacaucuugguugcuuucaaauuuugacaauuaagaauaaagcuccuauaaauacucauguguugguuuuuguugagacauaaguuuucagcuccuuuggguauauaccaaagaguuuugguuuuuuuuuuuugggacaaaaucucgcucucucacccaggcuggaguacaguaguguggucucggcucacugcaaccucugccuccaggguucaagugauucuccugccucaaccucuggaguaggugggacuacaggugugcaccaccacgcccauuuuuuuuguauuuuuaguagagacgggauuuugccauguuagccgggcuggucucgaacucuggaccucaggugauccaccugccuuggccucccaaaguacugggauuacaggugugagccacugcgccuggccuaauuuuuguauuuuugguagagacacgauuucaccguguuggccaggcuggucuggaacuccuggccucaagugauccaccugacuuugccucccucccgaagugcugggauuacaggcaugagccauugcgccugaccuaauuuuuuaaauuuuauguagagacugggucucacuauguugcccaggcugguauugaacugggcucaagugcugcugcugccacggccucccaaacuguugguauuauaggugugagccacugcaccuggccaagaugaauauuuuuuaguuucuuuuucaacaacaggaaacauccaaaugccuggcugggugauaagcuaauugcuuucaacuuuugucuguuucaauugguggggcaauuuuugccuuccauauugcucuguauaacgcuggauaaucuucaguagagugcuguagucaaagcaaagcaccuaaauaguuguacagaaccuacaagcaggugcuuaaggcucacauaaacauuaccuguacuuaaguauauauuaccuguacuuuucaauuucuccuuuacgguuuccuccuucuuaguuuaaucucuuuuguuuguauuuuccuuuuuuuuagguugcaguuguucugauggauacccagggggcauuugacagccagucaacugugaaagacugugcuaccaucuuugcucuaagcacuaugacuaguucuguucagguaaaaaccacuugacucagaaaaaagcucgcaaaggaaauaagauaaagggaggaaauacaguuuugguuauuguucuguuaacagaauuucuaggaugauauguaaauauuauuuuuaaacuguagaugcaguuaaacuuuuaaaaguuugagaaggagccaaagaauuuuuccucuuuggucauaauuauauauaauauguuccaagaaaaguccaaaaaauggaaauuuauuauaucauauagaaaauacagauuugauaagagcuuaggaaaacuguuuuaaacuguaaaggaggaauuuuugauuucaaucuuaugugcauaguuuuccaaaagacagaucauauugcuguuugaacaggccucauguucuuauaugcaagucuuuaauuguucaaagcuucugucagcccuuuaggcuuauuugggauuuguuugaaguaagccagaguaguaucaaucuggauuuuuguuuucuagauuuauaauuuaucucagaacauucaagaagaugaucuucaacagcugcagguauauauuucucauaacaauuuuaacaucauauuauuuaaaaguuuuaagauuaaggaacauuuuacaacugaguaguuuuuagcaaaagauugaaauguagaggaagguuuuugguucauaguaauucuauacuauguauagccauuggugggguggagcaggaguggucggggaaggccuuaaugauuugagcagagaaugaaagaaagugggcaagugaguccuucagauacauuugggcggaaaacuauuacaggagaggagcagcugcuggaagacagacccugaggggagugugcuuggcaagaucaaggaauggcagggaggccgguggguaggauuggagagugugacaggaagggguuaagugaugaagucagagaggcagugaggucccacucauucugggucuuuuccucuggggaaggugggagccaugggagggucgucagcaaugauguuaucugaccuguuguaaagggaucauucuggcugcuauguucagaauagacuuuuuuuuuuuuuuuaagacgaagucuugcucuuguccccaggcuggagugcaaugaugcaaucuuggcucacugcaagcugggauuacaggugugcgccaccaugcccggcuacuuuuuguauuuuuaauagagacgggguuucaccaugucgguccggcuggucucaaauuguugaccucgugauccgccugccucggccucccaaagugcugggauuacaggcaugagccaccgcgcccggccuuuuucuucucuuuuuuuauagcagcaggucuuaucuguuuuucccacaaaaugcucuuuugugaguauuccaggguuggaugcaauucugguauguuacucuaaugcuacuucucccacugacauucaagaaagcaucagaaugugagugaguaagggugucauuauuauagggauuaccuugaauuaguucuauuuuauguuuauuuuaaaaaacaaggaaaauuccuccuaaaccucgauccuuaauguugcuuauggcaauugucuguacuucauaauugguaguucuguaccagugccauggcuuagugguugagagcuguugcucuguaaaacuucgaucacaacuugaguuggucaccauuucaccugaaauuuauuccuuucuaagcuccuuccuuucaaccauuuuucgaaugcuuaccuugugugagguagagggccaagugcuauagauauauguaaggucacauucacagguaccaggugcgaggacuuuagcauauuuuucuucaggacacaauucaacccauaagaaguaguaaguagauuaugaugcaguuauguaauucaccuugucucacaugacaaggcuguugguagacucagcaacuguaaaauauaaauauuacagaggagaaaguaauauguuugugugccuggaaauccguaagaaugaacuagaaaauuauuuggaacuuaaaaaauaauuaaggucuccauuacaaaauacagauacaaaaucauuagguuuuccucucuacuaacaauaaccaguuuaaaaauguaauggaaaaaauugacuuuagcaacaaaauauugaaaacagaauaaacuuaaaaaagaucuauauggagcacuucagaauuguaugaggcauauaaaagauuuaacaugcagaaauaugccuuguuucuuccauauggggaugauaauagccaacguguauuuauugcuuacucuguacuagauacugcgguguguuauaaacauuaucucauuuagaaugagaauuauaaacuugucaguucuuccccacuaaacaaaaucauaaaggcauuauuuugggaacuugacagaauuguugugaaauucauuuggaaaguuaaauuguaaaacagccaaaaaaaaaaauuacaggggaaauaugagauaauugacuuaguacauauuauaaaucuguaauuacaagaacauggcauuguuucaggaaaaaauagaucaaugcaguguacuuacgauauacuacauuuucauauauuuuauucuacuuaagaauauauacacauauaccauaaagcauagaucagucaauaaaugguguuaggacaguuggcuauguauuuagauaaauuagaaauuauauuccucuugggaaugcugaggcaggcugaucaccugaguuuggguguucgagaccagucuggccaacauggugaaacccugucucuacugaaaguacaaaaaaaaaaauuagcugggugcgguggcaaaugccuguaaucgcagcuacucgggaggcugaggccugagaaucacuugaaccugggaggcaaagguugaagugagcugagagcacaccacugcacuccagucugggcaacagagugagacucugucuuuaaaaaaaaaaaaagaaaauaaaauuauauuucuaccuuguacuauauacaaaaauuccagauagaccagauagauuaaauauuuugauguaaaaaaagaaaucacagcuggguguggugggucaugcguguaaucccagcacuuugggaggcugaggcaggugaaucaugaggucaggaguucgagaacagccuggcaaacauggugaaaccccgucucuacuaaaaauacaaaaauuagcuggguguugauguucaugcagagccuucugauuaaacacauuaauauuucuucagugaaauauauaaccaauaaaaugggguaaauaagccuauaaaaagcuucaugucaguugaaggcagguuuuguuuccaaauaaguuuccccccuaaccuggauuuuuaguacuuuuuuuauuuuuuuugagauggagucucccucaguugcccaggcuggagugcaguggcacgaucuuggcucacucacugcaaucuccgccucccaaguucaagugauucugcugccuuagccuccugaguagcugggacugcaggugcgugccaccacacccggcuaauuuuuuuuguacuuuuaguagagacaggguuucacuauguuggucagagugaccucaaauuccuaaccugaaaugaucugccugccucagccuccuaaagugccaggauuacagaugugagccgccgugccuggccuuuuuguuuuuuugcuuuuuuuuuuuagagacagagucucacucugcugccuaggcuggagugcaguggugcgaucucggcucacugcaaccuccaccucccggacucaagcaauucuccugccucagccuccugagaagcugggauuacaggcaugugccaccaugcccagcuaauuuuuguauuuuuaguagagacaggguuucgccauguuggccaggcuggucucgaacuccugaccucaagugaucucccugccuuggccucccaaagugcugggauuagagcggccagcccugcuaagaggcuuuucucaaaugucuagcuggugguccuugacuaccuauuuaagagagagccacuaacaauccaacugggagcuuugauaagaggauaggccuuguguacugguuuggaucacaaugagguaggugguuuggcaagguuaucuagcuauuuuguugccaacuccuaaaugucuauuuuuuuugcagauauuuauucuuggguuguuaguuucccuggaaaaaauuucuuuaaauuccugccuugguggguagaagcuugcuguggcaaccaguagggugagagggcuaaggagucccacugcucacuauguggacuuugauuuaaguaccuguuugaagguaggagacuuacuccuaaccucagcugaguuugguaucuaagucuagauuuuuuuuuggauuuaucuucuccagauaguacacuucccaucuucuauggaggcaggaaaaauacggcaguuagagaggggugccuggaaguguagguacuuucuccuaagacucacauauuuccuaguugucagcuggacuccuacaccuccuccuguaagguaacuguaugcuuauaauuucugagcauuucagggauuucuacugagauaauuugcuucuuccuuguuggccccugucucuuccagauuucuuagcagaacagagaaagccaaaacuugagacaguucucauuugucuauuuuccauccagaauguuuuugacagggcuuuucugcuggcugcuuuguccuguuuauuuauuuacuuuuaaaguuuguuuuguuaugcuuuuagugaggcuuccugaagauuuagagguaaauauacauguaaaccuuaaccuuaaagaauucagucauuugaaugacauaaauauuaugggccuaauacuuuucuugcugcuggaaauccaguagugcacaaaacagacaaauauuccugcccucauggaguuuaaaugcuaguauaaagacagaugcaaaucaaaucaagaagagguauaguauauuagauaaugauaaauguuaagaaaaaaacuuuuaagacugggugugguggcucacgccuguaaucccagcacuuuggaaggccgaggcagguggaucaccugaggucaggaguucaagaccagccugaccaacauggagaaaccccgucucuacuaaaaauacaaaauuagccaggugugguggcacaugccuguaaucccagcuaccugggaggcugaggcaggagaaucgcuugaacccgggaggcggagguugcgaugagccacgcgccauuacgcuccagccugggcaacaagagcacaacucugucucaaaaaaaaaaauuuuuuuuuaaagacacgaaguaggaaauauuauuggcaaacuuguaaucuuuuucgguagauggccauggaagucuucacugagaaggagcuauuugaaagaccuuaagaagugagggagcagaucaugaggaaauuugggagaagaacuuauaguuagugggaggagccaguacgaagguccuaaggcagcggugugccccguguauuugaagaacaggaaggagggccaguguggcugcaucacacuguaaggacuggcuuuaauacugaaugagguugugggguuuugagcaaagccauuauaugaucuaacuaaccauauuauaaaagagucaauguggcugcuguguugagaauagcccauagggaggcaugggcugaggcaguuaggaggcuauugcaguauuccaagccacauggaaauagugaguggcuggauucuggauuuguugaugaauugggaugugggaugugagcagggaauaaccaagaugauuuuaagguucaugacuccugugggcuuuugaaacuguagaagucugguaucaguauaaauauaaugaauacuuugcuaaaaaggccauagaacuauuuuaaguaauuuugcuuuacaaaccauaaugcuucuuuuuuaaagcucuucacagaauacggucgucuggcaauggaugaaauuuuccaaaagccuuuccagguuagaauauuuauuuuaaauauaauucauaccuuuguuuuuguuuucacagauuggcaaacuacagcucauaggccaaaucuagcuugccaccuguuuuuauaugacuugugagcuaagaaugguuuuuacauuuuuaaaugguugaaaaaaaugagcaguacuauuuuaugacacguaaauuaccugaaauucaagugucauugucuguagguaaaauuuuaguguaacacagccaugcucauuugucuuuguacugucugugacggcuuuccugcuacaacggcagaguaaucgcuuaaaaaguaagcucuguggguugggcgugguagcuuacaccuguaaucccagcacuuuggggagacccagguggaagaauugcuagagcccaggaguuugagaccagccugggcaacauagcaagacaucucuuaaaaaaauggggguagguacaguggcucaugccuguaaucccagcacuuugggaggccaaagcaggcagaucaccugaggucaagaguucgagaccagcuuggccaacauggaaccugucucuacuaaaaauacaaaaaucagcugggcgugguggugggugccuguaaucuuagcuacucaggaggcuaaggcaggagagucgcucgagccugguaggugaagguuacagugagccgaggucaugccacuauacuccagccugggcgacagagcaagacuuugucucaaaaaaaaagaaaaaaacaaaaauaaaauaaaauaaaaaggucgugcacgccuguagucccagcuacucggugggguugagguaggaggaucacuuaagccuaggaggucaaggcugcagugagccaugauugugccacugcacuccagccuggguaacaaagcaagaccgucucaacacaaacacacacauacacacucacucacucucugucucucucugucucucucucucucucucucucugcaaaaagucuuugcugaccuaugccucaguucaguguuucuugagaaugaggaagcacagcagccucagucaaugggauuagaggugcuuucaguguguaagccuuauuucuuuucuuuucuaauuuauuuuuuuuuuuugagauggaguuucuuucuaaaauuuugcccaggcuggagugcaguagcaugaucuuggcucacugcaaccucugccucccagguucaagcaauucuccuuccucacccuccugaguagcugggauuucaggcgcccggcuaauuuuuuguauuuuuuguagagaugggguuucaucauguugaccggcuggucucaaacuccugagcucaggugacccaccugcuucggccucccagaguaaagggauuauaggcaugagccacgguggcuggccuuccuuucuaaugcugaaaacagaccugauuuuuuucuuuuuuggagacagagucucgcucugucacccaggcuggagugcaguggcgugaucucgccucacugcaaccuccuccuccuggguucaagugauucuccugccucagccucccaaguagcugggauacaggcgugagccacugugcccggccacagaucugauuuuaugauuagcuggugccaugugguuuucucuuuuguccuuuacuguauuccccauagauuucuuuaaggcagagucccaaauuuaccauuuucucauuaaugucuuccuucuguuccuacuaaccugugggaacaaaaauagcagauaggauauauugaccucauauuuggcuuaaacaugucccuccaguguuuguaaaacuucuaagacauuacagaauagauaaaucuggccgggugugguggcucacaccuguaaucccagcacuuugggaggccaaggccacaggauugcuugaggccuagaguucaagaccagccugggcaacagagcaagaccuugucuauauaaaaaaauuaaaaaauaagccaggaguaguggcaugugcuuguagucccggcuacuugggaggcugaggugaaaggaucacuugagcccaggaauucuaggcuacagugagcuaugaucaugccacugcacucuagccuuagugacggagcaaggcccaaucucuuuaaaaaaaaaaaaaaaaaaaaaagguaaauccuucuacuuuacccccuuuguagaagcuggcauuaugcaaagauguauugcaguuguucucuugaaaauguguuuaugcauguuaaaauauguuccgcucuuuucuuaaauagacacugauguuuuugguuagagauuggaguuucccuuaugaauauagcuauggacuccaaggaggaauggcauuuuuggauaagcguuuacagguaagugggacuauaaucuucugaugaauuaucucaaaguagugauagcuuucucauuugcuuuuggcuauuguguuuaaagcaauuauugaaaaugauauugaauacauuaacuauauaugaaucuuaacacaagcuaauauuuauucuugacaagauuaaagaaccuguauauacaguacacaggaacuguagaagaaaacucugggccagugcccaagcuuugauuauaauuuccauuuuacauuuuaaaccaaguucuauaugugucuuuagaaaucauacucagaauuuuaguuauguuauucuucaaaauuuuuacuuauuuugggauagauauaaacaggccuaaccuguucccccaaaccaaaacacaggaauccuuugucugucacuacuaauugguuagauccuccuucauccccacaaaccaucucuuguguaauacucauuuuaaugaaacucuuaugcaccuguuugcuagcuauaggagucaagccguagguaaucagauuuguguguuuauugcuucuuaggguucugaguuuucucauuuggccacuaugauccaucagaguugaggagucuucuuuccuuuguccuuauacuaguugucccuagugaagaaaaccaaaugacuuuugguugguaaauucuuggucuucauuggcaggugaaggaacaucaacaugaagaaauucagaauguucgaaaucacauucacucauguuucuccgaugucaccugcuuucucuuaccacauccaggacuccagguggccacaagcccugacuuugaugggaaauuaaaagguguguuccagguguuauuuuaaaccugugauucgaucuuuggaauuaaaaauaaugaaucacuuacaaaucaagugaaugcuuaagaaaaaugguaugcucucuuagaaagaguaguauuuaaagucuaguucagauuuugcuccugacuuacugagaccaucagaauuaguuuaccuugacuucuccaccugaaauggugguguucauauccauuaguagucuuucuaaagagacucauuaugguucuugguuuacaagagauacaaaugcuaaauaaaggaagacuaaacauuagucagcuaauauuaaguaaaauuaacuuccuaagggaaggcagcaugaugcauggcagagcuauuauuuucaucuuauuugugauuauagcaaaaccugacgcugggucaugugcuaauaucaggaagugcuaacuaaaugguaggugagaggaaucguaguugggacucuugggcuccauuaucuuaucuuuguuccuuuuucauuaaggccuugagucauuaaauggcuagcccuuaauuuauacauguguuaaacugagcacuuguuaauaagcuuauccgagucucucagauuccugguaauguuugcaacacuaugcuagguacuuugauauuuaugcucccaguaauuccaaugacuuugaugucauuuccuuuaucuuauaugugaggaaaauggcaaaaauaguuaaggaaaaggaggaaaguuaaguaacuugcucaaagugcucagcuaguuaaguaaguggugaggcguagaucuacauccaaguucuuguugcuccaaacccauacugggcuaaaauagggguucuucuguuauauggaggaaaucauuuagaggauauguacuguuuaguuacuacuaaaagguuuugaagugaaugguuuucauagccucauauuaaauauaaaaugcaucauuuccaaccuauuugauuuaguugauccaagaaaaugaauguucaacucaagauuuucauucuagcuggucuuaauauugcaaagaaacugaguuaaagagacuuaaccuuuaccuuuuauuugucacuucucugauacuuuuacgugauugacagcuuuccugaggaggagacuucccuggccuguuucauggcaauugaaaaaucuaagauuauugcuuggggagagaaauccgcuuggcaagcaguggaccuagaaccuuuuaccugaaaagcaguuucaagggaguuuucagagcugaguagggagagaaaguuaaguguguauguguaugucucuagguaauauauuguuuaggauuauaaugcuccauuauugguuguacuuuucccaaccugaacucagauuuguucaucacugauagggaauguguccaguggaauucuuaaauggagguguuaggagagggugaauuagagugacuccuagugauuauccaguauaaacacacacacauggcauucuuccauaguuucaguuuuaguauuccaaugcauugcuuuaaaguucauuuucauuuuuaucauucagggaguaggcagaguuuuuuaaaguucaguaacccuggcuuuugaaauuugugucacuuuugguuguauuaauuuccuguggcugccuuuaaccaauuaccacaaacuagguggcuuaagacaacggaaauuuauucccccgcaagucagggagccagaaguccaaaaugaugguugguuccgcccggagacucugaaggagaaccugucccacacucucuccuagcaucuggaaguugccagcaguccuuggcauucuuugacuuguaccuuuaguugccuccagguucuuuguugucacaugaccgccuucuuuguguguucugucuuuuucuugugagcacaccagucuuuggauuuagggcccaccuuaauccaguaugaccuccuuucagcuaauuacauuugcaagacuguuuccaaauaagauuuucugaaguuccagguggacaugcauuuuguuggggagggggaugcuguucaacucacuauacauauauguagauuaugaaugguuuaaucacuaaauauuaagcgugucaaguuucauauauaacauuuauaaaauagggaacaaauucuguaugagcaaucuuuagucucauaauuauguacuauuugguuuccucaucaagauagagcuauauaaaaugcacugguaagucuuaaaucuuccuuucuuacaugaaaaggcaaguccaaaaagaagaaauacaaauggucauuauauauuaaugaaaauaugugcagcaucacaauaaucaggaaagcacaaaagcauugguaauaaaugaucaucuuuaugaauuguaacguggcagcaucagaauucagaauguucacguccuuugauccacuaucccacuucuaggaguuuauccuaaggaacuauuuaaauaaguggauaaaaauauguauacuggcugggugcaguggcucacgccuguaaucccagcacuuugggaggccaagguggacgaaucaccugaggucaggaguuugagaccagccuggccaacauggugaaacccugucucugcuaaaacaaaaauuagccaggcaugguggcaggugccuguaaucccagcuacuugggaggcugaggcaggagaaucgccugaaucugggaggcagagguugcagugagccgagauugcgccauugcacuccagccugggcgacaagagcaaaacccugucucaaaaaaaaaaaaaaaaaaaaaaaaaaagauacuaugguagcauuauuaucauagagaauaacuggaaacaacacaaaugugucuuuauguggaguugguuagauuaugguacaucucagccucggcaacauagggagaucccccccaucgcuaaaaaaaaaaaaauacuagcuggacaugguggcacaccccuguggucccagcuacucagaaggcugagguaggaggauugcuugagccccagacgucaaggcuacagugagcugugauugcaccaccgcacucuagccugggugacagagugagacccugucucaaaaaaacaaaaacaaaaacaaaaauuaagguacaucugcagaaaggaauaaaaugcagucauuaaaaaggauaagguagaggccgggugcgguagcucacgcuuguaaucccaguuugggaggccgaggcaggcagaucaccugaggucgggaguuccagaccagccugaccaacauggagaaaccccaucgcuacuaaaaauacaaaauuagcugggcauggugacacaugccuguaaucccagcuacuugggugacugaggcaggagaauuacuugaacccgggagguggagguugcagugagcugagaucgcgccauuguacuccagccugggcaacaagagcgaaacucugucccaaaaaaaaaaagauaagguagauaguugaaucugugugucuuuauacagaaagauguuugugauauauuauuaaaugcagaaagauaguggaguagcauaugugguaugauccuauuuauuuaaaaaaaauaaguacuuuaaaauuuguaugcauucauguauguauguauguauuuauuuauuuauuuuagagacagggucuugcucuguugcccaggauggagugcaguggcgugauuguagcucacuguagccucuaacucccagucucaagcaauccucccaccuuagccuccucaguagcugggacuacaggcaugcaccacuaugccuggcuaaucuuuuuauuuuuuuguagagacagggucucccuauguugcccaggcuggucucgaacuccugaccucaagugauccucccaccuuccacuucagcuucucaaaguguugggauuacuggcuugagccaccacgcccagccaguacuuucuuaaguggaaagauuugaaaaacaaaaauuugcuuuuuugccuaacuuuaaaaauauguuaaaagccugcccucuguguuuauuuaaggaacuacaauuauuaugaggauuguucaugaagaauucuuacuagcucugcaaagguuuauguacauuuuagauuuggagauggauauuuuuuaauuuuagggaaccacuuaaccaagauuuugaaggguuuugagugaagaguaaauuggaugcuaaauugcaaauagcgggugauuuguauuuggcaagugcuagcuugagaaccacacacaguuuauuguaggagaccuguuaguagaacuaacguaguuuucagaauuuaaaaaaaaggguaggcauuauauuuucucaaauauauacuugugcaguuccaugguugagauucugcaguccuguucuguguaacuuggaaaagacauuagccugagguuguuagggcuaauccauaaaaggaacuuaaaguguaauuuuuguagaacauuuaaauuucauaagaacuacauucugaaacuauuucugcaaauguucccccagauacuuuaggaauuauuuuagugguuuuauuuuauuuuuaaagaucaaccacuuauuuagagguagaugccugccaaacaugaucuuaguuuugguauaacugaugcugagcugcuguuucuugaaguaauuagcuagaauagcugcugaguuuuuuuuuuuuuguuuuguuuuguuuuuugagacaaagucuugucuacacucuguugcccaggcuggagugcaguggugcgaucucagcucacugccaccuccgccucccgggcucaagcgauucuugugccacauccucccgaguagcugggauuacaggagugcgcuaccaugccuggguaauuuuuguguuuuuaguagaaacgggguuucaccauguuggccaggcuggucuugaacuccuggccucaagcaaucugcccaccuuggccucccaaggugcugggauuacaggugcgggccaccacgcuaggccuagaauagcugcuuuuugagaauacuuuucaucagaugcaagaugacuguguugucagcauaaagaaaauuguuaucuuccuacuuacugucacagggagaccuaauacaguaacuacugaguuguuuaguuggaaauuaacacaggaggcuuuguagggcacagucuucuuugacaccacuaaagauugaguuuguuucuguuaugagauaguucuugucuauucuaauuuuaaaacuauuauuuugguguagccuucauagaaacaugaguagcauauagggucuguacagcuuguuaaagugacaaguguagcaucuggauccugcugcuacuugugugagguauuuuuugaaacacuccaucuuucagugugauggaaauugaaaccauacaaaaagguuuuuuggauauguaauacauucacauguuuaaaauuuuaaaaaggauuaaaaaguacucagugaaaagucucucuuccauuuuuguagucuuucagaguuucuuuaguauaugaaagcaaaugugaauguguacagaauggccuguuauguauacuuuuauacuuuuucacugcaagguuauaaaguauuuuucccaugcuuucuugaaauuuuaguuucauuuuucauauuauagucugguugguggaguauuaaagaguucuuauuugaugugggcuccuaccugcuuuuuuucaguguauagcugggaacccaggaagauguuagaagauuauguaaaucagcuuuucuguauuuuaauucuccugugucuucauaguuggaccagcuaauaauucuuacuuugaggaaagagcucuauuuaauggcuguacugaucccucugugggaaccuuguagaagcugcagagaaucugucaccuuucuugaguuaguggucuuuucauuuuggggugguuccgagggucucugaggagauaauagaaaauaaauauaaugaggcacagguacuucuacuucuuuuaacauuaaaaaaauuaacaagaauaaaucaaugaccagugauuucuaauugauuuaaaggaguaguagugugagggcauggcaaaggccugagacaacuugagagguugaaaauugacuuguugaagacccuguuaaugaaauucuuuuuuuuuuuuucugagauggagucucacucuguugcccaggcuggagugcaguggugcgaucucggcucacugcaaccucugccuuccggguucaagcuauucucugcuucagccucccgaguagcugggauuacaggugcccgccaccacccccggcuaauuuuuguauguuuaguagagacgggguuucaccaucuuggccagacuggucuggaacuccugaccucgugauccacccgccuugaccucccaaagugcugggauuacaggcgugagccaccacgcacggccaucaaauucuuuaaaaagugaaauuucuugaaaggcuagggaguagaccagauaucccagaaugaaaaccaagguaaagauauucugcauauauaguauucuauuuugaacuagagaagacuuucuacuacaguggggaaggagaaaaaugaagguacauugggacagagaucugucagcaacuuggucauagccagaaagugucaaaacauagucucagaccccuucuucucucccacuuuuuuuuuuuuuuucuugagauggaguuucacucuuguuucccagccuggagugcaauggugcaaucuuggcucacugcaaccuccuccuccuggguucaagagauucuccugccucagccuccugaguagcuaggauuacaggcaccugccaccacgccuggcuaguuuuucuauuuuuaguagagacgggguuucaccauguuggucaggcuggucucgaacuccugaccuuaggcaauccaccugccucggccucccaaagugcuaggauuauaggcgugagccaccgugcccggcuucucucucacuuuuaacaaccaauguuaaaagcacuagacugggaagacugcauuguguguucaccuugguugaauaaggcuguuuggcuuauuuuucccuucuuugucguccugugaacagauauugcuggugaauucaaagagcaguuacaggcacugauaccguauguauuaaacccaucuaaguuaauggaaaaggagaucaauggcucaaaggucaccugucggggacuacuggaguauuuuaagguaaauauggguuuuaguuauuaaaauguuugauuuuugguaaagcugaucucacucguaaaucaacuugaauuuaaauauuuugaaacuuaaaaauuuucugggggagauggugagaggcauuuucagagaccuugguguccuuccaggagugggccauuggguggcaguaucggucuaagaaccaaauggauguucuuugcacucucuuagaggagcaauuagcugugacuaaaggaagauuguuccucaaggaagaugguguggacaggaggugguuaggaaguugcugugaguaggaggagacggcaccuagaugugacacgacuaccucaaggcggauggucacucugcccacagguaguggugaggccagcgugcauggggagcuggaugggaauccuagccucuguaggcuugugcugcuugagaacauuuuuaguuaacuaaaaaugcuaacaugcacucaaaggugugugguguguuuuugcuaauuccugguuguugaccuaagucuuuaggaaaaugcaguuguauggucacuuucuaaaaauuaaauaugaguaagauaugacugaauaacauuuuauagcaguuuuuauguuuauauuuuaaggcauauauuaaaauuuaucaaggagaagaucugccucaccccaaguccaugcuucagguaaacaaugauuugacauccuaaacgcuacccuuaaauuacuugaguugaccuguauacaauaagcagaguucuuuaggaagagaaugcacuuuuucuccuuuuucaucaugcugaggucuguuaauuuuuuuuuagcacauuuugcaguaguguggcgaccuuuucuaguucacuuguuuguauucauggugguacaguuaaaacgaaauggccucuccucacugggccuagucuuuucaccaaacacacuuugggaagcacaguuuauuauacgugguugaaacauacccaccauguuagacaagcaaguucuugucaucuguuguuuauuuuuuuuauuuuuauauaauuucuaauuuauuauuuuuuugagacaagagucucacucuugccaaggcuggagugcaguggcacaaucuuggcucaccgcaaccuccaccuccuggguucaagugauucuuauaccucagccucccgaguagcugggauuauaggcauguaccaccaugccuggcuaauuuuuguauuuuuuaauagagaucgguuuagccauguugcccaggcuggucuccaacuccuggacucaagcaauccgaccgucuuggccucccaaagugcugggauuauaggggugagccaccaugccuggcuauaauuuuuuuaauuaaaagaaaaaaauagggauguggucuugcugugucgcccaggcuggucucaaacuuggcucaagcgaugugccugccucagcuucccgaagugcuaagauuacagguguaagccacugugccugaccuguuauuuacuuuaguggaacauguccugacacaccuguuuacuauucacuaaucagguuuuuaauuugcaacuagaaugucauuugguuaaaacauaauuuuugacuuucauauguugaacauaaggggauuuauugccaaguguugauuuauuuuguagcagaaaauuuucauaaagggagcuagagccugggauugacauugcaaauaauuuuuuccuuuuuuuuuuugagguggaaucuugcucuguugcccaggcuggagugcaguggcacaaucucggcucacugcaagcuccaccuccuggguucacgccauucuccugccucagccucccgaguagcugggacugcaggcgccugccaccacgcccggcuaauuucuuuguauuuuuaguagagacaggguuucaccguguuagccaggaugaucucgaucuccugaccucgugaucugcccgccucagccucccaaagugcugggauuacaggcgugagucaccgcgcccagcccccuuuuuuuucuucuucuucuuuuuuuuuuuuuuuuuuaaauagaaacaggaucuagcuguguugagcaggcugguguugaauucuuggacucaagugauccucccaccucagccucucaaagugcugggauuacaggcguaagccaccacacccggcuuuuuccuuuuuuuuuuuuuuuuuuuuguuugagacagagucuugcucuauugcucaggcuggagugcaguggcgugaucucggcucacugcaaccucuaccuccuggguucaaguaguucuccugccucagccuccugaguagcugggacuacaggcgcacaucaccacgccuggcuaauuuuuuuguguuuuugguagagaugggguuucaacauguuggccaggcuggucuugaacuccugaccuuaugauccgccagccucggccucccaaagugccaaagugcugggauuacaggcgugagccaccacgcccaaccuuuccuucuucuuuuuuuuuuuuuuuugacucacaucuauuucuuaaaguuggagcaauggagccaggugugguggcuuacuccuguaaucccagcacuuugggaggcugaggugggcagaucacuugagccugggaguucaacaucagcuugggcaauauagggagacucuagcucugcaaaacaaaaacuuaaaaaguuagccaagcgugguggcacgcacuggcaggaggauggcuugcauucaggaggcgaagguuguagugugcugagauuaccacugaacuccagccugggugacagagugaggcucugucuuaaaaaaaaagaaaaauuuaaacaauuaaaaaauaaauugaugcaauggaaauaauauuuuccuugaauuuuggagauuuaauuuuugcuaaagauucuuauguauaagaauacauauuucuauguauaugaacuucuaccuuuuuuugguagaaaauuuggcagaaaaaguguauucuauuucaucaguugaacuauauggaaaucuagaaaaauagaagguuaauaaaaaaggaagaauggggaauagagaagauuuuuguuagguuauuuguggaggaauguuaaaagaggaaggauuuacaguucacguuuuucucucuuaaaaggccacugcugaagccaacaacuuagcagcugcagccucugccaaggacauuuauuauaacaacauggaagagguacgugggacauacgccuuauucugaaauaucuauaaucugggcauuguugcugacuucaaaagcccaacuugauccuacuuaauguaucuuuaagugaugaggcaauaaacuuauauucagguuguccugguaacgggggccuucuaauuauuaccauuucuuuguuuguuuguuuguucuuguuuuguuuuguuuuguuuugaauagcaaauaguuuauugguaaguacauaguuucaaugggaguaauaaauucacaugagcaggagacaauaaucaagucaaaagaauaaaugcuuacuaaucaucagaaaaucuguggccauuaaggcuggcacauaaaaauccaaaaucacucagaggccgaaucuuaaaagaagauucguccucuuauuaguucauauggaauagguccauaguaacuggaaucuguagaauucuguagauuuaucaccuucuaaccaaacaugacccacugggacauaacuguagcuuuuaaagaaaucugauggacuaguggugaggauuuugucuccuuccaaaccaguuacucuuuuacaaauauuugauguuggaucacuugggcuuuuugcaaucacaaugucaccucuuuggauacuaucaaaaugucgacuaagauuuugugcaaagacaguaucugaauuuugaauuguaggcuccauugaugguccagaacacaugacaacaccaccaacguauucagaagcacagugagcuauacagccauacugaauagcauagccaacaagucagaagguuuccccagagcaccacgaagcauaguucuauguagacucugccaccauuggucauagaucuguucuauaauucauuuaauuuuuagggaagucgcagggcuuccagaaaaaaaaaauuaaagcaugucucaaagcguaugugggugauccaugauuucaggaauccucgggucccaaagaacccugaggacccucaaccaggacacaggugggccuuucucaccugggcccugcagaagucgaccguuugcuuuuguuuuuuagagacggagucucacucugucgcccaggcuggagugcaguggugcgaucucggcucacugcaaccuccgccucccggguucaagcgguucuccugccucagccuucugaguagcugggauuacaggugccugccaucacgcccggcuaauuuuuuuuguguuaguagagacggaguuucaccauguuuaccaggcugauuucaaacuccugaccucaagugaucugcccgcccuggccuccgaaagugcugggauuacaggcgugagccaccgcacccgucccagugucacugcucuuuccaauugauauuaucacccugguuuuuuaagugugcuuuucagaggaagugaaacuagacuuuauuggucuuagucaucuuuuaaaaguuaacuuauuaauacauuguuaacaucuuaaaacauucuaauccuuucauuaucuuuucauguuuuauuuggcacuuguuuuugaagagaucuuuuaacauauuguuucuuuguucuuuuuagguuugugggggagagaaaccuuauuugucuccagacauucuagaggagaagcacugugaauucaaacaacuugcucuggaccauuuuaagaagaccaagaagaugggugggaaggauuucagcuuucguuaccagcaggagcuggaggaggaaaucaaggaauuauaugagaacuucugcaagcacaaugguagcaagaacgucuucagcaccuuccgaaccccugcagugcuguucacgggcauuguagcuuuguacauagccucaggccucacuggcuucauaggucuugagguuguagcccaguuguucaacuguaugguuggacuacuguuaauagcacuccucaccuggggcuacaucagguauucuggucaauaucgugagcugggcggagcuauugauuuuggugccgcauauguguuggagcagguaaguggugcugcugaagagccugaggguugauaaugggcagauauuugugcuucuguuguaaaauaucucaguuuggaagaauuucauagugaagacaugagacaguggccacuccguuggcuguuguuuucugauagacuguauguuuuauuauccuuuaggauauuaauauuuauucuuaauauuuuguuuccaugucuaaaaaggcccccgccccgcuuuuuuuuuuuuuuuuugagacaaagucucgcugugcucucuugcccaggcuggaguccaguggcaugaucuuggcucacugcaaccuccgccucccagguucaagugauucucuugcgucagccucccaaguagcugagacuacaggugugugccaccacggcccgcuaguuuuuguauuuuuaauagagacaggguuucaccauguugaccaggcuggucucgaacuccugaccucaugguccgccugccucggccucccaaagugcugggauuacaggugugagccaccgugcccagcccaaaaauagcccuuuaaugcaaaaacauuccaacuuagacauacugauuguguuccccuuuggcaacuuuuuuuuuuuuuuuuuuuuuugagacagauuuuuacgcuuuugcccaggcuggagugaaguggugugaucuuggcucacugcaaccucugcccacuggguucaagugauucucuugccucagccucccaagaguagcugggauuauaggugccugacaccaugcccaguuaauuucuguauuuuuuuuuuuuuuuuuaguagagacaguguuuugccauguuagcuaggcuggucuugaacuccugaccucaggugauccacccaccucggccucccaaagugcuaggauuauaggcaugagcuauugcgccuggucggcaacuucuaauuacaugcucuucagacauaauuuuuaugugauucucacuucucacccccucuagauuaauuuacuucauugaaaagcaagaacuuugaaaaaauuaugaacuuaacgaaaaauguucgguuuugaguccuacuggauuaggaaagggaugguaucuuuuuuauuuaaaaaucuuccaaaagccaguggcuugguuauuuauuuauuggguugcuuauuuauuuauuuauaaaauuuuuuuuggagacgaggucuugcuuugucacccaggcugguaucuuagcucauuguaacuuaaaacuccugggcucaagugauccucccaccucagccucccaagcagccgguguuacaggcgagugccaccacaccugacuaacccaguagcucuuggacauugacauggucacaaguuuuguagaucuuugagaugauacauuuguuuuucugaguaacaugaacaggugaguuggguuagcagcuugugaagccacaggagcugccuauccuacccuagccacagagcagauguuccccuggcucucuugggaguuagcugcugccacagccucucuguaucccugcauuuucauucaacugcuuucuguaacaugccgaugauggagacagguuuuugaaaguuuaaggacuuacuuucuuguugcuguguuguauuuuauuaacuuauauguugaauaaauggacuuuugcaggcuucuucucauaucgguaauuccacucaggccacugugagggaugcaguuguuggaagaccauccauggauaaaaaagcucaauagcaucuuaacgugaagaucaaacaagaacacaacaagccccuacugauuucuggguuucugccacggccacagguucauauccagaggaauggcagaucugagacgauccaggaagagcuaaaacauggcccuguaauaaaugagcagaccucuccugugguuucaaauuauuaaacacacuuccauuucucuuggaagcauuucuuuuccuugcuguuauagaugcaagccugugucuauuuucauauuacucugcuuugugcacuuuauggaggaggaagcuagaggaaaaauggaaaugcagcuuuuaaguucuuuaugugccacuuagugccuuuuaagauugauuccaug

SEQ ID NO: 192783 - RNA, 25232 nt, Homo sapiens
acugggggugggguuacguguaggugacguggccgcuuccagucuuuggucggguuucggcggcuucagugcucggggaggaggcagugacggccggugagauuggaaguggcggcggcggcaggcggcagaggggagguaagauucgcuuuaagaggggaucuggccgccgugucagcucuggggcagugguuuuacgggggcgacgacuggcggggggaagggaaucaggggcgagcgggcaaguccugccggcccggcuccgggugagcgaauuccuugccguccaaucaggaaagccucuguugagagagacgucggccuuagcuaaugagugguugaagucuuccagaaggcggaccuugggcggggggugggacuuccuguuucaaauaaacacccagagguuuucccccuccgcccaccgaagugugucagucuuuggagguccgucacuggcccucccggaggggccgaaggaaaccgcggaaacgaaagggcuggguuagggcccggggcaguuacacgggccgggccggagucucaggaccacgggguuggcucuggcccugucucugcuucaggguccccggcccgcgcucuggccgccagagccaaguuggaagaagagucugaagcggguucgacuugggacaggggaaaagcggggcccuuuccgcugcugguccgccccaggauuugcgagcguccugggcgcgaaaguccacgagaagugcagaaggggcucggggauuuguugauugggguggggcgggggaguuuggguaaagaaguugccuggggaaugacacucuccccuccacaacaguccgagguuaugcgucucaaugaucccgcggaaacgcuacgggucuaagaacacggaucagggugucuaccugggucucucaaagacacagguccuguccccugcaacugcuggcaguagcagcagcgacaucgccccucugccccccccagugacccucgucccucccccucccgacaccauguccugccgggaucggacccaggaguuucugucugccugcaagucgcugcagacccgucagguaaggaccuggaguggaaaaggcgaggagugagccuuacucaaaucuaggaaggacugugcuccaccacuguuaaccgaaguaauuuugggggguaccugauggaacugauaggcuuggauggggccuguagggucugcuauaagcaacagagaagaggucggcuggcuaacuaggggcaaggacuuagacuuuuuuuugugaggaauccuuuggagggcaggauugcuauucuggagggaguacuucagagaguacuuggcugcaauauaauuggugugaauaaggaacaaguucuaggaagagccuuuagcugagaaacaugcaccuugaauuuuccaauauacuucuaccauaaguuugcucuguaaccaugagaaaauuaguuaaucuaguuacauauuaguuuuuaucucuguaagauuaaggacauuuucuagauaaguaauuuguuguuuuuguuuuguuuugagaucuguuuuucaacucugucaacaggcuggaguguaguggugugaugauagcucacuugcagucuugaacuccuagacucaagggauccucuuuccucagccuccugagcagcugggacuacauggaugcaccacucagcuaauuuuaaaauuuuuucguacaggcagugucucacuauguugcccagguuggucuggacaccacaccuggcccuagaucaguaauuuguaucaaaaucacuuaggguuggaugugguggcucauaccuguaauuccagcacuuugggaggccuaggccagaggaugacuugaggccaggaguuagagaccagcaggagcaacaaagcaagacccuguuucuacaggaaaaaaaaaaaaaaaagcuggacgugguggcaugugccuguagucccagcuacuuagaaggcugagcgaggcccagucucuuccucucucucuuuuuuuuuuuuuuuuuuuuuugagaaggaauuuugccuugucgcccagacuggggugcaauggugcaaucucggcucacugcaaccuccucuuccuggguucaagcgauucuccugccuuagccucucgaguagcugggauuacaggugcccgucaccacgcccggcuaauuuuuguauuuuuuuuuaguagagaugggguuucaccaugucaggcuggcuuugaacuccugaccugaggugaucugcccuccucagccucccaaagugcugggauuacagguaugagucaccacaccuggccucucucucuccuuuuuuggaaacauggucucacucugucaccaaggcuggaguacaaugguucuaucucaucucacugcaacaucugaccuccugggcucaagcaacccuccugccucaggcuccucaguagcugggauuauaggcaugugccaccacaucuggcuaauuucuguuuuguuaguagagaugggguuuuaccauguugcccaggcuggucucgaacuucugggcucaagugauccgucugcuuuaucuucucaaagugcugggauuacaggugucagccacugcacucagcuccucuuaaaaaaaauuugggagugcuauuuauuuauuuauuuauuuauuuauuuuugagaugggaauuucgcucuuguugcccaggcuguagugcaguggcacgaucuuagcucacugcaaccuccgccucccggguuccagugauucuccugccucagccucccaaguagcugggauuacagacaugcgccaccaugccuggcuaauuuuguauuuugaguggagacgggguuucuccauauuggucaggcuggucucaaacucccgaccucaggugcucugcccgccucagccuuccaaagugcugggauugcaagcgugagccaccguacccagccgggaguguuuuuuucaacaaucccagugggacccgaguaagcaguuuguguuuguuuguuuguuuguuuguuuguuuguuuuugagacagucucucuuuguugccaggcuggagugcagugacgugaucuggguucacugcagccuccaccucuggguuuaagugauucuccugccucagccucccaaguagcugggaauacaggcggugccaggacacccagcuaauuuuuguauuuuuaguagagacgggguuucacuguguucgccaggauggucucugucucuugaccucgugaucugcuugccucggccucccaaaaugcugggauuacaggugugagccacugcaccuggccaaguaacuguauuuauuuauuuguuuguuuguuuguuuauuuauuuauuuauuuauuuugagacggagucucgcucugucacccaggcuggagugcaguggugggaucuuggcucacggcagccuccaccucccagguucaagugauucuccggccucagccugcugaguagcugggacuacaggugcaugccaccacaccuggcuaaauuuuuguauuuuuaguagagaugggguuucaccauguuagccagguuggucucaaucucuugaccucgugauccgccugccucagcuuuccaaagugcugggauuacaggcgugagccacugcacccggccgaguaacuguauuuuuaaauauuuuuacugauggcuggacaugcuggcuggcaccuguaaucccagcacuuugggaggcugaggugggaggauugcgugagccuaggaguucaagaccagccugggcaauauagcaagacccuaucucuacaaaaaguuaaaaauuagcuaggugugguggugugcccuguagucccagcuacuugggaggcugaaguuggaggaucacuugagcccaggaugucgaggccgcaguaaguuaugaucaugcuacuauauuccaaccugggagacagagugagacccugucucaaaaacagaaaaguuauaaagaaguguuuuucagcucaugguaaagcugcucuucuguaugaucuccaagagcuuugcaaucauccuuauugauuuccugauuugaggaauagaauggcaauacuagauaccauuuauuuagugcuuacuauguaccagguaguugacugaaguacuuuucagccuuuuuguuauuuaaccuuagcaacaauaggagauguguggauugucuucauuuuauagaagagaaaguagagauuuagaauguuuuaaguaacucgccccaaauccaccagcuaguaguaaguggugagucaagauuugaacucaggucuaccugcucuucaaaucuggacucuaaacgacuaccacucauaaaucuagaucaucugauggaugccaccagcacuagagauagguuaguggacaccucaggaagagugaaagcuggaacuggggaagggagaacuaaaguugucaccuccugccauugcuuuucagaauggaauccagacaaauaagccagcuuugcgugcuguccgacaacgcagugaauucacccucauggccaagugaguugagagaagcuuucugguggggugauacagugucugaagaaaaguagacuugcaaucaguggccuuggcugugaagucugggauugguuaugcuggagcuuaugugggaaaaggcguccugcccuuucccacagucugacuaguggucauuugcaggcgcauugggaaagaccuuagcaacacauuugccaagcuggagaagcugacaaucugugaguguucuuggggucuuucagaaguggggcaguaaaucaaagaggguugaggacuauauucccugagcuuuguccuugaccucacccauuguggcuucuuguuugucucuguaguggcaaagcgcaagucccucuuugaugauaaagcaguggaaauugaagagcuaacauauaucaucaaacaggugagcuacuagccaucaggagagcccagcauuccaaucagaucacuucugucuuccugucauuuuccauugccauggggacccagagcaaguuucuuuuuuuagagaggggggucucacuguguugaccagucuggaguguaguggugugaccuagcucacugcagcccuuaacuccuggccucaagcuuuccuccagccugagccuccugagugguagagacuacagggacaugcccucauuccuggauaauuuuuuuuuuuuuuuuuuuuuugaggcagaguuuugcucuuucacccaggccggagugcaguggugcgaucuuggcucacugcaaccuccaccucccaggugcaagcgauucuccugccucagccuccccaguagcugggacuauaggcacccgcuaccaaugacuggcuaauuguuuuaucuuuaguagagacgggguaugccaggcuggucucgaacuccugaccucaagugagccgcccaccuuggccucccaaagugcugggauuacaggugugagccacugcacucgacuguaauaauaacuuuuauuuuauuuauuuauuuauuuauuauuauuuuuugagacagaguuucacucuuguugcucaggcuggagcacaguggcgcgaucucagcucacugcaaccucugucuccuggguucaagugacuccccugccucagccucccgaauagcugggauuacaggcacgugccaccgcgcccggcuaauuuuguauuuuuaguagagacaggguuucuccacguuggucaggcuggucucaaacuccugaccucaggugauccgcccaccucagccucccaaagugaugggauuacaggcgugagccaccgcgccaggccaauaauaacuuuuuuuuuuuuuaagacggagucucacucugucgccaggcuggagugcaguggcgcgaucuaggcucacugcaaccuccaccucccagguucaaaacgauucuuuugccucagcaucccaaguagcugggauuauaggcgcgcgccaccacacccagcuaauuuuugguauuuuuaguagagauggcauuucaccauguuggccaggauggucucaaucucuugaccucaugaucugccugccuuggccucucaaagugguggguuuacagacauuagccauugaggaauuguguguaugaaaauaguucuguugaugccucucgaaacuacagugccuuugacucuucccuuuuccugaguacuguccgggggcuuuguuggucaugcccuagacccgagauuuuggccuuugaaaggguucuguggccaagagcauggccucacagaauggagcagggcaguaggcuggaggaguaaacaaguuauuuacaauggaugaaggccuauuuugccucuuuguagcucuucucugcagggacugagccagagcaaacacuagaccuuggaaaauccuagcaggcccaucuggucugacugucugagauacucucacucuggcuaguaacuuccaccuuguccuuccuaccagagauggccaucgugagagaugcugacuaaggacuccuuggcuaauacuuuguuuuuccuuggacucuuuuaccaggacaucaauagccucaacaaacaaauugcucagcuccaggauuucgugagagccaagggcagccagaguggccggcaccugcagacccacuccaacaccauuguggucuccuugcaggugggaccuggggaggaagggagggaggcaaagaggaagaauguggagccuucuuugguugacccucucuccuuuucuucuagucgaaacuggcuucuauguccaaugacuucaaaucgguuuuagaagugaggacagaggugagaacaaucugcguaggagggguaggaauaugggaguaaagauccaagagggaaaugaagaagggacaaguucuacagggucauggggccaauggugggagucucuuuaacaugccugcuuucuaguggcuucagguccuuugcguuuuuccccaaccccagaaccugaagcagcagaggagccggagagagcaguucucccgggcaccugugucagcccugccccuugccccuaaccaccuggguaagucacagguaaaacggggagcccugggagguaagguuacuuacucugguugugauggcauccucuaaaggcacggguuggguaggagaguggaaggucaaggaauuuucuaggcuuuaucucucagaggccaaaccagaugguugagauucgugauccacauuuagacucccacauucucacuguuggggugaauucaguuauauucagaauaaugauaauuucuaauuuuuuuucguacacuuuauucacauucucucauuuaauuuucacaaccacccuuugagaaagcaacuauuauuaucccccauuuuacaggugaggaaacugaggcucagagagguuaaaugaccuguccagggucacaaggcuaguaagugcuagagcugggauucaaacccagagcaugugggcuuugaaccugcuuuuaacuguuaaggugugccacauccuguuuucucccccaggcgguggugcugugguucugggggcagagucccaugccuccaaggaugucgccaucgacaugauggacucucggaccagccagcagcugcagcucauugacgagcagguacccaggcucugaacuagguagaaucagcuucuccauuauccucugugguucccgagagaguguuuggagugugccaugggcagaauggcaagcugggaggguuguaaaaaugcaggucugacccugaagaagcuguuggugcucaugugcucucucccucuccugaaggauuccuacauccagagucgggcagacaccaugcagaacauugagucgacaauuguugaguugggcuccaucuuucagcaguuggcacacaugguuaaggaacaggaggaaaccauucagaggugagauacacucucucgccccaaacagaggagcuuucucuuccccguggauuggcaucuuaaaguccccagggacugcuugaugccuuuuggaagauagagugaauucugcccacccaugggacccaguucaccugcuuccauccacccaacaaguuuuuauugagcaccuguucaugugaggcacuguuccaggugcgggagauacaguggcaaguagaacaguaaagucugucuggagcugcuuuguagcauguguaaguguauggaauuugauagggcagaugaggacagcuguggaaaagaacugacaaggcuggcacagugacucacaccuguaaucccauaggcagcacuuugggaggccgagcaaugcagaucgcuugaguucaggaauucaagaccaguuugggcaacaaagcaagacccugucucuacaaaaaaauacaaaaacuagcugggcaugguggcaugggccuguagucccagcuacucgagaggcugaggugggaggauggcuugagccugggaggcagagguugcagugagccaagaucgugccacugcacuccagccugggugacagagccagauucugugucaaaaaaauaaaaauaaaaaauugaccaacaaaauuucagggaguaauaaaggcuguauacagaguuaaaauaggaugauguguuaagaaaguaauggauggguacgguggcuuacaccuguaauuccagcacuuugggaggcccacacagucaguugaacucaggaguucaagaccagccugggcaacauggugaaaccccaucucuacaaaaauaaaaaaauuagcuggacaugguugcgugugccugugguuccagcuacucgggaggcugaggcgggaggaugacuuaagcaugggagguugaggcugcagugagccaugauggaaccacugcgcuccagucugagugacagagcaagaccccaucucaaaaaaaaaaaagaaagugacuaaguagguauaucagauugugugguagggaaugcugcucugaagacaugacauuuaagcagagacuugaaugacaagagggauccaaccaggcaaagaacagagaguguucuaggccgaggagacagcuagagcaaagccuugugaugggacagucucaccauagcaagaaucaagaaggccugcguggcuagaaaguaaugaacagggauagagaaguacaggguguacuggagggauguaggcagaggcccaacaaugggcuggccucucuguuccucuggugccuccugcuacuacaagaguuuuuaucugcuccuccucuguggugcuuagcauucagucagucaguuaugggaauauagcaguggacaaaagagacaaaauccuugcccuuguggaacguguauccuaauagggagauagaugugaaaaagucauaauaaauaguauguuaaaaaaaaaaaaggucguaaaugccaaaaaaaaaaaaaaagauagucaacacaggauaaacuaaucaggagugccagguuuggagggagguaggcccuauuaagaagguggcaucacacuugggagaaggugaggaaauuagcuacauagacccuggcaaaggcccgcaggugacaauauguuugaugaguuaaaggacagcagagacuacugcagcugggaucaaugaggaagagaguuguacaagguguggucagaggggaacugugagaccucuugggaccauugguaggcuuuagcuuuuacucugagugacauagggagccauugcagggguuaguuuuucuguguuugagacagagccuugcugugucgcccaggcuggagugcaguggcaugaucuuggcucacugcaaccuccaccuccuagguucaagugauucucaugccucagucucccgaguaccugggaccacaggugugcaccgccaugcccggcuacuuuuuguauuuuuaguagagacagaguuuugccacauuggccaggcuggucuuggacuccuggccuccaguaaccuguccaccuuggccucccaaagugccgggauuacaggugugagccaucacaacuggccaaauacauuuaacuuuauuuauuuaugcauguauuuauuuauuuauuuuuauuuuugagauggagucucacucugucgcuaggcuggagugcaguggcagaaucucggcccacugcaaccucugccuccuagguccaagugauucuccugccucagccuccugaguagcugggacugcaagugcgugagaccacgcccagcuaauuuuuguauuuuuaguggagacaggguuucaccauguuggccaggauggucuuaaucucuugaugucaugauccgcccacuucagcuucccaaagugcugggauuacaggcaugagccaccaugcccgguguuaauuuuauuuuuauuuauuuauuuacuuuugagguggaguuucacuguuguccaggcuggagugcaauggcaccucucgccucacugcacccuccgaguucaagcaauucuccugccucagccucccgaguagcugggauuacaugcacccacaccacucccagcuaauuuuuguauuuuuagcagagaugggguuucagcauguuggccaggcuggucucgaccuccugaccucaggcaauccgcccacuucggccucccaaagugcugggauuacagaugugagccacugcgccuggccacauuuaacuuuaaaacaaaaaguauaauaguguauacucugggauuuguaaaguacauagauacaacaaauuuaacuguagaauaaaggaugaagcaagaggguuucaagauuuugacagguuuuucuuuuuuuugaaauggaguuucgcucuguugccaggcuagaguacaguggcucgaucucaggucacugcagccuccaccuuccagguucaaguaauucuccugccugagccucccgaguaguugggauuauaggugcccaccaccaugcccagguaauuuuuguauuuuuaguagagacaggguuucaccauguuggccaggauggucucgauuucuugaccuugugaucugccugccucggccucccagggugcuaggauuacaggugugagccaccgcaccuggccuauuuugacaguuuuuaugaaguaggcugugaaaaguuaauaagguguauuuuguaaucccuagagcaaccauugaaauaaaacagaaacucaacaaugacauauagcaagaagagcagcaaccaaauugaaauggaaauagaauuuuaaucaaaauuucaauuaauucaaaagaaggacaagagaggauaaacagaggaacgaaaaauagaaaauagugccgggugcaguggcucacgccuguaaucccaacacuuugggaggccgaggcaggcggaucaugaggucaggagaucgagaccauccuggcuaacauggugaaaccccgucucuacugaaaauagacaaaaaauuagccgggcgugguaguggguaccugcgcagcugcuugggaggcugaggcagaagaauggugugaacccaggaggcggagcagugagcugagaucgcgccacugcccuccagccugggcaacagagugagacuccaucucaaaaaaaaaaaaaagaaaaagaaaauaguaaaauggcagcccuaaauccaaccuuauuaaaaauuacugcuggccucaagugaucuccccaccuuggccuccaaaagugcugggauuacauaugugagccaccacaccuggccagauuccgcccuuuuuuuuuuuuugagacagagucucgucguguuaccaggcuggagugcagucgcgugaucucggcucacugcaagcuccaccucacagguucacgccauucugccucagccucccgaguagcugguacuacaggcucccgccaccacgcccggcuaauuuuuuuuguauuuuuaguagagacaggguuucaccauguuagccaggauggucucgaucuccugaccuugugauccgcccgccucggccucccaaaguucugggauuacaggcaugagccaccgcacccggccgauucugcccauauuuuaaucuccgucccagaccugucuccuaaacuccauauauccauauuccuguucaacaacuccacuuacuggccugggagcgguggcucaugccuguauuccuaacacuuugggagguugaggcggguggaucauuugagguucaggaguuugagaccugcuuggccaaaauggugaaaccgcaucucaacuaaaaauacaaaaaaaaaaaaaauagcugggcauggugacacaugccuguaaucccaacuacucaggagccagaggugggagaaucacuuuaaccuuagaggcggagguugcagugagccgagaucgugccauugcauuccagccugggcagcaagagcaaaacucugaaaaaacaaaaacaaaaacacaagcugggcguggugaugcacaucuuggucccagcuacuguucccaguagcugaagucugaggcaggaggaucuccugagcccugggggcggagguugcagugagcagagauugggccacugcacuccagccugggugacagcaacacccugucucaaaaaaaaaaaaguauuaaaaaguuaaauguauuuuaaagaaauuaagaggaagacuugguaauagugcucacauauuuaccaucuucaguguucuucauuccuccuugaauagaucuaaguuuuccacugguaucucuucccuuuauccugaagaagcacuuccuuugguuuuuuuuuuguaguggagaucugcugacaacaauuucuuucaguuuucuuucaucugaaaacugaaaucuuuuucacuaacuaaaucaaaacuaaacuuuuuucaccuucuuuuuuuuuuuuuuuuuuuuuuuuuuuuuuuuuuuucagacagagucucacucuguugcccaggcuggaguacaguggcacgaucucggcuuacugcaagcucugucuccuggguucacaccauucuccugccucagccuccugaguagcugggacuacaggcgcccaccaccaugcccggcuaauuuuuuuuguauuuuuaguagagacgggguuucaccguguuagccaggauggucucgaucuccugaccucgugauccaccugccucggccucccaaagugcugggauuacaggcacgagccaccgcacccggccucaccuucauuuuugaaggauguuuucucuggauauagaauucuggauauacaguuguuuuuucuuuuuuuuaacuuuuuauuuauuuuuuccugagacagggucucacucucuugcccaugcuggagugcaguggcacgaucauggcucacugcagccuugaccucccaccucagccuccugaguagcuggagcuacaggcauacaccaccacaccaggcugauuuuuuuucuuuuuuuuuuuuuuugguagagacggggaucucacauguugcccaggcaggucucaaacuccugggcucaagaaaucuucccaccuugaccucccaaugugccuggcucauacagauuuauucuuuuuuuuuuuuuuuucugagacagaguuuuugcucuuguugcccaggcuggagugcaguggugcgaucucggcucauugcagucuccacuuccuggauucaagugauucuugugccucagcuuaccgaguagcugggauuacaggcaaccacuagcauacccagcuaauuuuuuuuuuguauuuuuaguagaaaugggguuucacuauguuggccaggcugguuuugaacuccugaccucaagugauccucccacuuccgccucccaaaaugcugggaucacaggcaugagccacagcaccuggcccuaucaugucuuuuuuuuuuuuuuuuuuugagauggaguuucacucuugucacccaggccagcaugcaguggugcgaucuuggcucacugcaaccucugccuccuggauucaagugauucuccugccucagccuccugaguagcugggauuacaggugcccgccaccacgccuggcuaauuuuuuguauuuuuaggagagaugggguuuugccauguugggcagucuggucucgaacuacugaccucaggugauccgcccaccacgugagccaccacacccagccucugaguuucuuuuauguguaaauuugucuuuaaauuuaggaaguauuuggcuauuauuacuuuaaacauuuuucugccucuuucuguccuuaccaucuggaaauauauacauauauauguuuccagguacaugucuuauauaauaaguuuauauuuauuuuauguauauuuucaggucaaucugcuguuaagcccauuuggugaauuuuuuuagauaauuuucaguuucaaauuuacacuugguucuuuuuuagagauuauguuucucugcugugauuuacuaccuucuuagugaguacaagcauauuuucccucaguuauaauagcugccuuaaaauuuaauucucaucaucuggauuauccuagggauggggccauucauugccuuuucucuucuguaugggucacaguucccuguuucauuguauaucuacuaauugaggauuuuaucguacauguuauugauaugaagagucuggauuauguuauguuucuauaaagaauguugacuuuuuuguuuucgcaggcaguuaacuuggcugaacuaagaucauuguuuuuuauauuuccucugugguuuauguaauuuauggaaugauugguauaauaggagguacccaggcauuacuggaagcagaaccucgaggauugagaaauagucauuggauucagcaauguagauauuguuggugacuuugagucagauucaauagagggauggaagcaaaagcucgaaugcaguggcguuuaagagagaaugaagcuagccaugguggcucuugccuguaauccuagcacuuugggaggcugaggcagguggaucacuugaggccaggaguucaagaccacccugggcaacauggugaaaccccgucuccacuaaaaauacaaaaaaauuagcugggcaugguggcgugugccuguuauccccaggaggcugagguugcagugagccgagaucccgccacugcacuccagccugagugacagagcaagacucugucucaaaacagaaaaacaaacaaacaagaaugagagagagcaauuagaaagaguaggaauagaugaauagacagcucuuucuuucuuuuuuuugagacagagucuugcuguguugccaggcuggaguguaguggcgcaaucucggcucacugcaaccuucgccucccagguucaagcgauucucuuuccucagccucccgaguacagucacguaccaccacaccccauacccagcuaauucuucuuuuuuuuuuuuuuuuuuuucaguaaaggcggguuucaccauguuagccaggguggagaauggacagcucuaagaguuuugcuucaaaauggagaaaggaaauggaguaauagcugauaggaggaaguuauucagaaguuuucuuuuuucguuuuuuuacuaugaaaauuuggggguuaggcaaaguuaauccuagugcucugggaguucaaggcgggaggauugcuugaggccagaagcucaggaccagccuaggcaacauagcaagacccuaucucuccaagaaaaugaaaaauuagccuggcauggugacaugccuguaguccuagcuauuuaggaggcucagcggagaagaucacuugagucuaggaguaggagguuacaauaggcuaugauggugccauuguacuacagccugggcaauagagugagaccguaucucuaaaaaauuuuuuaaaauaaaaauuuuaaguuuaccaguaaguugaaagaaccauaauaaacacuaauauagcugcaaccuacauucaacaguuaacaguuggccagauuagcuuuaucuuuauuuuucugaaccauuucacaguagguugccgauaucgugacacuuaauccuuaaauauuuuaacaugcgucuccuaagaauacacaaauucuuuuuaaaaaccacauccaguacucacuucagcaggacauauauuaaaauuugaauaauacagagguuagcauggccucugcacauggauggcacaaauuugugaagcuuucuguauuuuuuauuaccugggugaugagauaauauguauaccaagccccaagacacgcaauuuauuuauagaaccaaccuacacauguaccccugaaacuagaauaaaauuuaaaaauuaaauaaaaaaauaaaaaccagacugggcgcgguggcucacaccuguaauccuagcacuucgggaggccaaagcgggcggaucaccugaggucaggaguuugagaccagccuggccaacauggagaaaccccaucucuacuaaaaauacaaaaaucagcugggcauaguggugcaugccuguggucccagcuacuugggaggcugaggcaggagcagugcuugaaccugggaggcagagguugcagugagccgagauugugccacugcacuccagccugggcgacagagcgagacucugucucaaaaaauaaaaaaaaaaaaaccacgccguuauccuaucuaugaaaauuagcgauuuccuaauauuauguauuauucagugagugucacaacagagugauacucugucucaaaaaauaaaaaccacacccaguuaugucugugaaaauuaaugauuuccuaauauuauguauuauccagugaguguuacgacagagcgauacucuguccuaaaaaauaaaaaauaaauaaaauaaaaaccacacccgguuggcugggcaugguggcucaugccuguaaucccaguacuuugggaggccaaggcgggcggaucacaagcucaagagaucaagaccaucuuggccaacauggugaaaccccaucucuacugaaaacagaaaaauuaacugggcguggugcugcgugccuguagucccagcuacucgggaggcugaggcaggagaaucgcuugaaccugggagguguagguuucagugagccgagaucguaccacugcacugcagccuggcaagagagcaagacuccaucucaaaaaaaaaaaagacacccaguuauccuaucuguuagaauuaacuauuuccuaauaugugauauccagugaggguuuacauuuucccaguuguccccaaacuguuuaauagcuuuuuaaauauuaaaucagaaagccaggcauaguggcucacaccuguaaucccagcacucugggaggccgaggcaggcggaucaccugaggucgggagcuggagaccagccugaccaacauggagcaaccccguuucuacuaaaaacacaaaauuugcugagcgugguggcgcaugcaggaaaaucaccugaacccgggaggcagcgguugcggugagccaagauugcgccauuacacuccagccugggcaacgagcgaaacuccaucucaaaaaaaaaaaaaaaauuagcugagcgugguggcaccugccuguaaucccaacuauuuggcaugcugaggcaggagaaucucuugaaccugggaggcggaaguugggugagccgagaucacgccguugcacuccagccugggcaacagagugagacucuuaucuaaaaaaaaaaaaaggaagagucccgggugcgguggcucacaccuguaaucccagcacuuugggaggcagaaguggguggaucaccuaaggucgggaguucgagaccaggcugaucaacauggugaaacccaucucugccaaaaauacaaaauuagggcgugguggugcaugccuguaaugcuagcuacuugggaggcugaggcacuaaaaucacuugaacccaggagguggagguugcaaugagccaagguugugccauugcacuucauccugagcaacaagagcgaaacuccaucucaaguaaauuaauuaaauucuuccucuuuucugagcaucgcuauaggcuuuaauuauagguuuuaauguauugguugucuuauuauuaguuagggcaaugauuauugugagugcucaaguuguuccaaauaugucuggugggagccuagaggguuuaaaaggcugagagaaaauaaagguauguuagcaugccaauggaaaugaugcaacggauaaauuuaaaaaugauaauauaggagaaagaugggagaauucuugaaaugauguccuugagaaggugaaaggaagugggcuccggggcauaaaucaaggcuuggcucuaagaggagcuggcgauaggugggaagacagaggcuauuguagcaaugcucgggguggagcggcauuuaucuucagaccacuucagucuucucagcucauuaagaagaaaagccaguagaggagaggagguguaggagguuuuaggaauccacuccugcccacuugaucuuaucccuuuagcaggguccaacccugauugaucuuuauuccccacgguaucuagcagagugcuuuuacucuacguuguugaucaugugaaacugagugaacaccuacauuuguauaaagccgguuucugaacaucaauccacuaagcagccucacacauuuaacuggccaagguaaaagaaaacacuuggagauucugauucgagagaugugaauggagugggcuuuucagggagcuucauuuuuacaaauuccauaggggguucugaugagcauccagguuugggaacuacugauuaaaagaaaguuuguuuauucaacuacuauauguugagcaccagccauuuauaagguaccgugaguacagcugucuugauccuagagucaggagaauugacugauuuuuuuuguuguuguuuguuugagacagucucacucugucacccaggcugcagugcaguggcauuaucuuggcucacugcaaccccuuccucccagguucaagugauucuccugccucagccucccgaguagcugggauuacaggcaugcaccaccaugccuggcuaauaauugacugauuuuuuuuuuuuuuuuuuuugagacggagucucacucugccacccaggcuggagugcaguggcaaccuccgccuccuggguucaaaugauucuucugccucagccucccaaguagcugggacuacaggcacgagccaccauguccggauaauuuuuguauuuuuaguagagauggggugucaccauauuggccaggcuggucuugaacuccuagaccucgugauccgcccaccucggccucccaaagugcugggauuacaggcgugagccaccgcacccggccuaauugauuuuuaucuauuucagcugagaccuagggaaccccuugcagaauuaugccauaaacaccauagcucccugagcuauguuguauuuugaauauuagaauauuaagucugggcgugguggcucacgccuguaaucucagcucuuugggaggcgagacaggcgaaucacgaggucaggagaucgagaccauccuggcuaacacggugaaaccccaucucuacuaaaaaaaauacaaaaaaauuagccggguguggugaccggcgccuguagucccagcuacuagggaggcugaggcaggagaauggcgugaacccaggaggcggagcuugcagugagcccagaucacgccacacgccacugcacuccaaccugggcaacagagugagacaccguuuccaaaaaaaagaauauuauagagucagugaaacagaauuauaaaagauauggagggccaggcgcaguggcucaugccuguaaucccagcacuuugggaggccgaggcgggcggaccaccugagguccagaguuugaaaccagccugaccaacauggagaaacccugucucuacuaaaaauacaaaauuagccaggcaugguggcgcaugccuguaaucccagcuacucuggaggcugaggcaggagaaugguuugaacccgggaggcggagguugcugugagcugagaucgcaccauugcacuccagccugggcaacaagagcaaaacuccaucucaaaaaaaaaaaaaaaaaaaaagguauuugaguucuuuccucaauccauauacaucuaaaauaaaguuauagcauauaggcaacuuuacauucuagucuuccuugaaacagugucauaaguauuuuucacuguuagcauguguuugcucauugguuuagcaaacauuuguugcugcugugagcuaauccugcugggucugaggauaaaagggugaaagaccauucugguccuccuggagcucacuaguaggagagacauaaguugacagugacagcucaguaugauagggcaagaagagaaggggaugaggcugggugugguggcucaucccuguaauccuagcacuuugggaggccgaggcagauuacuugaggccagcaguucaagaaagccugugcaacacagagaccccgugucuauuaaaaaaaaaaaaaaagggaugagagaacucagaguagguacugcuccuagauggggccaaggggccuucccagaagugauaccaagcuaagacuuggagggaaugccagcccaaaaaggggaaaggagaagcuguuccaugugaggaaaaaacagcacagaaaugagaaagaacuugguagauacaggagugcagaauuauucagcauggcugggggaguggugagaggcaaggccaggucacagauaaccugugugucacagcaagaaauuuggugucagggagagaacauaagaagaagcaagcggauugaugcugggugagaauuagguuuguucugggugugcugagugccucagacuucaugggacagcuaaaugacagaguuuaguaggcauuucauguucugauguuuggaagagaaggcagugcuagagguaaggacuuaggacaguggccucuuggugaaacccugggcauagaccacccagagacuggguaaagugaaaaaaaggucaggacagaucccccauggagucaggggguauguagagaagggaagaaucuggccagacugaggaggaagguugaggaagaugagagaagaaagcagagagagaaauguguccuuagaacuugggauagaagaauuuuaaggagugguuauuucuccuugcuccugagaaagaaaguucgagguaaggauguguuugagucaggaggggcuugaauuaauuggaucagugccaguauuuucaguggaauggcucaguagcaauuuuacaguauguuggagcauaaaagaaauaaggaaguagaauuuaugggcaaccauauacaaaauaaauuuaugaaaggaugccaucuuuaaaauagguguagacauucauaugcuuccucccugcaugccaguggaucuggguuucagcacuugcucuagaaaccacugauuaagucugaaguuuuuugggaugcagauucuugggccccaaccuagaauuucugguugugacacuugagaauuuuuauauuugagaauucaacaggugauucuuauuuuuccuaaggugugaaaaccacugaucuaauguugcucagucauuuuccuuuucaccucauaaaauauucaaacuacagaaaaguugggaggauagcacaauaaacacucauauucccuucaccuguagucacuaacuuuuuuuguuuucauauuuguuuuuuucuuuucuuuugagacaaggugacacucugucacucaggcuauagugcaguagcgcaauaauggcucacugcagccucaaacuccugggcacaagugauccccccaccucagccuccccaguagcugggauaacagguacaugccaccauguccagcuaauuuuuaaauuuuuuuguagagacagagucuccuauauuccccaggcuguucuugaacuccugaacucaagcaauccagccaccuuggcuucccaaagugcugggauuacaggcguuggccagaucuggccaccaauuguuaacauuuugucacuuuuuuucuuuuucuuucuuuuuuuuuuuuuuuuuugagauggagucuugcucugucacccagguuggagugcaguggugcgagaucucagcucacugcaaucuccgccucccggguucaagugguucuccugccucagccuccugaguagcugggguuacaggugcacgucaccacauccagcuaauuuuuguauuuuuaguagagacagguuuucacuauguuggucaggcgggucucaaaccccugaacuugugauccgcccaccucagccucccagagugcugggauuaucggcgugagccaccacauucagccuuuccccucuuucuuuugccgaauuauuugaaaguaggugcaaauuucaugcuguuuuauuccuagauacuacagcaugcuaauaauaaggcauucuccugaacagccauaaugucuuuuuuuuuuuuuuuuuuuuuuuuuuuuuuuugagacagagucuugcucuguuucccaggcuggagugcaauggugcgaucuccacucacugcaagcucugccucccagguucacaccauucuccugccucagccuccugaguagcugggacuacaggcgcccgccaccacgccuggcuaauuuuuuguauuuuuaguagagacgggguuucaccguguuagccaggauggucuccaucuccugaccucgugaugcacccaccucggccucccaaagugcugggauuacaggugugagccaccacgcccugcccauaaugucauuuucaaacuaagaaaauuaacaguucuccaacaugauccaguaaucagcccauguucaaguuuccccaucugauuuuuuuuuuuuuuuuuuuuugagacggagucucgcucugucacccaggcuggagugcaguggcacgaucucggcucacugcaagcuccaccuccuggguucaagccauucuccugccucagccucccgaauagccgggacuacaggugcccgccaccaugcccggcuaauuuuuuguauuuuuaguagagacaguguuucaccauguuagccugaauggucucaaucuccugacuucgugaucggccugccucggccucccaaagugcugggauuacaggugugagccaccauguccggcccccauuugauauuuaaaacaaaaguuuuuaucuuuuuucuuucaauuuaagacccaggaagauucacauuuuguauuugaugugugucuucagugggccuuuuguuuuauuuuucaugacaucaacuuguuuuguucaauguuaaauuaaaucuaacacugauuaaauuagugcugcgaugauuacauuaguaggcacuugaugagguuaucccuuuuauugcugaugucaauuuaaucacuuguucaaggugcuaacuaucagauuaagcacacucaucccuugguauuguggggcauuggcuccaagagccccagaggaaaccaaaauccaugcauccgcaagucccauaaaaucuugucauauuugcauguaaucuacucacauccuccaauauacuuauuuauuauuauuuuuuuaguagagacaagugucuuaccauguuguucaagcuggucuccaacuccuaggcucaagugauccuccugccugggccuaccaaagugcugggauuacagccuggccaaaacuaggguccauauaccuuuuuuuuugguguuuuuuuuuuuuuuucccccugaggcagucuugcuaugucacccaugcuggagugcaguggcacaaucucacugcagcaucaagcuccucaaccuccuggguucaagcuauccucccaccucagccucccgaguagcugggacuguagggucacaccagcacacccagcuaauuuuuguauuuuuugcagagaugggguuuugccauguugccuaggcuggucucaaacucgugagcucaagccaucugcccaccucagccucccaaagugcugggauuacuggccugagccaccaugguuggccauagagcuuuuuuuauccccugauuuccuguccgugucauuauguuuuccuuuuucacucagaaccaugauuuccugacugcaauggucugugaacauuuuuccccuuacaauaaauauaauacauacucaccagauaaaaauguaaauacugaugaggaaaaauuguaacuaacauuuucggggcucuuguggguuagggacuuuauacuaacucauugaagacagacaguagccugagagaagguaggguuuggguuauccucauuuugccggugaggaaaaugaagcuugaaguuagacuaacuuagagucuuaagcuaauaaauggcagaguugguuuucaaaccagaaauaacuuguuuauaguacccuuccaaagccuuuucuauacacaaauauauauaagaaugggaucauauugugaccaucuuuccaugucaauaaauggacuucaacagcauucuuuuuaauccaguguccuuuuguuuccucuucucccggccuuguccccaggaucgacgagaacgugcuaggagcccagcuggacguugaggccgcccauucagagauccucaaguacuuccagucugucaccuccaaccgguggcucauggucaaaaucuuccucauccucauugucuucuucaucaucuuuguggucuuccuugcuugaacccucucuacucugaggcacucuguugggguuugggacccuccugggaaggcaaguggccagugcugccacugagccugugcaggguacuugggagaaaggcccuguuucccuggaacugcuaagaaugaccacugccccugaucccccaccccuugccucuggccacccuguccuccccccaccacccucaggccuaugaaacacacaggguucuagauuugaacucugcugugaagugacuggaagggagcagaggccagcugggggccagugggggagguuguuuccacuaggagauuuuuauaaacccucuccagccucucccaaaggaagcguuggcagcaaagggagaugaugcccuuacccaccuuccugugagugaagagaggaagcagccccagggaccaauuuucccaauugaccucuuucuuccucuuucaccaugugaggcagggagcccugagcccuucagcugccugcacaaccccugacauuggcugcuggugacucaaucugccaaaugugcugcagcucguuuucucccaauuacagcaagacugucagccucacuagccaugucaucauuucugggugggagcgucgaag

SEQ ID NO: 192784 - RNA, 1049 nt, Homo sapiens
gcaugaggaaagucugagaugagggaaacaacauuuuuguguauacaacaauguuaaaauuccaaacuuauagaaauuuuugccuucucaacacuuucuugaaugcauucuggacuucucuguuccucaggcuguagaccacaggguucagcauggggaugaucauagcauagaacacagaugccauuuugucuguguccauggaguggcuggagcugggcugcaaguagaugaagauuacugucccauagaagacggagacugcagugaagugagaggcacagguggacaaugcuuuuuggugucccuuagcugaaugcaucuucaagauggugaugaauaugaacaaguaggagauaaagauaacuagaagaacaaaaaagauauuaaagcuugacauaaaaaccagaaucaccucacuaguguguuuaucagagcaagacagagccaugacugcuggaacaucacagaaaaagugauguaccagauuggauuuacagaaagagagacugaauaugcccccaauguggaaugaggcauuuaggaagccacagacauaugagccuagggccagacaggcaccuacacuggccgucaugguggugguguaguguagggguuugcacacugcugcauagcggucauaggccauugaggccaacaaguaauuuuccaccguggccaaggcuacaaagaagaacaucugaacagcacaugcauuguaggagaugaccuugucuccucuaaggaacccagccaugaccuugggagugacagcugaggaguauccaaaguccaccagagacagguuacugaggaaaaaguacauggggguguggagacaagaguccaucaggaucagcaacaucauccccagguucccacacagagugaggagguagaugaaggugaacaagauaaagagggggaucuguaguucugggacacugguuaguccuagaagaaugaacuuugucacuuccguacaauucuccaucaguauuaucugagaaacuuaagaugaccuguagcaaugagaaauaaagcaa

SEQ ID NO: 192785 - RNA, 46081 nt, Homo sapiens
aguaggcuggagccggggucagcuuuggcaccuuccuccagucaguggccaacuccuggcucaguggggauugugcucguccccuccguuccccuccagucuuccucccgcuaccggaacgagccucgcgcuuggcaggcugaggaggagcaaagaaagcaggauuaaagagaaggaagaccuggcuaggucuggguggcgucugcagugccagaaagggaggcgguggcggcggcggcugcgaccacggccgcgcgggacgugaggcccgagagcaaccgacgggcagcggcggccgcuccagcgccccgcaccggggccguuagucagcagaacgcgagcucuuguggaggagcagggccggcgcgaggcgagacucgggagcgugagcggggccccuggggcgccgccguccuucuucgccccggcgccgggggcuguagcccugguccccgcuccucugucgggccagucugcaggcggagagagucggacggcgcccggagcgcggaucucgccuuguggaggacagcgcgucggcugcgguucucucucgaccccuucugcccggcgcuucggcccgggccgcucaggugcaggugcgugcggccucgggguuuggggacgccgcagcccggcucggggagggggcgcuaggccgggagccgcagcgcgggagggacgagcccgggccggcggggggaggggagcgggaagcgucuuuguuguuggcgaccgggaucccuucucggcacaggggaaaggcggggaagccacuccucaucgggucuguguuuuugagaggauucucugaugguugcgugaaggggagcgguaggacagucccugcgguccguggagcggccggagucagggggugggggagggaggaccgaccgacacucuaagaaggucuuugguccuccucggugaagagaaggguuccauuucauuuccuuugcuuuucucucaguggaugaaaagauggggucagguucccauuccccucacuggcgcacugagagauucgcgggugccuaaaagcuuucuccugaauguccuuauaucucugucgggcgcgauuuuagauugaaucugcacggggcuuggcgauuuguguauuccgguggggcugucguaggguucuuuuucuuuagaugguugggcuuuaaucuuauuuguuuucgaacucuaagguaggcuuaucaggaaucguuuuugaauuggaaaauuuaaagguuuuguuugggauuuuuuuuaaccccgaaacaaaguuaugucaaauuagauuguacugugugggggcucucgugaaggaaagaguguauuuaaccugggguuuuuguuuaaaaaaaaaaaaaguucagaucuuugaucuuuggugagaucucugccaaugccagaagagaauuuuuuguaaaugaugcuuuaagucagugugaaguagauuugguaagcaaaaggaugaauaacggaauacagagggugaccuuuaaauuucgcuguuuaugaaauguguuccuguuuaauacuuuuugugauauaugaugcuugaucuauagaugauucauuuggaauuuuuuuaugccucuaauaaaucuuuggagaucuugugccaacauaugaaacuauaauaccuaaugagucggaguagaaagccagauacauguuguaauaacguuaaucuguuuagauuaacagggaaauuuacauuaaaaugaacuuuuuuccguaaagaguuucucuacauauguuuauagcaugaauuucaguugggugacaucuaaugauagccaguauuuugaaaauugucaugauugcuaguauucuaauuugagacugcucaacuuguugguaaguuuuuauuuggagaauaggggucguguuacuuaaggaacagcagagguaaaaaucucuguugugcaguaauugucauaucauuugaaauccagaaggaaaugaauggcaccuucaccuauauuuugaccucucuuuucuccuacucuaguguuaauaagguuaauuggcaaggacaggauuagauuuuuagcaggcuaggcaguuuuaauuuugucccuuagugugcaguauucuaguugaugaguagcuuguuuccuugaguaucuuugcccauuuugaaauguuuaugaaaugacugcugacaaagaauuuucuguuuccugggacaaacaaaaucaccaaaaaacaucaugaaaaaauaauguuuuuaguagcuuaaugaacacagaagaauuaagcaauuagugucuguuccaaguuugacacugaauuggucuacaacuccaggcacgcuaucccacaucugagucaguuuucuccaucuguaauauagggcugauaaaaugugccaccugcucacuuuauaaaaaggggagugagaaccauguaagcaacaguuacucugguuaugugacauugauauaaguuaaaugagaauacuuuuuaaugcagugcucuuacuuuguuuugauauuaugaauuucaaucauuugaugaacaguuagcauaaagauaaggagaaugacucucccuaugccaucauuuaagaauuaaaauuucuuccguauuaagauugguguuaagaucuuuagaagcagugaugacaagaaaauagaguauauuuuauugguugguuuauuuacugguagauuuuacuucugauuuauccaaaguuuugcucuuaauucugaaaauucccccuacccuuccuacucuuuaaaauuucucacauacauugccccauuugccugucgaauccagccuugugaguuggagagagggaaggugaguuuguggccuuuuuuuuuuuuuuuuuuuuugagacggaguuuugcucuuguugcccaggcuggcgugcaauggcgcgaucucggcucacugcaaccucugcuucccggguucaagugauucuucugccucagccuccugaguagcugggauuacgggcacccgccaccacucccggcuaauuuuuuguauuuuuaguagagaugggguuucaccacguuggccaugcuggucuucaacuccugaccucaggugauccacccgccuuggccucccaaagugcuaggauuacaggugugagccacuucacuguuuguggaauuuuuacagaugaaauaaauaaagcccagauaaguuaauuauuucaauugccuaaagcuaagcaauuaguaagaaguagaauugaggcuugaacuugggucuucucuaguccugaauccuuugcuuuggagcaguguuuuccaaacaccuguucaugcccaagaguuuuguccaagugaagugagaacuaacauagcaauauaaauguuggugccauacaauauaaugaauauccauguacccaucacccaguuaaacaaacaaaacuaccaauuaaaacgaaguguccggccaggcucgguggcucacgccuguaaucccagcacuuugggagggaggccgaggcaggcggaucaccuggggucgggaguuagagaccagccugaccaacauggagaaaccccgucucuacuaaaaauacaaaauuagccgggugugguggugcuugccuguaaucccagccacucgggaggcugaggcaggagaaucgcuugaacccaggaggcagagguuguggugagccaagauagcaccauugcacuccagcgugggcagcaagagcaaaacucugucucagaaaaacaaaaacaaaaaacgagguuuccuuaguauguuaauaccucucuuaaaugcuguucccuuuuccccccgauaucuaaccagugacccaaaguugacaugcauccuuccuauauccacguguugauacuuaacuacauaccuuuauccuaugaacauuauauauauauaguuuuauuuugauugucuuaagacuauuuaaauacagauaucuuuauuuagcuugcuuucuucacacaacuuggccaagauuuaucuauguuuauuuagguagcucuaguuuauuuacuuuuacuguuaggugguaugugcucuguuauauaacuaugucagguuucuguugauggucauuuuuguuguuuccauuuguuugcuauuaaacaguacuauaaggaauauuccuguauauguuagguaucuguuguguaagacuucuagagcagugguucuugacccuaccuacaucccauguucauagaaaauauuuuacaguacuuuaaagaaagcauuggccuuaauaaaauaagaaaaaauuguaauaaaguaauauguguuucacuuuguaaauacucgagcucaagacuacauucaagauuagccaccaaguguaauggucgaccagcaacaucagaaucccuugggagcuuguuggaaaugcagagcaucagacuuuaaccuacugaugcagaugcuguuuuuuuuuuuguuuguuuguuuguuuuuuaauaauguaaaagacaggaucucuggagccauacaacucacuguaaccucaaacuccugggcucaagggauccucccacuucagccuccugagcaucugggacuacagguaugcaccaucaagccuggcuaauuuuuagauuuuuuacagagacagggucuugcuaucuugcccaggcugaucuugaacuccuggccucaagugauccucccuccucaguaucccaaagcacugggacauugggauuacagacaugagccacugugcccggccagaugcuguauuuuaucaagauucccaggugaugcauauacgcauugaaauauaagaagcacugcuaaaagaaauaguaguaauuagacgcuuuguaccaauggauggugucuccaucaauacaacagcuacagauuaaaacagguauguuagccauucaauuaccaaugcugggccugucauugguggaaaaguggaaaaugauuuucugaaauaacaaacuauccucagaaaaguuuaaacagaaauaaaagugcaaucuuaccucuuuacacaaugauugcauucauaacaaaucaucuauguuaaaacuauacaaauaaacuugguauuaaauccuguuuagaauuaucugacauuaguggguuuuuuuuccucuuucuguuccccucuaugaauguccagcagaauauucaagucaugaggcauggagcagcacuauuuguuuauuuacuuacuuauuuauuuauuuauuuuuugagacagauucucacucuguugcccaggcuggaguguaguagcaugaucacugcccacugaacccucgacccccgccaagcucaaacaauccucccaccugggcuucccgaguggcugggacuacaggcaugcaccaccacacccagcuaauuuuuguauuuuuuuuguagagacaaggauuucaccauguuggccaggcuggucuugaacuccugagcucaagugaucugccuaccauggcgcugcaccccaccugcccccuccaaaagugcugggauuauaggugugagccacugcgcccaaucugagcagcacuuucuuuaugcaagaaaagugccuggcauuccuggccucuauuuaguagugccccucauucauuauaguagccaaaagcugucauugagaaagauugcccugguuuauaaaucugguaguagguugcuagaucacagcguaugaaugucuucaacuuuauuaaauaacugucaguuuucuguacaaaguacaacuuccaguccauaaugcaugagagagggucugcuugucugcauuucagauauuuuagaagguagaaaaauauuaguaguaauauuuuauuaauuuuugccauucugaggaguaugaaaugguaccucauuguaguuuuuauuugcaucuuguuuuaauguauucuuuguaauaauacuugguaggcauuaaaaauaucuuccagccugggcaacaugaugaaaccccgucucuacuaaaaauaccaaaacuuagccggguguaguggugggcgccuguaaucccagcuacucaggaggcugagacaggagaaucgcuugaaccugggaggcagagguugcagugagccgagaucgcgccaccacacuccagccugggggacacaaugagacuccgucucaaaaaaaaaaacaaaaaacuucuuccacucuuuagcaugcauuuucacuuuaaauauguugucuuuuaaugacuagaaguuuuuuaauuuuaauaucaaauguaucauucuuuuggagaaagccuucucuauacugggguuauaaaaauucuuucagagcaucuuuuaagaguucacauuuagaucuuaaauuuuuguugaacuguuuguauauaaugaggugcucauggaucuaaauuuacuuaaaaaugacugcccuuuauugugaaauuagguaauuuuuuauguuaagauguucugaugaaauuacagugauaguaauuguuuuuaguucuuaauaucccuuugugucaaaauuaaaauuugacaccucuuucauuccaacuuuucucuuuuuuacuuuaccuguuuuuugaaaucccuaagguuugguaacuacuacuuuaguguacucugauucuuauguuucaucugugucucacauuuacccacuacagcaucaucaaaugugaguagacacucuuaaauacuaaucauugauccucaucugcaucuuccacauuucggaguuugcuugacaugucuuuucaccacuuuuuauuauggcuaggauuuuaaaaaugauacugaugacccuaauuuuuuuuuaacagaauagaauuucaggcuaaauuuaaauguuacuugaauauaaauuuuucucagcuauagggucaaacuucuuuguuuuccuaguaauuaaaagugagaaugaucaaacaaguucuugcauacagcuaaagcugaaaaacgggaaaggaaaauugggccaguguucacuggguaccagucacuauucugggaaugggaggguggggaugacgucuaugagcaaaacaagcaaagcucccuagcuuccuggagcuuaucaccuaccagaggcccacugauaauaugcacaacaaauaauauauuagaaagugauaacugcuuuggaauaaaagaaaacauagagagggguaagguggaccaaaggaguuaguugaaccuguuaaauagggaagaagagaaugggcagagaugugcagucagugagaguauuagcaauucagauauuagcaaaauacuggaagaguggauagaauauggucuuuaagugaaaccuguguuccuggcucucuccaccuuuaaguugugugaacuugacaagcuaauuaacuuaaccugaauucuugauuucuucaugauaaccugggaaaaguauuauuaagauuaaaagauauaacaagugaaagugccuacuucccgccccccacuuguucucauagcacucuguacuuuauuuucauagcauuuauuacggucuauaauuaucugugucauuauuugauaaauauuuaucucacucauucuaaaacauugauggaaagaaccagucagugcaguaaaucuauuuuguuaacauacagucauuuguagacaaacccuaaaccuuuuucauguaaaaaucaucucaugcagauuuauugagaaaguguuuuguacuuauagaaugucuuuaugcuagagcuucagauuauauuacagguauuagcccauuaauuaccauaugucaucuuugugaugaaggcaauggauauguaucaucuugcaguugaaggaacugagguugcuaauugcauagagacagaaaaucagagaauuuggaucaaaucugauuacauuugauuauauuuuccuuucuuuucuucaauaguguuaacauggacucucuuuaaaguauaaaagcaaaaauacguagauuguuggaaaaucacuagcaaacaagcaauuaauauuuuaguuaugacuuuucaguuuuuuccucaugagaagcuucuuauagugucugaggugauguuagaauucuaugcauguagcaaacacauguaccccauaaauagguaaaauauuaucuaucagugaaaaaaaaaaggaugacaauaguuagaggccuuuacacuuaaaaauacuuuauacagauaaauacuuuuuaaaauuauggcuuaucagaguauuuaagauuuauguugaggauguagucacauuaaaaggguaggauuuagaaaaugcauagcacaugccuaauguagaucagagugaagaaaggggguugaaauaacuucauuuacuuggugcagccaagucuccauuccaaucacaagaaacuugaaguaaagcaagugccuccaggaacaaaaaagacauuaucaaucaugucaaacuuguuuggcuucugaauuuagauguuuuuuuaaguuuguuuugaaaauuaaaaucaauggaaauaauucguauaauaaacuuuucccaaaaaugucaucugcagauugugaccuagauauuuuguuucugauuacuguccugcuuagugugcugauaauuuuucacucuagcucuguggacccaaccccuaaaaguaaugauuauucucugcauaucaguuauuagcaaagaaaaugucauuuaguaacuuguguuggcaagccuacaucugaaacacuacaaguuacauuuucuuccgagcuuuuuaacagaccucauugucacuuuuauuaaucaaauaguuaggggcugaucacagucccuuuacaacuaauugauaacaaccugcuacagacuucuuuguuccuucuccaguuccacugcuucauuugacuagccugaaaaaaauaaaaaaacuaaaagggugggggugggguggaagguggggguaaugagauaauagccagaagcaggacuuuacauauauaaagggcguucugauacaaaccccuaggguaauggcuuuccauuuuucauuagauucuauaaaaaauacauuuugcuucauaaccuaguucauacacaugcacccaaaaaccaaaauaagucucacuaaagagauuaucuaaauuaaucagcaugggcacgggucaggggagacuguuuuugcccccuacggaaggaaguacagcuuaaacagagguuuaaaaacuaguaaaaguuucauuuauuugaagggggagugaugaguuggggagauuuuaucaacaaaaaaggaacuauaugugauaaggcacagaagcagaaaagaaccucucuuagcgaggaacagccuguuaaauuaaauaaaugaaucggacagugcucagaaauaaggcuagagaccaaggaggguagggggaaucauguauagcaugccagagaauuuagacuuauuuaagagggcuugaaaggcccauuggaacauuuuaaacaggaaagugacaucaccugguggcaguguagagcauggauuagggggguaugaaauagauauuagugagugauuuuauaacauucauugaaaagucguugagcuaaaaauguggcuaagagguuuggagagagguccauaggaaguagaccuugauugaaugagaggaaugaagagggggauggggaaagagugaaaugcagguggagauauuucagagucuagaguuuaaggggagagaccugaaaucuuagagauuuagauuuuuagaucuagguaacauuguaguauaaaggguaguuaaagcauuagguuuaggugcgauaaaaagaggaaaacaaaagaccaaucuauaaaaauaaauaaauagguuaaaaaagaguuugaagaaaccaucagagaaaccaagauugaagguuaauuucaagaaggaaggaaaggacaacgauguuaaaugcuauaaagugauccuguauaaauugaagauugaaaaacaccuguuauacuucgaaauuguuaagagguugucagugauccuacaaguugaugauagauguuauauuacaauucauuuugggccugacagggaauauugguaagugagaaguaaagagguuugauucugaaaaaagaaaaacaaaaaacaaacaaaaaaaacaacucagguacaguagguagaaucuagauacagauacaugcaaaaaaaaaaauuauuuauuuauuuauuuauuuugagacagagucucgcucugucuuccaggcuggagugcaguggcacgaucucggcucacugcaagcuccgccucccggguucaggccauucucuugccucagccuccugaguagcugggacuacaggcgcccgcuaccaugcccggcuaauuuuuuguauuuuuuuuaggagagacgggguuucacaguguuagccaggacggucucaaucuccugaccuugugauccacccaccucggccucccaaagugcugggauuacaggcgugagccacugcacccagcccaugcaaacauuuuuuaggcaagugcaugaacucugauguggaaacagcuucaugcuuucaagauacugaaagauggugagugagagaggcugcaacuauagugaugagggggggauaguaucaagauaugguuggaggaguaagcaaaagccacuugacacaaggccuuuaaggaccuguggagaaguuugacuuuuuuuuuuuuuuuuuuuuuggagauggagucucacucugucgcccagaccagagugcaguggcaugaucuuggcucacugcaaccucagccucaugaauucaagcgauucuaccaccucagccucccgaguaauccugggauuacaggcacacgccaucacgccuggcuaauuuuuguauuuuuaguagagacgggguuucacccuauuggccaggcuggucucgaacuccuguccgccucagccucccaaagugcugggauuacaggcacgagccaccguccccgaaccuugauuuuuuuacaaguagagagagaagccaucaaggaguuuuuaagcgggaaaucaccuuguaggccgucuagaaaagaaacuguagauuaggagaacauaugaauggaagaaauucacauuuacucaaauauuuuucuuuguguuuacucgcacauuuugaguuguucuuucuguuuucuuauucuauauaacccuaguuaguccuuucauuuccucauagugagaaacuaguacaaaaaggauagaaaaggcaaucuuaauaaauucagagaauugcauuuguucuuauuuacaauuaaagaugacauaaauugacuuuucaauugaacugucuuuuuugggguuuagacuuuuaagauauuaaagucaaugaaaauuuccugccuaucugauacuguucuggcuuguuuuuaguaaggcuccuaaagaauuuacuuuucuuuuagaaaugucauuuagaggcuuuuaaaauauucucaguauuuuuaauggaauguagaauuaaaguguuuuuuuuuuccuguaaggacaaggcaggaagagagccauauuuagcugcauaaagauaauguuaacauaggauaugauguccccgaaauaggcaguuuacagagaagagggaggauuuaguauaauuuugccagagaagcucuaugucucauagugcauuauuuucacauuaaaauugaggcaguagggggcauagagcucauuuaaauagaauuauagccagaaccuucauuuuccaacucuugggcuagugcuccuuccacaauuccuauauuuccuacagguccaaguaauguugucaaagauauauuuaauucaucuaauaacaggguccgugggaucccugccuaaaaggguauucaagaccauuuaguaaccugaugugcaacauuuguaagggugagcaaaccacccaucuuaaaugccugcuuucuuccuuaucacaaagaaguauuuacaccaaagauacccuagacauauagacuaccaaauaaaaacuacaggcucagccuaugagauucaucucaaauaaaggauuugccucaauguuuuuacaaaccucuucugcuuuccuccaucccacucuuccccaguugcauuacuuggcauacagcuuuggaaacauuguucugucagcuuuggcuaaaauacuuuucacaccuacccuaggacauuucuuugaaagaaaaaacaaaaacaguauuugcuuguauuguugcuacucagcucucuuuuuuuuuuuuuucccugagagucuugcucugucgcccagguuggagugcaguggcacaaucucggcucacuguagccucugccuaccggguucaagcuauucucaugucucagccucuugaguagcugggauuacaggcaugcaccaccacaccuggcuuauuuuuguauuuuuaguagagaugugguuucaccauguuggccaggcuugcucugaaacuccugaccucaggugauccauccaccucagacucgcaaagugcugggacuacaggugugcaccaccacgccuaauuuuuuugguagagacagaguuuugcaauguugcccaggcuggucucaaaugccugagcucaagugauccaccuaccucggccucccaaagugcugggauugcaggugggagccaccacucccagccagagauuuguuuuuaaauuucucacaugucuaaacccgcccuuucccauguguguuguuuguuuguuuguuuguuugaaauagaguuucacuuuuguugcccaggcuggagugcaaaggcacgaucuuggcucaccgcagccuucgcuuccuggguucaagcgauucuccugccucagccuccugaguaguugggauuacaggcaugcaccgccaugcccagcuaauuuuuuuuuuuuuuuuuuuuaguagagauggaguuucgccauguuggucaggcuggucucgaacucccaaccucaggugaucugcccaccucggccucccaaagugcuuggauuacaggcgugagccaccaugcccagccucccauguuuuuacuuccuuuccaccaugcacccuaugcuuuucuucuuucucacuuuacacauuauccuccuagccuggaggauuuucccuccguuuugggaagucauaucuaaaugaaguucuaauucucucacaaaggcuuuccuaauucuugaucucugcugucuucugauuucugaaagcuuaaaaucuacuccacauuaaauagcccuuaauuuuuuauuggaugaaaagacccuacagaacauuaauucccaaucuguuaaauauauuguucuuauuuucuuauauuaggcaucuagucuauucuuugaaaucuuuauuccauuucuucuuaagcacuacugaaaaaaaauguaugaaaagacaaaauuuccauauuugaagaagguggugaaauguaaacuuuuugaggcuggaaaaguuuuauuaagcacaaguaacaaguguuuguuacacaucuaagaguagugcuauuucuucaaaccuuuacuuacagaugcauaugauuaagggaaaacagcugcagccagaggaaaaggaagugguagagaugacaguuuaugcagcuagccaaacuggguagacaaacugaaggccacauuaguaaggauugacugacauguuacaacaucuauguaaagagaguuaaagaguauuacauuuauauugagagugcauaaauguuauaauucccccauaucucuacuaaaaagguauuauauauaguauauggaaaagggauugauaguuaaacgaggaauauaacuuccuuugggaaauaaauucuuugcaagauggcuucauuuuaauuucauuuuuuauauuuuuugagacagggucuuccccuguugcccaggcuggauugcaguggcacgaucauggcucacuguagccucgacuccugggcucagguacuccucccacuucagacuccugaguagcugggaccacaggcgugugccaccacacccagcuaauuuuuauuuuuuguacacacuauguugcccaagcuggucuugaacucaggcucaagugauccuuccaccuuggccucccaaagugcugggaugagccacugagcguggccugcagaaugacuuuauaucucguguagggcaagguuacaagaaguuuaaugauauggagugguugaaacccucuaagccaacuguuauuaauuaguuuuauagguuauucuuggagcugccacuucuguaacuuuucuugguuaaucuuuagguaaaaaggggacagauugauuuauuagccauuaguuggcaccuaaaauucuuucuaguuauaaauucaugugucuccaaugagagaccuaaacauuuucuuauuguucuguacuuccucuugggcacccaccacugaacaucuuaacccuuauucuaagagguuuuguauauaaucagccccagggcugcuagaagagagaaaugacauuuccuaaccaaauucagcuucuucagcucagaaaaaaggaucuuuuuuguaacaacaugaaaaccuauacagggguuuaaucaauuuucucuauguccauuuaucccauuuucccuuuuaauucugucauuugccuuugaaaaggugaggagagggacacuccuaugucuugaagaagguauauauauauauguguguguguguguguguguguuuugguagaagauagaacuguauauauacauagacccccuguuuauuugcuugacuuuguaauaaccaucagaggacuuuuuaaacagcauuuccacuaggaaaagcugaagccuuaugcuacaaauuuggcaucuuuuuuauucgcaggcugaaauucuaacccuccuccuucaccaguaucucuaaguuaccaagaacucaagauauuuuuuagaaguuugauaucuugaccaaguucucuugaacccccacuggauaggugacagaacuagggauauuccuuaaugcccguauguagacauauuuucagggcagggauaagaagucugcuacuacauuuguagucugcaauuuuaugcaauucuaaaagauaaaaaaagaaauugaagucaggaguacaauguagaaauuccuaucuacagcugagaauguuaaucauauagaagugaaguuggggacagaaugagcauucacugaaucaagauaugaguagauuaagauucagcuugguuuauuuuguaacaaaugucuuacacagcacuggaaauauccaucuuaaccacagaugagauaggugcaaaaaggaaggguucuuuuagcuuucugaauagaaauuaagauauuauagcuguucuagauugggugagugguaaagccugagaagcuuaaaaugaaaauguaauauaucuuaagaaccuccagaguuuugagaaaguaguuuucaagucagucuguuauuaaauauuuuggaccuuuugucccaaaauuuugcauguaguuucaggaguuuuccaugaaccacagcucuaaauaguccuguugcauuccaaaguaauuuuuaggcuugaccccaagcuguuggcacauuaagugauuuugcauggaauugauuaaauaguaccuagcuccgaaccauccaaauaaggguuuguccaaagucaggucugagagcaauauacaguauaauguuauccugagacauugacauuuucugguagaagauauuaauaagaaaguuaacuaaguauuagaacauugacagauugguguuucagaggcugaacagcuugaugcauucuucaaauugcagacuuuacaaaguaagguaauguaguacuucucaacuuuaaaaaucuauacugggucauagccuccuuuuuccauacugguauucuacagaaggcagaagaaucuugagaguaaguugcaaagacagauaauucagccugaaacacaauuauauacccuauuuggccaggacauagucuuuaggcaaguaaguacuggucuagucaaauuccuuaagaaguuauaacuucuuggcuuccaggucuaagaacacuuccugaugacugcugaauaugaaaccuggcuuuaccauuuacuaacacuguggucuugcauaaguuaaacuuaucuauguuucuguuuccucaucuguaaauggggugggaggagggaggaaaaaauaauaucuaucucauaggauuguuaaagcacuuggagcaagaccuaguaagugcugcauaaguguguuuugguaaauuaacacuagccuggcuuuucuaaccuagcaaaguuuuaaaccugaaaguuuggauuugccagucaauaauaauacuguuugauuuguuuugacaaaauucagcucagccagcaguggcuuuugagugauuucuguguggcagccauugcuagguguagguauacuugaauuuaaguaugugcaguggggagggguauguuauaugguucaaaacuaauaaggacaaacaugaccuuauaguuaguaaaugauuuaugaaaugguucauuugauuaauuguacaaucaaaagaaacuuuuuuuuuuuaggagacguguucuugcuuugucaccuagacugguagugccauggugugaucauagcuuacugcagcuucaaauuucugggcucaaguauucuccuaccucagccacccaaguagcuggcaugagccaccacaccuggcuaaaaugaacauuuuuaagcccaagaagucuaguuccuuuugaaauaagacuuucugggcccuuuguauacauuuccaugcuuuuagaagguagcuuuuaauaauauguacagacugcaauuuaauuuuuuaguaauaaugccccaagugcuaaagauaaaacuucuaaaaauuuuggcagcugggugucguggcggggcaccuguaauuccagcuacuugagaggcugaggcagagccuacuugaacccaggaggcagagguugcagugagcccaaauggugccacugcacuccagccugggcaacagacugagacaccaucuuuaaaaaaucuaaaaaauuugaaauuuaauguauuuauuaccuuaauccaguuuuauauguauacacaaauugguuauaguaucuauuuuguuaccaacugauaaauaagaaauaagucaaacaucaguagaugaaaggacaagcaaaaugugcauuauauugugaaauauauauuugaucuucauucuuguguugugucauacaacuccaacaauccuuagaaucuccaaagugaaguauccuuuuuuuuuuuuuuuuuuuuuuuuuuuuuuuuuugagauagagucucgcucugucgcccaggcuggagugcaguggugcgaucucagcucgcugcaagcgcuguccuggguucacaccauucucuugccucagccucccgaguagcugggacuacaggugcccgccaccacacccagcuaauuuuuuuguauuuuuauuagagacaggguuucaccauguuagccaggaugaucuccaucuccugaccuugugauccacccgccuuggccuaccaaagugcugggauuacaggcgugagccaccgcgcccggccagugaaguaucuuuguaugcuaacaaguugacugaaagccaugcaccucuagguagcuauuggauggauguuaguuacccagaaacaggcaggauuagaggguugggauuuacaguccugccuguuaaucucuggguaggagagagggcgugaagguuaaguugauaccaacagccagugauuuaaucaaucauugccuacuuaacaaagcuuccauaaaaauccaaaaggacuggauucagaaagcuuccagauggcugagcacauggaggguggcauccccuuccuacaugccuugcccugugcaucucuucaacuguauccuuuguaauauccuuuauaauaaacugguaaaucugucucccugaguucugugcgucgcucuaacacauuaaucagacuggaguaagagguugugggaaccccaauuuauagccaguuagucagaagcauagguaaaacaaccuggggcuuuagauugggauuggaaguggggagcccucaaccugugggaugugacacugucuccagguagauaauguuggaauugaacugggugggaggacacccaccugguguccacugcagaagcgauugcuugcauugggggaaaucucucauacaucuggucacagaaguauucuggugauuguuguggugugagugcaaaggacaaaauaguuuguuuuagguacaauggaauauuuuucagccuugaaaaggaagggaaauucuaagacaugcuacaaugaaauaagccugucacaaaaggacaaauauuguauaauuccacuuguaugagguacuuagaauagucaaauucauagagacaaaauggugguugccagaggcuggcaggagaagaaaaugauguuauuguuuaguggguauagaguuacaguuggggaagaugaaaaauaaaaucuggugauaauugcacaauaauguggauguauuuaaugccauggaacuguacacuuaaaauaguaacuuuuaucuauauuuuaccauaauuuaaaaaacacaacauuauuucccuacagugaccaagauacaaaaaccacucauuuuggaaaacagcuguaggaaaugacaaccucccuuacucucucaccucugcacuucccccaccuuaucaccugccuucccccccccaaauuaauuugcuaaauguaaauuuauguuuauaaauuuuauauuaacuaaauuuugguaaauauaguguacuuguuuaggagcuuuguguuuuuuguuuguuuguuuuuguuuuuuuuugagagggagucucacucugucacccaggcuggagugcaguggcgugaucuccucucacugcaagcuccaccucccggguucaugccauucuccugccucagccucccaaguagcugggacuacaggcgcccgccaccacgccuggcuaauuuuuuuguauuuuuaguagagaugagguuucaccguguuagccaggauggucucgaucuccugaccucgugauucgcccaccucgaccucccaaagugcugggauuacaggugugagucacugcgccuggccaggagcuuuguuuuuaguagccggaacaacuuugaaaaccugaaguuuuucaaauuauaaauuucuucauucuuuuuauauacuauggaagauuguaucugaagcuuaugagaacaucuuaguuacaaaguuuuagaacuagaagaaaccuuauuaucaguuuaugcuuuucacuuuguagaaaaggaaaaugagguauaaagagauugacuucccuaaagucaccagcuuuuuaauaguaaaacuagaacugaaagccauggcucuuuugauucuuagugcucuuuggacuacacugugcuaucgugcuguccaaaggcuucguuggcaucucacuagaagaauuuacuggguaaaauuuuuaauuacauuauuggaccaagaguuaaagcuguacuauguucucgaauauuuguaaaguaucuucuggucccauugaagagauaaacagaacauacuuguuugcccuauagacaggguaugagugugugugagagagagagugcguauguguguguuugugagagacagacugacacugacuacucuaucuccaaaauccucuuuauucuagcaguuacaggaguuccaauucugcagucaguccuauucagacuauaggccuucugggucaauaggcuuacacaaauauaaaggaaacccaauuuaguucuuugcuuagaaauaugaacagucaagaaagaagcauuccaacagcaugaaacccaagaugaacaagcauuaccugaaaaacacaaaugaagagaacaaaaagaaaagcuuuauagauauaguggauaguccuaggauuccuaaaaaggaauuccacauggaacagagaagauggagaggaaauagaagaaaaauuaucugagcuaaguaaagacucggggcuuuagaucaaauggacccauuaaguauaaaacaaaauggacaaacaauaacacacauuuagauaauaggcuuaugaaauuucagagcuaaggauguagggaaaucucauaaauauuuuugagagaugagaaucacuuuuaaaaaaucagauugguagacacuuuuauuacuugguacuagaaaauguggaccaaugauuuaaauuucgaggagaauuuuaagaaacaaccuauaauucugaagcagaccuaguuugcuguaaguguggaaguauacauaacaguguaguuuacuucgccagaccuuuggguaagggggugggggguagugcuugggaguuguaguacagcaaaaucaaacaaaaaaaucuuacaaaaaggagcuugagauucagaaucaacagagguaugugaugaaaagaaguacuagguaggcaggcaacugggcugugaacuaacccagaacauaauuauuucaaauuaaaacagaaaucacuggggucuaaacaugucuuuaagaacaacauggauuuuguugaacaaauucuaauaaauuggaauauguuaaauguaauaaaaaggcaaaaacuucagaaaauuaaagccucuucugaaaguccaaaugugaagcaaacgaaaaugugccuuauuuuugaacagugagguguaauugaguaucaagaauguaaacaccuugacacuuggaauuuagugacauaaaauugcuguuuauucucugaguuuuaccaugccccuuggaugggcagugaaugacacuguaaguacuuuuuauuauccaauuaaugagaaucaaccaauagauaaaaacuuaauaaauugcaaaugauauaaaacuuaaugugaaacuuaauuguauagucagcaauaaugguauaugauuacaugggggagccagaagaaacuuccuaaaguugauagaauaagaaauacagguucagcuauaauaucuaaaguuauaacuaauacaaacuaaaauaaaucagaaugagcauagaaggugggaauuaggguaaaucuucucagucuuucgugugugugugugucugugugacagaguccagcucugucacccaggcuggaaugcuguggcacaaacuuggcucacugcaaccucugucuccugggcucaagcuauucuccugucucaaccucccgacuagcugggauugcagacaugcaccgucacucccagcuaauauuuauuuauuuauuuauuuauuuauuuauuuuuauuuuuaguagaaacagggucucaccauguuggccaggcuggucuugaaacuccugaccucaagugaucgaccugccucugcuuccuaaagugcugggauuccagguaugagcuaccuugcccagcccgcucagucuuuuauaaugaggcuacacugugauaagaaauaauggauuuuuuuaaaaaaugaguaugguaguaagcacuagaagaauuaaaaacaaaugacccaaaauuguaauuucugagaacaaggcugagguuuggguugggauuagggaagagacuaaagaaguuuuaaguguuuuuuuguuuguuuguuuguuuuggucauuuuuuguuuuuuaucaguuuuguacauguauguggucaggaagccaaauaauucuacaaauucccaggggcauuuaguuauuuuugaaugauucuuuugguguuuacuuccaugucgcuagauaacaguauuauauuacuacuucuuacauguugacaucccacuuacaguagagagcauagcugucccccaccaguaucgcacaaauacgcucccagaucccccaacuucccuguguaauuugccauaucagucucuuuuaagauaugucuuucagauuagucugauuccucagaggagguuuucccaauauaaaccucuacucuuaugaguuggagacaguaucuagggaacuucauuuuuugaaguggacuuuuaaccaauccuaauuuuagccuggcgaggagacuuuuaaaaaauaguguaacaugcgguuugauuuuuuuuuuuuucuuuagacggagucucgcacugucguccaggcuggagugcaguggugcaaucucggcucacugcagccuguaccuccuagguucaagugauucaccugccucagccucccgaguagcuaugauuacaggcgccugccaccacgccuggcuaauuuuuuuguauuuuugguagagauggaguuucacuauauuggccgggcuggucucgaacuccuaaccuugugauccgcccgccucagccucccaaagugcugugauuacaggcgugagacacugcaccuggcugguuuguuuuuuuuuuuaaacuuugucuuguaauacuuucauaauagcaauguuauuucuuaaaauaucaaaucccuauuguggaacuugacuaauauuuauuugcauacaguaguaguauuaucaccguuuacguuuuugucuuuucacuguagcucuaauauguuuuacagcaguuucaguugccuaaaaaacaaaaccuuuguuguuguuugguaaaguuuuuuuaacuuuauugaaacaccuuauuuuauuuacugcuugguaaauaaggguuguguggguccaugcucauaugcuguauugaccuguaaaugguuuuauaaacuuuuuguauaaacucuuagaaauaaucuuuuuuguaacucuuagaaauucaaacugggguacccauaauaugaaccucuuuuuaaaaaaagauuguauucauuauuuauaaucaauaauccuuaaauuuugugagauuugugacuacauugacuagauaauauugagguacauauggguguucuaugguaugaaaaauacugaguagguacucaccugaaaaguuucucagggacuuauuuuacuuauaaacuagggaauaaugugcauuguggaauguuucuggaacaauguaauaugacagcuuuucuaugaacuuugaguuugaggauaagcaugauuuggauucuuagaauagaaaugccaaaagcugaugauuagggagagaaaacaugugucuguucaugucuagcuuacgcucagcaacagguaaaggugugacuuuuaaaagcccugagcuaauuguacuuuccagucaccaaaaguuuuauaggaauaugugauacuagcauaugcaaaaaccaacaaccuauuuuacugcuccaucaguaagacuuuguucacuuguuaggacauugcucugguggaucaucaagauuguaaguguuuaggauacuguuuuggacuauguucagaaauucauuagcuaauagucacaaguguuuuuuacacuuucucaugguuuacuugcaacuucagcuuacaaggaaccucucaagaacaugaauccuuuugauucaucaaaccguggauuaaaacauauagauagccuaauugaguugcacugcucauuuuuaauaaaauggcuuuuauguuagaauuggguuagaaauaagucugugucauaaagauaaaauuuuccagaauagucuuguguaggcaaucucacuuaguucuguguguuuuaucaauguucaacagaaagaucuaugagauuuacguauauguacuuugauggaaaagccaggaaggaaggugcucuuuagcauuugaagcuaguaugaauuuaaagcauggaacuguuuguucuggauugucuggguuucaaagguuuucguucagcacugcccauuagggcuuucuguagugaaagaaauauucauacuaugcuguguaacuuguagccacaguggcuggugggauugaagaagugaauauuuaauuuuagguaauuuaaauuuaaauaaucauauguggagagugagugcuuagcuagugcagugucuagcaguaucaagaaacugagggaaaacaaaaguaauaaaaagcacugcauuaaaauaaauaggacuucugacccaaauuaguuugcuuggcacagcuuauagacucuuuacccuuaauuuucaucuucuacuauaaugucaucauagaucuaacaucuucauuucugaaccuuacuagcuuuuuuuuuacuaggauaguaaguucacaacuuacacuagaacugacacuauuuugaugucucugguugaugccuccuaucuucaccucaacuuucuuuuuucgucuaacuccaguacuuuccaccagugagaaaggacucuuauuugcacauugcccaguacauuuuuuuuuccauuugagaaacuccucuaaauuuuucuaaacucaaauuauuaaggcguuuguucaguuuaccccaacaaaacccacacuucuaaggguguuuucaagugacccauuggcacuguuacacucuauaucuagaaucuuauugguauuuaaaaauugcaacuuuaccuuaaaaguaccagacaugauucuuuuucaaagaagagguuuugcaaaaauuucuucuuuuaauucaaaauauuaaaacauuaauauuuuuaaauuuuuucuccgaguuuaaaaacucauguagcaugcaguucauccaguuugugucuucaagcagagcugacuuuuuccugcaaagucaccugaauuuugagcccuuugaucucacagaugaaacuuguuucaucugugaacccguuucauccaugaaacccugucucuacaaaaaguacgaauaauuagccagacaugguggcacacaccuguggucccagcugcucgggaggcugagguaggaggaucgcuugagccugggaggcggagggugcagugagccgagaucacgucacugcacuccagccggggcaacagagugugacgagcuuugguccugcauaaggcaugcccagauaagauagaaaauguuuuaaaacauuguuacaacuaaguaccuccuguucaaguuguaguuagugaguuaguggauuuuuuuuuuuuuuuuuugagacagggucucccuauguugcccaggcuggucuugaacuccuggccucaagagauccuccugacucggccucccaaagugcucagauuacaggcaugagccacugugccuggcccaggaaacuuugauacuguguuuuggaugcuucaucuucuuucaaggugaauauucagcuucucuguauguacuaaacucuguaauguguauggcuuucuaaaaaccauaacacucagagcuuagaguuucacauguagcuauacuuugaauacuacuacagauuacacagaaugauauugcauccccagaguuauccauaaauggaguaauucaucuugaauuuuagacuauaguucuuaacaugaaaucuaauauaucaaaauuuaaaugguuuaucacauacaguguacugagcauaguugucaacauaucacacaaaaugaagaaagauauaagcauucuuuuaaauguuuucucuaaaccugcuuuuaaagacuuuuaaugcuaguucaguacaacaaaaaucuuaaaccuuauaauaauuaguaguaauaugaguuggucugcauuaccaagaaacuauuacaaggagaucaaaaggagauuuuuuuuccccuaguaaauuguuauuaugucaaaaauugacaggagucaugucaguaauuucuuacguuagaagagaggaaggagauacaguaggucauucuauuuagggacuuuuuuuuacauuagucuuccuguuuugcugagaaagaaucaguuauuuaucuuuuuucuuugucauugaggaggaaaacguuaccaggagaagcagauucuuaaauuauuauuucauacaauuuuaggaaauugcucuugcuguaagugaagaaauuguugaaugcccugccaaaaggaaaaccuuaauuuucacaaugggccaucuguuuaacauugaggugacccccuuuuuuuuuuuuuuuuggagacagagucuuguucugucacccaggcuggagugcaguggugcaaucucggcucacuguaaccucugcuucccggguucaagccauucuccugccucagacuccugaguagcugggaugacagguguacgccuccacgccuggcuaauuuuuauauuaauuauuauuauuuuuuuaguagagaugggguuucaccauguuggccaggcuggucucgaacuccugaccucaagugauccuccugccuuggccucccaaauugcugggauuacagucaugagccaccguucccggccugaccuuucauuuuguguauuuauugcaagaggggcaagauucccuccucccuggaauaggguccuucucuguguuucauaacacauugagugauuugaguaacuugcaaggcuuuuuccaccugcccccacuuagguucauagauuuuuauuugacugcuucucuuuugcccccauaugaaaaagauucuguuuugcccccauaugaaaaaccuaaguaauaguaacaaaacauuuuugcauuuuuucuugacauguaaauuuagugaauuucuuucuuuuguaggagcuucuugggugcaaagaguugaaucagucuuaauaauuuacuaacucauucauuuaagaaauauuagaaacccuacuauaugucaaguauucugcuugauacuagauguccaguuguaagcaagcagaugugauuguuacccucuggaauuucuaaucuaguucauggcgcauuaucaccaucaaucuaugagcauaggcccugcucuuguuuuacuuaauuuccuuuuuuuuuuuuuucccuucaaccuccauccccauuaccccuuugguaagcauauacucugacauauguacccuuagaaauguauuuguccucaaagauaauguuuaugucuguuuugcauguauguuaaugauauuauagaucuguucguaccuuacuuuuuucacccaauaccauuauauuuaaucccuagucaucagucuuugcuucugacuguguuaauuuucuauuaucugcauccaacacaugcuuacucauuuccccaguuauggaaccuauauugcaucucaggcccugacacaaauaauacuucagauacacuuaaaggaccugugcaaguauuucuuuguaguacuuacccaagagagagauucugggucauugguaaacacaauggcuuaccaagcaguuuacaaagauuuccauuuuccccauucucaccagcacuugauaauacucagcuuucuaauuuuuucuuuuaguuuugauguauuauuuuuugauuucucugauaguuggugagguugagccuuuuuucauauacuuguuagccauaugaauugccuauuccuaucuuuugcccauuguucuugaguuacccaguuuuuucuuguuuuugcugaaguucccuacauuuuaaauauucugacaguuugggaugaugaauucauccaaaaaaggacauuuaucuuuucucuuucuuuuuuuuuuugagacagagucuugcucugucacccaagcuguagugcaaugaugcaaucucggcucacugcaaccucugccucccaggcucaagugauucuucugccucagccucccgaguagcugggauuacaggcacgcgccaccaugcccaacuaauuucuguauuuuuaguagagaugggguuucaccauguuggccagguugguccugaacuccugaccucaggugauccaccugccuuguccucccaaagugcuaggauuacaggcgugagccaccacggcugcccugacauuuuucauuuaagagaaauccuuuauuugaaugaagcuaaaucuaccaauguuugucuuuuguggauuguguaaaaauuaguuuugcucuuuaagucugugaucugccuggaauuugcuuucuguauuccaugauguagugauccaaccacuuuacccaugugguaaguuuucccagcacaaucuacuaaagaauccauccuuuccuacugcuuugagaaaccagcugugucaaucccuagucccauucacauagggguuuauucauaagcucuguuacuaggucuauuuguuucuguaccagcaccacucugucuuuauuacuuggacuuugugcagugugucuuaauaucugggagggaaaauuccuaucuaccccacaaauacauguauauaccuuugcucuuuauagacauuuucugguaacuucuuuauuaauauauaauugacauaccauaacacucaaauauuuaagauacaacucaauuuuuguuuguuuguuuguuuugagauggagucucgcccugucgcccaggcuggagugcaauggcgcaaucucagcucauggcaaccuccgccucccagguucaaacgauucuccugccucagccucugaguagcugggauuacaggugugugccaccaugccuggcuaauuuuugcauuuuuaguagagauaggguuucaccauguuggucaugcuggucuugaacuccugaccucguguucugcccacaucggccucccaaagugcugggauuacuggugugaaccacugcgcccggcaauguuuuuaauauauauauucacagaauuuucacagaauugugcaacaaucacccaaaucaauuuuagaacauuuucauuaccccagaaagaaaccuguuauccuuuaguuauuauucuccaucccuccuguucuccucauccccauuuuauggauauauauacuaccuuuuguuuuguuuuuguuuucuugguuuuuuuuuuuuugaaauggaaucucagucuguugcccagguuggagugcaguggcgcgaucucagcucacugcaaccuccgccucccgaguucaagcaauucuccugccucagccucccaaguagcugggauuaaaggcaugcaccaccacaccagcuaauuuuuguguuuuuaguagaggcgggguuucaccauguuggccaggcuggucuugaacuccugaacucaggggauucucccgccuuggccucccaaaguacugggauuacaggcgugagccucugcugcgcccagccuacauuuuguuuauccauucaucagcugguguacauuuggauugcuuacguuuuucagcuauuguaaauaaugcugcacaugcauguacaaguuuuuguguggacauggguuuugcuuucucuugagaguagaauugcuuugucaaauggcaacucuuuaaguuuuugaggaaauaucagauuguuuucuaaugugacuaccauuuuucuuccuaucagcaguguaugaggguuccaauuucuccaccugccaaauaaccuuuauuauuaugucuuuuugauuauagcuaucuuaauggagaugaagcuguaucucuuugugguuuugauuuccauuuccuugaugacugaugguguuaagcaucuuuucacaugcccauuggccauuuguauaucuuuuggagaaaugucuauaaaucccuuugucuauuaauuggguuguccuuuuauuguuuuuuuuuuuccuuuuuuuuuugguuuguuuuuugagacgggagucuugcucuguuccccaggguggaguacaguggcgugaucucagcucacuacaaccuccaccucccguguucaagugauucuucugccucagccucccgaguagcugggaauacaggcacgugccaccaugcccggcuaauuuuuuguauuuuuaguagaggcaggguuucaccauguuagcaggauggucucgaucuccugaccucaugauccguccgccucggccuuccgaagugcugggauuacaggcuugagccaccgugcccagcuguccuuuuaaaauuguugaauuguaaagguuauuuguauuuucucacauucaguagguuguccuuucaguauccuugugucuuuugaaacaugaaaguuuuuaauuuuggagucugauuuaucuauuuuuuuuucuuuguuacuuguacuuucaguaucuuuucuaaggaaacauuuuauaacccaaggucacaaagauuuaugccuauauuuucuuuugagaacuucauaguuuagaucuuacauuuagucuuugacucauuuugaguugauuuuuguauauggugugaaguaagaguaaaauuucauucuuuugcauguggauauuauguugcccuagcaccauuuguugaaaacacuucuuucaccauugaauuguuuuggcacucuugucaaaaaucaacugaccauaaaugucagguuuauuucuggauucucaguucuauuccuuagauauauuuguccuuaugccaauagcauucugucuugauuacuguugcuuuauuaugaguuuugaaauugggaagugugaauccuccaacuuagguuuucuuuucaagauugauuuggcuauucuggguuccuugagguucuguaugaauucucugcauuuuguuuuucuugauuauaaguggaggagucuuuuuucuuaguuuuauuuuuuuauuuucuauagaccuuuauacuuuuauauaaauuuuauaaucacuuuugaguuccucaaauuucugcuggaauuuugaugggaauuaccuugaaauuuucauucugggagaguugacauucucaaugcuauuaagucauucuuuccauuuuuuaauguucuuauuuaaaauuuuucugcauaaagguuuucugcauucuauuuuauauuaauuccuagauagucguuuugguugugggugcgaucuuauuuauaauuuuuuuaacuauuuuuaguuguuuaaugcuagcuaacauugaacuguaccaacuuuaccuaaguucaugcauuugccaaaauugcugagaagucucauuuguuuuaauacuuucuagauucuuuugguuuucuaucaggguaauuauaucaucuaccaaacauauuguuuugucccuguauaucuauuaagaaaaccauguguuuuuuuucuuuaguucauuaaugugaauuacuuugguuuaacauuggaagauuugucauucuugucuuucagcuugauuuuguauuuuguauuuauauacacuuuauauguuguuucuuuuuuuuaagguuuuuaagguuuuuucaugcauguucaaagugaaguggacuuacaguuuuauuuacaguucuaaguuuugggauaaagguuauaauagccucagaaagcaauuguugagcagcauucauuuucuggaauaacuucacuuaaugaaaguauuuuaagugaagguggucuuugauuucccuuugaaguucugaugguuauuugcauauucuagccuuugugccaauuuuguccuuuuauauuacucaagaagugcgugaguuuugucuagguuauuuauugacacaugauauucuuucauuucuagaaacuaugucuguagcucaaaguccuuuuuccuuuaguacauuauuucguuuauuuugcuuaucucuuucuugugaucagucuugucugaguacccuuuccacaaaacaguaguuaugaguuuggguuacagagucauucugucauguaucaguuccauugaucagauuugugacauuaggcaacuuauguaacuauucuaugccucuguuuucucaauugcaaaauggguguaauaauagucccuaaagcagaggauuguugaaaggauuaguuaauaugugaaaaguguuuagaauagugccugacacuuuguaaguguucaguuaaugcuauuugcuauuaguaguaguggaagccuuuucugaaaucagcuguugguucuccauugcuuuuuguucuuuguuuuguugauaucugcucuuaauuuucuuuuucuuguuuucuuuuuguuuacucucuucuuaaguuggacacuaauauuuaaagcuagacuuuuguaauggauaauuguaacuccuuuagaugugcccugcacuaucauuuuucugaugauuauaucugacuuauuaagagucaugcuuauauucaggcuuuucuucuaugucuuaagcuuaucaguaucaguagcauccucaacaagucagguaccccagcacauuuuuaccucuuaaguagucucucuuuugucaauccucuucguauucauauucaccaaaguuuuuguucuggauuuuuagggauauacuuuguugucuucacccuccuugcucccauugcucacuuguacaaaaaacauuguauuaacuauucuccuuuauuucucauaucucagauaucucauagaagucccuugggauuugggggguuuuuguuuguuuuguuguuauuguugagacaggcucucacucuguagcccaggcuggaguguaguggcucuaucacagcucgcuguagccuugaccucccaugcuccagcaguccucccacuccagccacgccaguggcugagauuacaggcacacacuaccaugcccagcuaauuuuuguauuuuuuauagagauggaguuuugccauggugcucaggcugguuuucaauuccugggcucaagcaauccuccuaccucggccucccaaaguguugggauuauaggugugagccacugugccuggccuucccuuggauuuaucuccuucccuccuugcuggaguuuuucaaagagagacuugauuugguuaagucuuacgaguuuuugugggccugcagaucucucucucucuuuguuuuuuuugauagagacaauguuuuccuauguugcuuaagugguccucccaucuuggccucccaaagugcugggauuacaggagugagccaccacacccagcccagauaccuuuauccuuauauuaaaacuguauuuuuguucuauguacaauucuagguuaaaaguuugauuucaucuuuagcuuaaaauuaucucuccauugucuuuuggcuuccaguguuuauauuagaaagucauauguucaucugaucuuguucauuuuuaaguaguuuguuguuuuuugguacacuuugagguguuucaaucugacuuuuuuucccccuuuaauucugagaaauucuuaaauagucuuaucuuuauuuucuccuggaacuucuauaguauggauagugauauuucuacuucuauuucuaucuauuaaauuuuguuguuuucugucucuuaauucccacaaaaaaauuccauauuugcaaauuacucaaccugaucuuuuagcucacugauguguuuuucaacuguuaacugcucaagcaauccacugcgucuggcaugaguuuuauaagaacaaguuggacuugaaauuaucuaaguuuaacaagcuauuucagugauuuuuuuuuuuuuuuacagaauaaaauguuuuucuucaguaacuugcucacacuauacuaaaaccuagauuuauuuguuuuguuuauaguuuuugugaaauuuuucagacuuaaaaaguauucaauuaacuuuugaaaguaggucuguguugcugcccuauaccaggccucuuauuaggaaagugaucauuugcaaguuguugucauuaaauaagccccaguuaucuggcuuuugggcaguggaagaggggagucauucugucagcauuaaggaagugaaguugucauuaaacuagacccuggcacugcaguuuuucuccuuucugcuucucuccuuugguguucauccccagaaacuucuucacagcauuauauauguucaaccagccagcuuuauuucaaaaguaguuuauuauaguguaugaaaguuuuucugcugggugcgguggcucaugccuguaaucccagcaguuugggaggccaaggcaggcagaucauuugaggucaggaguucgagacuagccuggccaacaucaugaaaccccaucucuacuaaaaauacaaaaauuagcugggcaugguggugugugccuguaaucccagcuacuggggaggcugaggcaggagaaucacuugaaugugggaggcggagguugcagugagccaagaucgcaccacugcacuccagccugggcgauagagugagacuucgucucgaaaaacaacaacaaaaguguuucuggcuaagagauaaauuauaggacuauagucuagauacguaccauuuacuuauuaagcuuuuuaaaaggcuauuguggcucagcagucaaugguauaugagguaaucaggguugacaaauaaccauagacagauauuaaacagacagcacugauauuauaccuuguaccucaucaucuuucugcaggucauuuccuccucuggaacagauccuuugaguuccuucccuuucaucuucuucaacagacacuuuauccuccugaccaggauaguaaauuuguagccagagucuauaguaaacaucacuaauuuaucacaucuuuugcuggcuaagcccuguguaugccuuagaaucauucucagcacaacacuucaggaagcccucaguuaaaguuagcagaugacacuuaguuguuauuucuguccuauuucuuguuccaaccagaguaagccauuaacuuauucaggcuguauuuugaagccuaaaaagaaauaaagguaggaagcaauuaaagcauuuccuaauauccaagauguuuuucugcccuucccucaccuuuugaagucuuuuauguuauaccuacccuuguuccucucuuccugugcuuuuuucugcugcuucuuauaaacacauuuauacugagcauuauaggauauauuugauucuguauugagugaaaagggcauuuuuucccccagauauucucaaccauuuagucacucuguugaguuguuuucuucccauuuuugguguaauaggguacuuuuuucccccuauucuuauauuuagauuuuuuuuuuuucuuuuuggagaaaauuggaugccaccaaaccuguaagguguugguuuuaaaugccuuuucucuggaacuaagcaauggccuaauuuugcuaaaaagagacaggaauuugaaaaaggacaagauagaaggaaauacugauagaacuaacaaguauuacuuuauuuuugucccuaaguuaaagugugacaaugauauggccaucacucaccguauguuguaugaugggccuucacuacaccaacauuugauauucacaaccagguccuucaguguagguauuggccuuguuuacuuaugaagaaaaugagagucaaagagauaguuugcccaaggacauacagcuggcaaacgguaagugguagaguuaggauuuuaccccagcuuccuaacuuuaaaccuuguacucuuucucuuccaaacauuuagaaaaguuuaccuuuaguagauuuuaccuuuuuuccacaauaaacuuuauauuauagccuuuuuaguuugggcaguaauuacauacauacauacaugcaugcauacauacauacacuuuaauguucuauagguuauuugggccacuggcacugugaccaaagugauagucuucugagcguguucugaaucugugaggcaguguagcccaguaacauaguguagugacagccuggagucaaauccuggcuccaccacugccucaucuugugcaaguuuccuuucucacaacaacuuacacaguuguucugagaauuaaaccaaguaacacacauagagcacuuggcacaaugccugacaaauagcuucauaaaugcuauuaguauguauucacuuuaugcuaaauuccuagcuucuccaugagguucuaagaacuuuugcugaguuacauagaaauuacagacuacacuaaagauauuucauaccuucagguuauuuguaaagaaauggcaaauauuaccuuuaucauuuuugacauuuauguuaaaugagauaauaaucacugcuauuugaaaccugucauauaggauuugagucugucugcuggucaggaauauuugccucaccccaggauuuaaaguacuucuagaaagaagccaaaggccgggcgugguggcuuacuccuuguaaucccagcacuuugggaggccgaggugggugaaucaccugaggucaggaguucgagaccaaucugaucaacauggagaaaccccaucucuacuaaaaauacaaaauuaaccgggugugguggcgcaugccuguaaucccagcuacuuaggaggcugaggcaggagaaccacuugaacccgggaggcguagguuaugaugagcugagauugcgccauugcacuccagccugggcaacaagagugaaacuccgucucaaaaaaaaaaaagaagccaaaaaucuguuuggaaucauaccuaaaauaguaauagucauuaaccaccaauaaaauuuacccaugucuguguuuuaacuuuuuauuguaugagucuacauucaguuauuaaaauauuugcuaucuccuuuucuuuuucagagcaugaauaaucuuucauuuagugagcuauguugccucuucugcuguccaccuuguccagggaagauugcuucaaaauuagcguuuuugccaccugauccaacuuacacacugaugugugaugaaagcggaagccguuggacuuuacaucugucugaacgagcagacuggcaguauucuucuagagaaaaagaugcuauugaguguuucaugacuagaaccaguaaaggcaacagaauugcuuguauguuuguacguuguucacccaaugcgaaauacacuuuacucuucucacauggaaaugcuguugaucuuggucaaaugagcagcuuuuacauaggacuaggaucacggauuaauuguaauauauucucauaugauuauucuggauauggugccaguuccgggaaacccacagagaagaaccucuaugcagacauugaagcugcuuggcuugcucuuaggacaagguaaauugugguuggaauuuauuuuucauacucguggugguuagcuaaaaauaucuuguguaagaauagaauaaaagcuguuuuuauuauacauaacugcuauauagagguuauauuuacuauuauauaccugugaauaaauauuuuagacagcaauuuuaaauuucacauaauagcaaaacaaaguuuuuaaagacaguuucagguuuguuugucuacauuaauacacguauauauguauguuuuuuuuaacuuaaauucuuagcuggaaguccauggugcaugccuauaguccuaguuacuuaggagacaaagucaggggaaucacuugaggccaggaguuugaggcugcagugagcuaugaucgugccacugcacuccagccugagugacagcgucagaccucaucucuuaaaaaguuaaaaaaaaaaaaaaauuaaauccagugacaaauguuugguuuuuguaagcuuucuuauuggagugugauauaaaaaauguuuauucaaagcugcaaccuuucaaggaaaugagagaaaauacugacauagcuaauuauucacuugaucugucauuaacaguaugaggcuggauugcuuucuauuaaaaucuuaagccaagauuugcauuauuuuaugugauuacuucuugggaaguacaacuuaaagauaccuuauuggaauuauuuuucaaguauucauucuguaaaacugagauuuuacuuuauauucuguguuccuaaaauugggagagauuauaucaaguuuaaaaaaauuuuuuaggcugggugcgguggcucacgccuguaguccuagcacuuugggaggcugaggcaggcgaaucacaaggucaggaguucgagaccagucuggccaacauggugaaaccccaucucuacuaaaaauacaaaaaaaaaaugucugggcgcaguggcucaugccuguaaucacagcacuuugggaggcuaaggcagguagaucacgaggucagguauucgagaccagccuggccaagauggugaaaccccgucucuacuaaaaauacgaaaauuagccgggcacaguggcgggugccuguaaucccagguauucgggaagcugaggcaggagaaucacuugaaccugggaggcggagguugcagugagcugagaucacaccacugcacucaagcccaagugacagaguaagacucuguuuaaaaaaaaagaaguuuuaauguuaugauaaauuguuuaauaaaauuuucuuacuaugucaguuauucuuugauuauagcagcauacauuuuggggaacuagaaauugcauuaaucuuuucuagucaccaagauaccuaaacauuuuucuugaaaaaaaaaucacaauuugguagacuucaguguauuauuagucagguuaguguacaauaaacagauaccuuaauauaggcuauucuuuauauuauaugaaaauaaaauaucugacuuccaggauguuuuagacugaagcuauaggauauaaagaaaacuuacuguuucuaauuuaauguuuaaauauuaaagauuucauuuagucaggaaaaauuuccucaauuuuaauaauaaaguaguuaauauuauuaaagauauuaaaaauaucuuuaaaacuauuuuucccuccaaagaaauguaauaaaguuaugcucucauagcgaaguucuacauaaaagggauucuuaaaaucaacugaaauuauauaaaaacauaaauauggggaauaaggaaaaaaagauggcaaguaguagguaaagaguugaugggggaugguaaaguuauuguuuaauugauaaauuaaaaacugcuuuaaauaaaaaucuuuuacauauauugauaucaguuccaucaagccuuaaaacaaacagaaacugagugcccacuuuuuagagucagucaguugaauaacguauaacaacuauaagaaaguauuauaauuaaaaaaauagcuuuauugagugauaagguucacacuuuuaaagguuaacuucaguggaauaaugaaguuuuaaagggugcuaaguuaaaacugauagccagcuuucauuauuagugcuucccaguaacgcaaaagggucacuuuacucaaacaaaacauguuaguauucaguucaguguucugugucuauaugaaaaaaucccauuuuuuaaguggucaacuuuacuguuuuuuucuuuucuuuucuuuuaaucuuggcauuuaccaauuugaagaaaacuuugaaaaaugauuuucagccuuaauuuuuuuaacauauuugauagccaguguuaaucaggaaugggcagauuucaucaauaaucccacauacuauuuuagcacuuauauuuuagaauuuuagaccuguguuuucuuucguguugaaaccaaaauauaguuggaguuucauaaguguagguacuuuaggaaauauuacuucucugagccuguguuuccucaucuguuuaaugaagagauugaauuaaaugauccccaagaucuuuuccaauucuggaauucugucaucuaaugaaauguguguaauuagaauacaugccuuuuauuuuauuugccugauuaaaaguuaggacuuaaguaaccaggagagagaaaauaaauaaugaacuuaaauaauguucauuuuugggaugaaugaacauuggaauguccuuuuugggaaaauuggauauccauaauaacuccaauuucugaccuucugauggaccaaaagaaacucggggccuggcauucacuaugcaccuuucccacaaaguccuugaguuccucaucugugugcuucagagguaaaaaacacugaacugggagucaguauaccuggguucuaauuauagagcugucaucuacuggugacuuugaagaucugcucauuaggcagcuggacucuagauuagauggucucuaaacuccuuucuagcucauacuguuaggcaguuguuacucuugugaguccccucaugcuuaauugucagcuaccucugcgacucuauccuugagcauugucauugcuagcuguagcccaaauuucaugauugccaccaacaaugcugauauucagcugacagcaacaaugcagccucaagaacuguggucaugcugcaaauguucauucuccuaauuucuucauucguaugaaauaugugcaacuaggucuguuguaaagaaaaaagcuuuucugaguuugcuaauauuuagagucaauuugaaguagacagagccccacuuucuguguccuauacaaaugcuuguguaguacugacuugaagaaacuauauggggagagcuguguuacuaccuguauaguugaaauaguauuaugccccuggaagagaacacacggacaguuucccucgcucuuuccuggugaauauccagauucuuagaaagauauuuuaccuuugcaaaagauuuccaaaagcagcuguuauguucuuagcugccagagugacugcugucugccuucuaaguggaaagguguauuuaaugucacuauaaccuuuaagcccacauucauuagcucagguagcacuguacuuacacuugcaguaguuuacauuugggaugauuauacuguagacaaguagcaagcaguuccuugaacauacuagguacccaauaaauauuuauugagucaaugaguuuucaucuauuuaaaccuguggccauuuuaaagggauuaaaauaguaccuuguaauuuuagcguaaagucuaaucauaaauaauuggaccaugugguguuuggaauucuuuuuuaucuuuucaaccauuaguccauuucuacaacuaagcaaagaucaauuuuaagaaaaaucguaaaaucauaauuugcccuuuacuaaaaccauacauauauucauuucauaccauaacuauauguaacaguucaucaauaugaccaauuuuggaaauuaaaaugagccacucuugauguguggagaaauaaauaacuuuuguuacacugaacggaaaauaaauaugaccuauucauucaacaucaguucauuaaaauauuagugauaugccccaagcuuagucagcaguaagcuagguugaaauauuauaguguaauaaauuauuuaauaaauuuauuucuuaagauugaaaucuuaaaauaccucagcaauuauucuuccaaaagaugaaguagagaaacacaugaaauaaacugaugauacagacuuuauuguaauguuaaaacuaacaguaauagcuaagaaacuuaaguuuaaaaaauggauuaguugacauugucuuauucuaagaucaaauccuuuggaaugauggaacauuucauaucacuccaacuuuuuugguuuuuguuuuuaacgccugaacuuuguagauauggcauucgcccugaaaaugugauuauauauggccaaaguauagggacaguaccgucuguggaucuugcugcucgauaugagagugcugcuguuauucuucauucuccucugacuucgggaaugcgaguugccuuuccugauaccaagaagaccuacuguuuugaugcauucccaaaguaaguagcaauauucaaaauaguuaaauuccaagaaacuugggaauuuuuucaucauuuaaaguauucaugacacaguucacucaaccauaaacuucauuuuauauauauuagcacauagaaauuaugaaaaauuaauuuguaaagaggguauuagcaggugaccagucagaaggcugaaauguuugaggaguaguaauccagaugaaaauugcugagggccuuacaccucaggugguggcacuaguauuggagacaagggaauuaauuugaaacauaaauuugacagaacugaguaucagacuggguguaggaugcuaaagagaaaaacuugaacaugacuaccauguuucugcccugaggugcuaauggauagggccauccagugagacacuugauguuagagaagaacagguagaagcuaaaaugaguaaauaucugauuaaugauaccuaacuuacaaaagaagugaauugaaaaaaaguugaaucuuaaauuaacuagauuaguaaguauugcugccacaaaaccugcaaacauacuuagauguauuugaaaggaaaguagcuacuuuuccuucaugcuucucaagacaggagguaguucccaccuacucuucauaguuggaaaaaauuaauggccuauuuuucucaaggagaagacaagaaauaaguuggcaaauuuuaguuuucucuccuuucuccaauuggcagcaauacaaaggauuuuuuuugugaauggccgaugggccaaaggcaaagucaucacaugguucaagaauuauuuuaaaaacacagaauuuucaucauuagccaguaauggaucacuuuaguagggaaaguaugugaacacaugaucuuaucacaagggcaagcugugggcauguuuggguuuuuauuuuguuuuggguuuguuuuuguuucagguaauguggguauaggcauuauacugccucugucuagcugaaugguaaaaaugauagggauguaucugaguauccccauaucaguguuguugucaacuuaugucuccaucuagcucccucuuucauuucuggugcaccaacagagagcaacacuaaaaauaaacuguuuggccaggcacagugguucacgccuguagucccagcacuuuuggaggccguggcggguggaucacuugaggccaagaguucgagaccagccuggccaacauggugaaaccccgucuccaccaaaauuacaaaaauuagccaggcauggugaugcgugccuguaaucccagcuacucgagaggcugaggcaugagaaucccuugaaccugggagacagagauggcagugagccaagauggugccacugcacuccagccugggcgacagagcgagacccugucucaaaaaauaaaaauaaacuguuugaaaaagauaauauacuucuuuuuauuuuuuauucaaguuuuaauuccucuaccgcugaacaucuuucugacaacagauaguaaacccaaguauuuauucuuaccaaaugcagccuuagauuauuucauugaugguuuuuucauugucaacauuccauuuucauuuuauguuuauuauaauaccuuucucuaaagauucuuaaaaagaauugucuguguaguuucuguguccuccaaguugccuuuuaaaaaaguguuuguuuugauuccucuguuauuugaaguguucuccucucaugucugauaauucuugguugccugcuuauauguaaguaaaggagcugaucaacucuuuacucuuacauauaagcagacaaucaagauuuagcagaucaacuaaagggcugaucugauaauaaucuccaaagaaggcucuuucuuucuuucuuucuuucuuuuuuuuucugagacagagucucgcugcgacacccaggcuggaguacaauggugugaucuuggcucacugcaaccucugccuccaggguucaagugauucuccugccucagccucgcgaguagcugggauuacaggcaugcgccaucaugccuggcuaauuuuuuuuuuuuuuuuuguauuuuuaguagagacgggguuucaccauguugaucaggcuggucucgaacuccugaccucaggugauccacccacuacggccucccaaagugccgagauuacaggcaugagccaccgcaccuggcccaaagaagacuuucuaaaagucccuccuggaggacaguggccugacuaccagcauucugggagccacauagggaaaauggguucauaguagccaguauguaaauguauauguuuccauugucucuaugauaccucuguucuaaacucuggcagucuucuaguucacagacauuccagucuugggggcaggcaguuucuggguauaugaacaggcaaaaggaacugggaaggggaggcuaacuuucuuacacagacuuugcaaaaauccuguauauuucaaucacccccuucaucaccaugguaauuccuuagcuuucugggguauucuguuguauaaauugguuucguucaucacuuuaccaucuaucugccuaaaauuguguuuucuucuuuuaauaaauuguuucacacauuaaucuucuuuccagcuccaacauuuuauuauauuuuaguacauucuccuuguuuuuguaucuuuauccucaaacaagaacaaaaacauaaaacauuuugcugucauuuuaguaggagacuaggagaaagaauauagugagugcagaaagugaaauuagcgcauacuugaaaugguucuuaaauuuucucuucuucuggacaccuaaguuucucugugccaaaagucaacauuguagaaagguacaguagagugacaagagcauugagugauuccagcaaaaccaucaaaacaagugcaugaaaauaacuuccucagauaaucuuaagguagggaguauguaaaaggcaauuuuugaaucuuacuggaaauucaggagacauucuuaccuucugaacugauucauacaauucucauauuugaauuaucugucugauauagcacaagaauauguuccuuuacauaguuaauuuauugcauuuuucccccuuccuuuuucccugcagcauugacaaaaucucuaagauaaccucuccaguauuaauaauucaugggacugaagaugaagucauugacuuuucacauggccucgcauuguuugaacguugccaaagaccuguggagccucucuggguugaaggagcaggucacaaugauguggaacuuuauggacaguaucuugaaagguugaaacaguuugugucacaggaacugguaaauuuguaaaauauucuguaaauuugcuacuggguuuuccuuucuugcugaacugcacucuuugguaaauaacauaaaaccugaagguuuuguuugcaaaucaugucaguugccuucauaaauguacagguaaugauuuguuaacagacuuaaugaagguuuuaauuaccagaacuaaaaacuggaaauaacaguaccgugcagucaggcuguguaauuuauauuuuuucugugaauuuuuuuuuaacaucaagaugaguacuguaugagauuuuaauucuauaaaaucaaaugcuguaaaaguauugccaaaugcuuuugcauacuagaaacaaauuuauaaauauuuuuaaaacaucucaauauauuaaaucuuauccuggaauacaacuguaauauuuugaaaaaagcuauguaucuaaagcaauuuaaguacucauaauggaaugaacuguaaaagagauuuaaaaccaugcaaguucacuagaauuaaccuaaacccuguuguacagggauagagguuuaaaguuauuuuauuguaaaauacauugaauuuucuguauacucugauuacauacauuuauccuuuaaaaaagauguaaaucuuaauuuuuaugccaucuauuaauuuaccaaugaguuaccuuguaaaugagaagucaugauagcacugaauuuuaacuaguuuugacuucuaaguuugguacugugaggcaaguacuuaaaauuuucaugcugguuacuuaaaaggcauuuagagauuucaagaaugauuuuguauacgauguuuuaaauuuugacugaucucauagucuucauagaauugcaguagucuucauuguaugaaaucccgaaaguccaugaguugaucuuaaagaccacuaacagacuggcuaucagaucccuuuucacuuuggcuauuuuuuucauuuuuugagauggagucuugcugugucacugaggcuggagugcaguggcgcgaucuugauucacugcaaccucugccucccgggaucaagugauucuccugccucagccuccugaguagcugguauuacagaugcuugccaccacgccuggcuaauuuuuguauuuuuaguagagacaggguuuugccauguugaucaggcuggucuugaacuccugaccucaugaucugcccuuggccucccaaagugucggaauuacaggcaugagccacugcgccuggcccacuuuagcuauuuuuaaaaauaggaccuauuguuuuggauuacuaucugagaauuucauggauucacuccuggguauaggagauaagaauacguuuaauucauaacuuuuauauuaaccaauauaguaaaaaaauaaagcucacacauacaaaaacuaaguugccuuuccuugaaugaacccugucugaauaaaacaaugaaaaauaaaaauaaaauuaaugguauguagucuaauuuguaaaugaaugaauauggaaauaauacacacuguggauauauuuuaaggccuuauguaguuuuaauuguucugcucguuccgugguuauguuuaagacuauaguauaugacucucuucaaaguauaucaaguauugugaaugcuuugguucagaugugucaaauuaacaguaaaacaacaaauauaccacuga

SEQ ID NO: 192786 - RNA, 140336 nt, Homo sapiens
gucagcuugggggugccuucgucgcgcagccuugcgucggcccggcccggccaggccagcgggcagaugccccgagcugccgccgccgccgccgccgacucggccgguggcggugugggaggugggcgaccagcccggggccgcugagugugacggacgcaacugggggcgccgggggcuccgcacggaccauguauuuucugagcggcuggcccaagaggcugcugugcccucuggggagcccggccgaggcgccuuuccacguucaguccgacccgcagagggcuuucuucgccgugcuggccgcggcccgccucagcaucugguacagccgaguaaguagagccgcccgccgccuuucgccgcugccuccccggccucccggcgccgucccacccccaacuuccacccagagccuaggacuccugccccuucgugccagacccaccugccuucgcaguccgcguccucguuccaccgaauuggccgcagguacccgccggcugcaggcacguccuccagccggcgguccgggguggaugaagucgcugcugccgaaaaucccugagccuccccgcguuggaccgacggccgcggcgugcagacuccgcacgcuccccggccgagcccagacuuguucuucucucccuucccccauuccccgagggacaaauuuguuuaaacuuuccacaauuagaaauccggccgcuguggugccccaacccucccuuacuuuaaaggucgccguuuuggaguuagggaaagccucuugggcuuuacccagcgccagacuuuacaggccuguaauaacuuauuucuacaaacuacagccugaauucuuuauucuucacuaaaggucugguuauuuaacuccccucuuuaaccccaacaucccuuccccacuuucgaguuggucuuuuucuuugcugcugcucuuggacucuucggaauaggggguuaaaggagcggaaguagaacucaaaucuguccgcggaacucccaguuauaacaccuggaaauaauaaggcuugggaggagcauggaacugaauucuguuuuugcuuuaaguccugguuaucuuuuucuuucuuguauugaauuacugaguagauaugagaaagaaauaagugguggaugggauacucccuacucucugcaaacacugcuauaacuuugucuaugagaacgacagaguucagaguauaaaaaugcuuuuuuuccuccccaaagaaggcaguaccaaucgaugucagagugaaguuuuucuccuuuccaaguuaauuugaccauguggggauagguugugaucuuguccuuauuagguguucgugaaauacugguuuuaguuuguuaaaauccccaaaucuuuguguguugcuguuccauuaccuguaaugcccuugacaguccucacccacuucccugguaauacuggugaugggauuuagugacggguaauucuggugucuccuuugacugucauaguugggcuguaaaucagacuauuugccaucaaguuuuggcugaucuaauuuucaaaugcaaaucagaacaaaacaaacuuauaaaaucguaauaccaacaauaugacuauuuugucuagugccugauuguauuuugaauauauauguauguauguguguguguauauauauaaacauauguguaaauauauauaaaguaucaucugguuccuaaaugagauauucguuuacaauguauaugccaguugaauaauuuuuaauuuguuuagguguauauaacucaacuuuaaagcacaugcagaaaaaaauagaacuugaauuuaaauugucuuuugaauuuaauacauaauuccuuuugaauguaacaaauuuagacuuucgucuaaaauuuaacuuuucuuaccuuuaaaaaggcagaccuaacuuaauuuuaaauaaaaguaaacaauaugaccuaugaauugaccagaagccuguaaaccacuuuauucccccauaagagaagcauaaacauaugcuuuaauuuagggacauugugaauauucuuaagcaugucuauuguuugguuuuggaguuacauacgacaucuagaaauccaaggcaguucuggaauuuaaacuauucauacucuucuuucaaauucccaccucacaugcaacuuccuuuuuccacagaaguccagggaccccuacuauuaaguucuguugugcaaaaguuaggcuguagggaacccauggguuuagaggucuggagugaaaugaaaugcaggaauaccuuagaggaggcuguauaguacuguaguaugagugguuaaccuuggucucugggcaccagcuuuguugucacugaaaaaaaucagauauucacgaggucaagagaucgagaccauccuggccaacauggugaaaucccgucucuacuaaaaauacaaaaaaauagcugggcgugguggugcacgccuauagccccagcuacucgggaggcugaggcaggagaaucgcuugaacccaagaggcagagguugcagugagccaagaucccaccacugcacuccagccuggcgacagagcaagacucugucucaaaaaaaaaaaaaaaaaaaaaucaaauauugaaccaagugauuauaagguguaugauuacaugccuaggugagugggauacauaugcuagacuccagcuuccaaucuucucuuccugggauaugcccuuucuuacucuguaugaaaguuuucauuuugauuuucuaauuuguaaacuuccugaaaguauguaaguuaauuagguuaacaaacuucauuuaaaagugaaaaugccuuuagguaaauuaaagggcuaucaguuauacuuccauaauuuagagugaauugguuuaaaaaguucucauggagcugcuaaaagcuuugauuuuugagaggcuguagauacaaguaguuuuauaauaauaugugaagaucuacaggauuuuacagaguugaagucuuacagcugcuugagggcauuugaaggcagggagacaugcucguagagaugauaaaacaagauuugcuuaccugaaauuuuguuagggcucacuuaguaaaucaggcucucuuaggagugauauauuuuaaaaagagacaacuagccuuguggaagggacagucguuuaguagucuaagcugguuguuucaauguucaaaagaauuguggaaauuguauguguacagugauaauucauaagacugaaucucuauuaaaaucucuaacuguacauuauaugggucuucuaaugaacuuuuauguacuacuuauaccuacuguccucuauucuaaguagguauucggaauuccacuguuuagacucauaucucuucagaauuauuuccuaccccaaauuugagaaauacaguauaguguuguuuaugaacaaaagagccucuagauaguuacuuagcuuuuuuauauuggagccccaauauuauauuuuggagccccccaaaugguguuaaaaaaaggcucaguauguguaggcuagauuggggugguagagguagaacuugacugggggcaguugguacauuucugcuaagguuauuguaaaaggacuaguuucagcuuugaggaugaaacuguugcauaagguagguuaugauuuaugauugacguagguguagugugagaugaauuacauuuuguacuguacugagggcccagaauuauuccuuuaauauacuaacugugacuaugaaagucuauauaugugaacaucagaaugguaucuuugaauuuagccauucuaaauuagauguauagacauucucguuuuucaggucaccgacuuuaaacauuuaaauuagcuucagaaguauuuuugaacaucaacuguaaaagacagauguguauaaaagggaugaagagacauguuauauguuaguguguuagauguuaguguguuaauauaaaucuugugagauaucacuguuguagguagcuaauaaaaagcugaaaugggcaaauaauuacuaggcuuauaaaauaaauuauaugucguuuaguaauccugagcaaaaacuuaguucccauugguaugugcuaaucauggaaaaaaacaaugauaugucaaaagaaccaagcuuuggaucagguaugugauuaacuguguugaccucaggaagaccauuuuauuuguauuuucccagcauucccauuucucacccuuuuaacucuauuacuuucuccagagagccuucuuuauaaauucacugcucugaagucuucuaggguucacuguugaugaaagaauggaguucaaacuccuuaguuugauaucacagacacucccuucuuggaaugcucucuugccucauuucugccugucagaguauuaucuauccuuuaacugcuguugaaauccuuucuuuaugagucauucuuuaccuaccguaaccauaaguguucauuuuucugaugaacuacugcuuccccacuacugccagcuuuguugagguauaauugacaaauaaaaauuguauauauuuaaggugugcugugcgauacuuagaucuacccugugaguugauaaucacaaucagucuaauuaacagauccaccaucucacacagcucccucuuuuuuuguaugugggaugagaacacuuaagaccuacucucuuagcaaauuucaaguauacaauauauguuaauuauggaaauaaaugucauuauuaacgauaguuacugggccaugcauuagguccccagaacguauucaucuuauaccugaaaauuuguaccuuugacugaaauacucccauuucacccaccucccagccccugguaaucaucguucuauucucuguuccuaugaauuugacgucuuuauauuccauauaugagaucaugaaguuguuuuuugucuugcuuacuuaguauacuguccuuaaguuuuguccauguuguugcagauggcaggauuuccuuguuuuuuaaaggcugaauaauauuuuauguguguauguguguguguuacauuuucuuuauccauucaucuauugacagacacuuagguuguuucuguaucuuggcuacuuugaauaaugcugcaaugaauaugaaagugcagauaucucuuugagauacugauuucaauuccuuuggauauauaccuagaaguaggauuguuggaucaugugguaguccuguuuuuaguuugaggaacuucuguuuuccaucaugacuguaccauuuugcagucccgucaauaguguacagggaggggaucccuuuucuccacgucuuugccgaccuuguuaugauuuaacuucuugauaauagauauccuaacaggugugagguaucuuaugguuuugauuugcaucucccugaugauuaguguauugagcaccuauuggccauuggcuguuuuuugguaaaacaucuguucagaucucuuguccauuuuuaaauuagguuaucuguuuuguuuuuuucucgguacugaguuguaugaguuccuuacauaucuugaauauuagcccccuuuuagauguaugguuugcagauauuuucuccuauuccauagguugcuuuuuuaucuuguugauuguuuucuuuacuguacaauaacuuaauuucauguaauccuacuuguuuauuuuugcuuuugucaccugugcuuuccaugucauccaaaauaccaucgugaaaacagaugucaggguguuuuuccccuguuuucuucuaggauuugcaugguuucagguuuuacauuuaagucuuugauccuucuucuuauuuuaauuuuuguggguacauaguagaucuguguauuugugggguauaugggauauuuugauacaggacuauagucacccuguuguacuaucaaauacuagauuuuauucaucaucaucaccauuauuauuuugagacagggucucacucugucacucuggaguacagagucaugaucauggcuuacugcagccucgaccucuugggcucaagcaauucucccaccuuagcauccugaguagcugggaguacagaugcaugccaccaugccuaguuaauuuuuugaagagauguggucuugcuguguugcccaggccggucucagacuccuggacacaagugaucugcccaucucagccuccuaaagugcuaggauuacaagcaugggccaccacacccaguccuuauucauuuuuucuauuuuuuguacccauuaaccauccuuccuucccccuccgucuuuaauccuucuugaguugauaguguaagauaaggguccaguuuccuuccuuagcauguggauauccaguuuuucuaacacuaugguguugaaaagucaguguugcaagauguguuuucuccauucuuagcacuuugugaaagauugacuauauaugcaugcgugguuuuauuucuggacuccauucuguugcauuggucuauguaucucuuuuuaugucaguaccauacuauuuugauuacuauagcuuuguaauauacuuugaaaucagguugauaugguuuggcucuauuuccccacccaaauuucaucucuaaucguaauccucauaauccccauguauggagggcaggaccugguagggggucauuagaucauagcgggaguuuuccucaugcuguucuugugauaguaaguucucacgagaucugaugguuuuauaaguguuugacuguuccuucuacacgcucugucucucucuugccugccagcauguaacaagugccugcuuccccuucugccaugauuguaaguuuccugaggccucaccagccauuauggaacugaaucuauucaaccuuucuuuauaaauuaccaaaucucagggaaguuuguuauagcagugugaaaauggacuaacacacagguaaugugacacuuccagcuuuguuguucuuucucaagauggccuuggcuauucaugggcuauugugguuuuguauaaauuuuaggauuguuuuucuguuuaugugaaaauaucauugaaauucugauagagauugcauugaauccauagauugguuuggauaguagggacauuuuaacaauauuaauucuuccaauccaugaacauaagauauccagccauuuauuuguaccuucuucaguuuauuucaucagcauuuuaugguguuuaguggcgguuaaauguauucuaaguauuuaguuuuuuggagcuaccauaaaugguauuguuuucuuuuucuuuuucuguuuuuuuuagacaaagucucgcucuugucaccgaggcuggagugcaauggagcgaucucaacucacugcagccucugccuccuggguucaagcaauucuccugccccagccuccugaguagcugggauuacaggugccugccaccauacccggcuaauuuuuguauuuuuaguagagacaggguuucaccauguuggccaggcugguaucgauuccugaccucaguugaucugccugccucagccucccaaagugcugggauuauaggugugagccaccacucccagccauguuuucuuaauuuauuuuuuagauacucauuguucuuguguagaaacacaacuuauucuuguauauugauuuuauaucuugcaacuuuacuaaauucauuucuuaguucuaaauuuuuuggugguuuuuagguuuuucuaaauauaagauuaugucaucuucagagacaauuuugcuuuuuccuuugaacuacugcuuuauaucguaaguuuugcacuuaugcuuuauuucuccagcuagauuauaaguuucuggagcacagaaacuaucuuaauuuguauuaucuauagugccuuguacaaggaagauguuuaauaaacauuuuuaauauuaaugaauuuaagguauuugucauacguguggcacagcaauuuuuuuuuaaguuuuaguguuuugauuuuugugagaacacaguagguauauauuuaugauuuuuuuguuuguuuguuuguuuuugagacaggguuucacuucaguugcccagguuggagugcaguggcacaaucucagcucacugcaaucucugccuacugggcucaagcagcuguccugcuucagccucccaaguagcugggacuacaggugugccccacugcacuuggcuaauuuuuuuuuuucuguaauuuuuuauagagaugggauuucaccauguugcccacgcuggucuugaacuccugagcucaagugauccauccaccucgggcucccaaagugcugggauuacaggcaugagccacuauacccagccaugagauauuuugauacuagcgugcaauuuguaacaaucaguucaugaaaaauaggguauucauccccucaagcauuuaaccuucauguuccaaacaauccauauguacucauaguuauuuuaaaauauacaauuaaauuauuuugacuguagucacccuguugugcuaucaaauacuaggucauacucauucucuuuuuuuguacccauuagccguucccaccucccuuccuauccccccaguuaccuuucucagccucugguaaucaucuuuccacucuuuaucaccauuaguucaauuguuuugauuuguagaucccacaaauaagugagaacaugcgauguuugucucucuaugccuugcuuauugcacuuaacauaaugaccucuaguuccauccauguuguuguaaaugaccggaucucauuuuuuuuguaacugaauaguacuccauuaugugcaaguaccauguuuucuuuauccauccaucuguugauggacacuuccaguacuguguugaauaacaauagugaaggugggcaucuuugucguguuccagaucuuagaggaaaggcuuucgguuuuuacauacucaguaugauacuagcuaugggucuguuauauauggcuuuuauuauguugagguauguuccuucuauacccaguuuuuuuaggguuuuuaugaagggauguugaauuuuuaugaaaugcuuuuucagcaucaguugaaaugaucauauaguuuugguccuucauucuguugauaugauguaucacauugauugauuugcauauguugaaccauccuugcaucccuggaauaaauaccacuuguucaugaugaaugaucuuuuuaauauauuguugaaucucauuagcuuguauuuuguugaggguuuucacaucaguguucaucagaaauauugaccuguaguuuucuuuauugaugugucuuugucuggguuugguaugaggguaauccuggccucauagaaugaguuuagaaguacucccuccuccuguauuuuucagaacaguuucaguaguauugguguucuucuuuaaauguuuguuggaauugagcagugaaaccacuaggucuugggcuuuucuuuacugggagacuuuuuauuacagguucaaucucacuguuguuagucuguucagguuuugaauuucuucaugauucaaucuugguagguuguaugugcuagggauuuauccauuuccucuagauuuuccaguuuauuggcauauaguugcucauaguaguuugugaugaucguuugaauuuuugcgguaucaauuguaauaucuccuuucuuaucucugauuuuauuuauuuugguuuucucuuuuaagguuugucaauuuuguuuaucuuuucuaaaaagcaacuuuauguuucuuuggucuuuugcauuauuuucuucauuucaaguuaauuuauuucugcuccaucuuuauuauuucuguuacuaauuuuggguuguuugcucuugcuuuucuuguuguuuaagaggcaucauuagguuauuuauuugaaguuuuucuucuuguuuucugagacagggucucucuuuauucuccaggcuagagugcaguggugcaaucucgucucacuguagccucaaccucccaaguucaugugauccucccaccucagcccccuaaauaguugggacuacaguugcaugccaccgugcccagcuaauuuuuguagagacaggauuucaccauguuucccaggcuguucucaaauuccugagcucaagcaaucugcccaccucggcucccaaagugcuaggauucaggcaugagccacuauacccggccauuuuucuucuuuuaugguguaauacuuauagcuauaaauuucucuguuaauacugcuuuugcugucucccauaacuuuugauauguuguguuuccauuaucauuuguuucaauaaaguuuucaguuugcuucuuaauuucugcacugacccauuggucauucaggaacauauuguuuaauuuccaaguguuuauaugauuuccagaauuguucuuauugauuucuaguuuaacucuauuaugagagaagaugcuugauauuauuucaguuuuuuugaauauuuuaagauuugugaccuaucauaugagcaauccuuaagugauccauguacugagggaaagaauguguguucugcacccuuuggaugaaauguucuauaaauaucuguuagguccauuuguuguauagugcagauuaaguccgauguuucuuuguugaguuucugucugggaguuggguucagugcugaaagugagguguugaagucuccagcuaucauauugaggucuagcucucucuuuagcccuaauaauguuugcuuuguauaucuggguguguugggugcauauguacauaugauuguuauauucuauugcuggauugacucuuuucucaguauauaaugacauucuuugucucacaauuuuugucuugaaaucuauuuugucaguauuuauauaauuacuccugcucuuuugguuuccauuggcauguaauaucuuuuucauccccuuauuuucagucuaugcauaccuuuguaugugaaguguguuucuugugggcaacagaucaguggaucuuguuuuuucauccauucacccacucucugucuuuugauuggagaguuugguccauuuguauucaaugcuauuauugauaaguagggacuucugccauuuugauauauauuuucugguuguuuuguggucuucguucuuucuuuacuugcuguguuccuuuuagugaaggugguuuucucuggugcuaugauuuaauuucuugcuuuuuauguuuuguguaucuguuguguuuuuugauuugaguuuacugugagacuugcaaguacugucuuauaacccauuauuuuaaacucacgacaacuuaacacugauuguauaagcagucaaacacacacaaaguguuuaaaguguaauuaaaaguguaauuaaaacucuacacuuuaacuucaucccucuacacuuuaacuucaucccucugcuuuuuaacuuuuuuguuuguuguuucuccuuaugucuuacuguacuaugucuugaaaaguugucguuauucuuuauugguucguuucaucagucuuucuacuuaagaguaguuuacacacuacaauaacacuuauaaaauaagaaucauuguuagguuauuuauuugaaguuacagaauaagaguguaauugugcuguguaaacuacucaaguagaaggaguuauacucuucuguguuuuucugugugcuuacuauuaccagcgaguuguaccuucugaugguuucuucuuggucauuaaauacucuuuucuuucagauugaacaacucccuuuagcauuucuugagggcagauccaguguugaugaacucucucagcauuuuuugucugugaaggucuuuguuucuccuucaugcuugaaggauauuuucacuggauauacuguucuaagguaaaugcuuuuguuuguuuuuuuugucagcacuuucaacauauugugccacucucuccuggccuguaagauuuuuacugaagagucugcugucagagauauuggagcucuauuguauguuauuuguuucuuuucucuugccguuuuuaggaucuuucuuuauccuugauaaagaaacuauccuuugagaguuuguuuauagaugccauaagguagucuucuuuuuuuuuuuuuuggacggggucuugcucugucacccaggcuggagugcaguggugccaucucagcucacugcaagcucugccuccuggguucacgccauucuccagccucagccuccugaguaccugggacuacaggcgcccaccaccacacccggcuaauuuuuuguauuuuuaguagagaugggguuucacuguguuagccaggauggucucgaucuccugaccucaugaucugcccgccucggccucccaaagugcugggauuacaggcaugagccaccgcgcccggccgccaugagguacucuucuuuagguuaaaucugcuuggcguucuguaaccuucucauacuugaaugcagauaucuuucucuagguuugggaaguucucucuuaucccuuugaaugaacuuucuacuccggucucuuucucuacuuccucuuuaaggccaauaccucuuauauuugcccuuuucaugcuauuuuuuaggcaugcuucacuguuuucuauucuuuuuucuuuuguggucuccucugacuauauugucaaguagccugucuccaagcccacuaauucuuucuucugcuugaucaauucugcuuuucagagacucugaugcauucuucaguuuguugguugcauuuuucaacuuuagaauugcugcuugauuuuuaaaaauuuaaauuucuuuguuuaaaaugugauagaauucugagguccuucucuguguuaucuucaauuucuuugacuuuccucaacauagcuauuuugaauuccugccugaaaggucacauaucuaucucuguuuuuccaggauuggucccugccuuacuuaguucauuugguggggucauguuuuccuggaugaucuugauuugaugcuuguagauguucauugguguguaggcaucaaagagguagguauuuauuguagucuuugcagucugggcuuguuuguaucuguccuuuuugagaagucuuuccaguuauucgaagggacuugggccccaagcccaauaaugcugagguuuuugcagacucagagguacugccuugguggucuuggauaaaaucuggaagaauuauuuggauuaccacguagagacucuuguucuuuucuguuacuuucuuccaaacaaauggagucucucucugugcugagucuccuggaacuagggauguguucaugcguugaugcaagcaccccuguugccaccaccacugaaacuaagcuggguuagaccugaagccagcagagcacugggucucauccaaggccugcugucaccaccaccuggcuaccaccuauguucacucaaggcccuaaggcucuaccaucagcagguggugaagccagccagguuuauguccuucccuucagagugucucauuccccaaaccccaggccaguccagaaaugcugucuggaagccagggauuagagucaaaauucuuagcaauuuguuugauauucuguucuguuguggcuaagcaggcacucaaaccguaacacaaaauucuucccacuuuuuccccuguccacaggcagaggagaaucugccucuguggccaccacuaccacagggccauaguggguucugccuggccacugccgggcagucaucuucagguguuuaugaaucauuaacauaauccauauuauaguuaaauauuuauuuggaguuuacuguggacuagguauuuuacaucauaguaagcaaaguuucccaaauuuaaguucuuuuuauuucucauucaugacuuuuggccuguucucauacuaccuauucauuguaacuuuuaaacuugaaagucucuuucaaaauaaaugaauuuauacuuuuaccauaaauggaaaucuaguaccauuuuuaugaauagaagauauuaugaaggaauacaauaaaaacaauuuuauaagucugggcaugguggcucacaccuguaaccucagcacuuuugggggccuaggugggaggaucacuugagcccaggaguucaagaccagucuggacaguauagggagacccccaucucuauaaaaaauaaaaauaaaaaaaucagcuggccaugguggugcaugccuguggucucagcuaaucugguggcugaggugggaggauuguuugagccugggaugucuugauucauaaacacaugaagaugacuaaaaucuccuuuuaaauuuguuuauacugcuuuuucuucuauggcuuucuuuuuuucauagaucaugucaauauaaacacauacugagaaccaggaguuugagugauucuauaugaaugacuguauacuauuuaaauuuugaugaacuacagaguaguuugagccuaggagguugaggcugcagugagccaugauugcacuauggcaacccagccaggaugacagggugaaacccuuucucaaaaaaaaaguuaugaaaaauaugguuuccugccaaacucauaauuacuccuuuauuaaaaagggcaauuagcccuuuuuaugcaaggugcuuaaaaauaaacuagcaccucauuuagauacucuccuuacguaaauaaaaaagauugaagaggaguugaaaaaagauuuuuuuccuaugugauuguuuacuucaguauuuguaugucaucuaaaauggugauauaggaccugcauuaaaguguuccaccuguauuaguuuguuaggcaauuuauuuaaucagaaaaaauaaaauaaauuuacaauuuaaaaauauuuuggaauuuacaccugccacaaaaugagacaguuucuucguucagauuucuuacucaugagcaggcaucaauugguuggaaucagagagguuucuuaccuuuaaguuacaauugcuuuccuuugaguugcugucacaaaucuacugucccccaaguaguuuaccuuauuucaaccauaaaucauacaaaaauuuaccuaugaaaauuuggauauuauuguagauaauacuguagaauuugcuaugguuuaaauuuuuaagagcuuugaggugcauaaaaauacaucuaaguguacauugauuuuuaguaaauuuauaguguugugcauccauaaucacagucuaguuuuagaacauuuauaucagccuuaaaaaguacuaugcccauuugucaucaaccucuucucccauuccagccuuagaaaaccuuggccuacuuuuuguccauuugauuuagcuuuccuagaauuuucauaucauuggaaucauaugguauauggucauuuguguuugguuuuuauuuagcauaauguuuuugaggugcauccaggucauaauauuucuuuuuucaaaauguguguaaacuaagggauacaagugcaguuuuuuuacagggacauauugcacagugguaaagucugggcuuuuaguguaaucaucagcuaaagaaugugcauuguacacauaaguaacuucuuauccuuuauccccuucucauccuucugagucugguaucuguuauuccacacucuauguccaugugguaguauuccuuuuuguugcugaauauuuuuccauuauuugcauaugccgcauuucuaucuccauucaccaguugacagguauuugagucauugugaauaauacucucauuuugaaugauugugaguaauacugcuguaaacauuuguauacaugucuguguguggauaaauguuacucuucuagagagauaccuaggagugcaacuacuaagucauauggcaaguuuaacuuauugguaaagugcaaaacuuuguuccaaagugacuguagcauuuuacaaccccaccaauaauguauggaaguuucuguuucuccacacccguucuagaggguuuguaguggugucuuauuuguggcuuuaauuugguguuuuucuaaugacuaaaaaauguuuggcaugauuucauuugcuuauuagcuauuuauauaucuuauuccauuuauauaucuuauuagccauuucgcuauaccuauguaguuaauuaucuauucaaauccuuuguccauuuaaaaaaaaaacagugaucugaucuugggucacugcagccuugaacucuugggcucaagugauccuuccaccccagccucccuaguagcugggacuacagaugcccaacagcaugccucacuuauuuaaaaauuuuguagagacagggucuccauaaguugcccaggcuggucuuaaacucccaucgucaggcuauccuccgaaaguguuggaauuacaaguauuagccaugaugcccagaccauuuuuguuuaaguggaauauuucucuuauuauucaguuguaagaguucuuuauaugucuugauacaaauuauuuagcagauauauacuucgcaaaguucugcagcauuaaguacauucacauuaucauguaaccauuaccaccaucaguauccagaacuuucauuuucauuuucccaaacugaagcuucguacccuguaaaugguaauuccugguuuucucaucccaucagucccuggaaacuacuauuguauuuucugucuuuaugaauuugauuuguguggguaccucagacaaguggaaccacacacuauuugucuuuuugugauugacuuauugcacucagcaugucuuaaguuuuauccaugcuguagcauguaccaaaauuuccuuccuucuuaaggcugaaugauacuccauuguauauguacauacugcauuuuguuuuauucauucaucuguugauggacacaugggcugcuuuuaccucuuggauauugugaauaaugcugcugugaacauggguagacaaauauccagaucccugcuuuacuucuuuuggguacauacccagaaguggaccugcuguuucauuugguuauucuauagguuuuuuuuuuuuuugagaaauuuugcuuuuuuuuuuaauguuaagaaauugccacauacuguguuuccacaguguacaucauuuuacauucuuaccagcaauacagugguuccaguuucuucacauccuugcuaguacuuguuuucuguuguuuugaugauugccauuccauuggguccaaugugguaugucaugguuuugguuugcauuuuccuaaugguuauuaaugucgagcaucuuuuauguacuuguaagucauguguaugccuucuuugaaaguguccguugaaguucuuugcccauuguuuuucuuggguuauuuuuuguugaguuguaacgcuucauguauucuggguauaauccuuuaucagauaugugguuucuaauacaguuaugcuccauguaauggcaguuugagauguuccugucaacagacugcauuauaugaugguggcccuauaaaauucuaauggagcugaaaaauucuucuugccuagugacaauagaaauuuuauauaguguaaugcauuacuuuuucuauguuuagaaguauuuagauauagaaauauuuaccauuauggcacaauugcuuauguauucaguauaguaauaugcuauauaggcuuguauccuaggagcaauaggguauaccuuauagccaagguguguaguaggccauaacgucuagguuuguguuaaguacccacugugauguucacaugaugacaaaauugccuagugaugcauuucuuggaacuuauccccucuuguuaaagugacacgugacuguauuuucuucuguuucaaggguuacauuuuuacucucuuuguaguagccauugaugcacagcauuuucaauuuugaugaagucugucuuaccuauuuuuuuuuguugccugugcuuucaguaucauauccaagaaauuguuuucaaauccaaagucaugaaguuuuuggcuuguguuuucuucuaagaguuuuauagggugaggucuucuguuuagaguuuugaucacuuugagacaauuuuuguauauaguauaagauaaggguccagcuuuauuuuuuuacauguggauauccaguuuucccagcacuguuuguugaaaagacuuucuuuccuuuuccccuuugaauggucuagguagccuuguggaaaauaauuugacuauuuaugcaagaguguauuucuggacucuguguuuuauucuguuggucuauauguguauccuugugccaguacgacaguauuuugauugcuguagucuucuaguaaguuuugaugucaggaaaugugagacguccaacuuuguuauuuucaaguuuguuuugucuauucgaggucucuugggaauccauaugaauuuuaggauggauuuuucuguuucugcuaaaaaugcuguuaggauuuugaaaggacuuacauugacuauguagauugcuuuggguaguauugacaucuuaacaauauuaaauuuucuaauccaugaacagaggauaucuuuucauuuauuugugucuaauuucuuucagugauauuuugcaguuuucacuguagaagucuuuugccugcuugguuagguuuaguccuaaguacuuuauucuuuuugauguuacgguuugcugauuuuucuguguugauuuuguauucugcaguuuuccugaauucauucauucuaacagguuuguuguuguuguggaaucuuuagagucuuuacauauaagaucaugucaucuucaaacauauaauuuuacuuauucauuuccaaguuagauuuauuuuauuucauuuccuugcugauugcucuggcuagggcuuuagguauuacguugaauggaagugguaagaaugggcaucuuugucuuaauucugaccuuugaggaaaagcuuuccaucuuuucaccauugaguuugaugcugguuacaaguuguuguuuuguuuuuuguuuuuguuuguuuguuuuuuguuuguguguguggggguggguggugguggugguggugguggugguggugguggugauggugguggugguggugguagugguagugguuuuuucuugcucuguugcccaggccggagugcaauggugugaucucggcuuacugcaaccgccaccucccgaguucaagcaauucuucugccucagccucccaaguagcugggauuacaggcgcccgccaccauacccgacuaauuucuuguauuuuuaguagagacaggguuuugccauguuguucagacuggucucgagcuccugaccucaggugauccaccugucucggccuccugaagugcugagauuacagcugugagccaucaugccuagccagguauagguuuuuuauauauggccuuuuuauuaucuugagauaguuugcuucuauucauaguuuuuugaguauuuuuagcaugaaaggauauugaguuuuaucagauguuuuuucugacucaauugaaaugauuaucuguugguggacacuuagguugauuccauaucuuugcuaauguuaacaguguggcuaugaacuugggggugcaaauaucccuuugauguauuuauuuuguuucuuuuggauaaauaccuaacagugggauugcuggaucauaugguaguucuauuuuuacuuuucgagaaaucuucauacuguuuuugguaauggcuguacuaauuuauauuuccaccacaggaguucccuuuucucugcauucucaucaacaucuguuauguuuucuuuuuaauaauugcuauucuaacuggguuaagaugauaucuugugguuuugauuuucauuuuccugaugauuagugauguugagccucuuuugauguaccuguuggccauccauaugucuuuugaaaaaauguuuaugucuuuugcccacuuuuuaaugggaauguuuuguuuuaacuguugaguuguuugaguuccuuguauauucugguuuuuaguuucuugucagaugcauaguuugcaacuauugucuaccauucaaaaggaagguuauuucuuuacucuguuggauuguuuccuuugcuaugcacaaaacaagucucaaaacauuuuaaaacucugggaggcugaagugggagaaucauuugagccagggagguaaaggcugcaaugagcuaugauugugccacuucacuccagccuggcaacagagauagacccuaucuuaaaaaagaaaaaaaaaauuaaacucaaaacuauaucaagugucuucuuagaccacaguagaauccucaaacuagaaauuaauaccaagaggaacuuagaaaacugucuaaauaaaugguaauuacauagaauacuccugaauguccauugguucuuuuucugcuccuuugaucuugucuuugccuucuguaacaccaaaaauucaaauagaucacuuuauggugucccauaugucauguaggcuuuguucauucuuauuuauucuuguuuuguuuucugaguuauuucaaaaaucugaaauucauucuucugcuugauaucauccauugcugaagcacuugaauguauuuuuuauuccacuuagugaauucuucgguuugaggauuucuguuugguuccuuuuuuaugauaucuaucuuuuuggugaauuuuucauucauaucuugaauuguuuuucugauuucuuuguauuuuuguguucucuaucucacugagugucuuuaguauuauuuugaauccuguugcuggcauuucauaaauuucuuuuuuauuagaaucuguugcuggggaauuauuguguuccuuuggagaugucauaauuucuuguuuuuuuuuuuucacauuacuuguauacuuacaaguugaugucuguaccucugguguaacaguugcuucuuccaguuuuuuagauuggcuuucagagagguagacuuuuuccugaagaucuauccgugguguugguuggguagggcaccuugucuuugauucugggugugugcaguaguguauuuuucauaugaccuuuuuagccauauauagcauuaguggugucugugauuuccucagugguuuagggugcaauuguuagcagaggcugaggugaaguucuccugggcagugggaugcuagguaggccaguccuugggcaccagugguggcagcagcagacugugugccuguccuucggccccaggguacacaggcaugguguuagcagguuuaauuggguugauucuuaggccuccauauggcuugcuuaggugcuggugguugcaguggaugaccaggugaguggguagguccuuggaucccugggcagugcaugugguaugggcuauggcaguaguugugaugguagcaucaggcugggugggcugacucucaggcuucccuguaggagugcguaugugugaguggcagacagggugaggcaaucucuaugcuccaaucucuaugcuugggcccuuggggguauguggugccaggccaggugggccugucuucaggcccccugguagagugcucagguagcaacaguggauagagagagccuugccucagggcaugugcauguccacuguggcccugcuacuagaggggauaggguuggugucggugucaguagccucacaccagaggcugggguggggcagguaugguaugcuuugcuccaagcagugucaggaacauugacacuggcaugcugggagauucuguccucaggacauguucaagugugcugcagucuugcuguuaguggagaugggguuacugucaguggcagcaaccccaggcuagcaggguuuaggcucucagaaguguacgcuuuggcucuuuuuguccuugugauagccuccccaguauacccuccccagugcauugcacuugccuguucuccacaguguaggauuuuauauaugcuuuaauaccagggacucugccacucugcuggguccaaguggcauugcaucacuguaggcccccagguggaugcagggaauguuaguagggcuuuacuaauguggaaaugcagggacucuugugcucaagggcaggaugcagccuguuaagagcuggacugaaaaugacaccaugcuguaacuguuuaggucucaugcaggugguacaggacccagugugagcucucucucuggagcagugucaucacauggucucuaagaaguucucuaugcuagucucuggacccccucucuguaagcuaggguugcaggaguccguggugggagugugagcugcuggguaucucucauuuaccuuucccccacacuggagaucugcucugugcuccaggucgauaaaggccaagcaaacaaccuugcuucccucuucuuccuugcuuuagguguuuccugucacuucucugcuaaauuccaguguugugucuuagauguucuguugaaagugugacuccucccuguuuggguuuuuuuuuugugaaggaggcaagggcugaugucucuagucagcuaucuugaagccccuccucuauuuuugcuguuguugccugugcuuuucaggucuuauccaaaaaauuccuugcucagaccaauauaaugaaucauuuccuuuauguuuuucuuccaguaguuucauaguuuugggucuuacauuuaagucuuuaaucuuuuuuuuuuuuuuuuuuuuuuauugagacagucucacccuguccuucauucuugagugcaguggugugaucucagcucacuucaaccuccaccuccuggguucaagugauucuccugccucagccucccgaguagcugagauuacaggugcaugccaccaugcccagcuaauuuuuguauuuuuuuuuauuagagaugggguuuugccauguuggccagguuggucucgaacuccugaucucaagugaucugcccaccucggccucccaaagugcugggauuacaggcaugagccaccgcaccuagccucuuuaaucuauuuugaaaugaguuuuguguauaguaagauaagggucuaauuucauucuuuugcauguggcuauccagguuucccagcaccauuuauuagauuauccuuucuccaaugugugcucuuggcaccuguuuuuugaaaaucaguuggcuguaaaagcauggauuuauuucugggcuauuuuguuccauuguuuuauuugcuuuuauugccaguaccaugguguuuugguuaauacagcuuuguaguauauuuugaagucagguaguguaauuccacuaacuuuguuauuuuuguucaagauugcuuuggcuauuugagguccucugugguucaguaugaauuuuaggcuuguguuuuccacugcugugaggcauaucauugguauuuugguagggauuacauuggaucuguagaucacuuugggucauauggacaauuuaacaguauuaauuuuuccaaucuauaaacaugggauaucuuuccauguauuuguguuuucuucauuuuauuacuguuucauaguuuucauuguagugaucuuuuacuucuucaauuaaauuuuuuguucuuuggguuuuuuuauagcuauuaauaagugggauuguuuuguugauuucuuuuuucagcuaauucacuauuaguguauagaggcauuacugguuuuuguauauugauuuuguauucuacaacuuuacugaauuauuuuguucuaccacuuuuuugguggcaucuuuaggguuucuauauguaagauuguguuaccugcaaauaguguuaauuugacuucuccuuuccaauuaauuuggauacuuuuuauucuuuuuuuuuucuugccuaauugcucuggcuaggauuuccaguacugcguugaauaaaaguggugaaagauaguauccuugucuuauuccagauuagaggaaaagauuucaacuuuuccuuauucaguaguguuagcuauggguuugucauauauggcuuuuauuguguugaguuacauucuuucuauucuuaauuuguuaagaguuguugucaagaauagauguugaguuuugucaaaugcuuuuucugccucuccugaaaugaucaugggguuuuugccuuuuauucuguuaauguaauauaucacauuuauugauuugucugugcugaaccauccuugcauuccugggaucaguccuacuugaucaugaugaauuguugaauuugguuugcuaccauuuuguugaggacuuuugcaucuguguucaucagguauuuauuuuugugaauguugacgucuaguuguuugaauacuauucauugcaaagacugucuuuucucuguuguacuuccuuuccuuguuuguuaaagaucaguuggcauauauuugugugugucuauuucugggcucucuauucuguuccauugauugauuuguuuauuauuuuguuaauaccacacuuucuugacuacuuuagcuuuauaguaagucuugaagucagguaaugccggucuuccaacauugucuucuccaguauuaaguugcuagucuuggucuuuugccucucuguaucaacuuuagagugacuuuguugauagccagaaaauaaauugcugggaauuugauugagauuguauuaaaucuguauaucaaguugggaagaacugacauauugugacaguauugagucuuuguauucauuaacaugguauaugucuccauuuauuuuuuucuuucuuucuuucuuucuuucuuuuuuugagacggaguuucacucugucacccaagcuggagugcaauggcgcagucuuggcucacugcagccuccgucuccuggguucaagugauucuccugccucagccucccgaguagcugugacuacaggugcacaccacuacgcccggcuaauuuuuguauuuuuaguagagaugggguuucacuguguuggccagguuggucucaaacuuuugaccuggugaucugccugccucagccucccaaagugcugggauuacaggcaugcacaaccacacccagccugucuccauuuauuuagcucuucuuugguaucuuucauuaguguuuuguaacuuuuuucuauagauaaacguauuguguuacauaguuuuuuaaaaaugcuuuuuacauuuuuuauguuuuugagacagcaucuuacucuaucacuuaggcuggagugcagugacaugaucucagcucacugcaaccucugccucccaggcucgagcaaucucccacuucagccuccugaguagcugggacuacaggugugugccaccaugcccagcuaauuuuuguauuguuuuguuuguagagacaagguuucaccauguugcccaggcugcaaguguguauuuuuuguuuuuguuuguuugguuucuuuuuuuuggagguagagucucacucuugcuacccaggcuggagugcaaugguguggucuugacucacugcagccucugccucccggguucaagcgauucuccugccacauucucccgaguagcugggauuacaggugacugccaccauguccagcuaauuuuuguaauuuuuuaguagagacgggguuucaccauguuggcgggcuggucucgaacuccugaccucaggugauuugucuaucuuggccucccaaaguguugggauuacaggcgugagccacugugcccagcuuuguuuuuguuuuugagauucaguuucuguugccuaggguggagugcaguagcgcagucucagcucacugcaaccuguaccucccagguuuaagcaguucuucugccucagccuccugaguagcugggauuaauuuuuguauuuuuaguagagauguaaccacaccuggcuaauuuuuguauuuuuaguagagauggguuucaccauguuggccaggcuggucuugaacuccugaccuuaagugaucugccugccuuggccuuucaaaguguagggauuacaggcaugagcuacugcgccuggccugcaaauguguuuauaaugacaaauuccacuuuuuuauugcugguauauagaaaauuuauugacuuuuguauauuaaucuuggauccuguaaccuugcuauaguuacuuauucuaggaggauuuuugggucaauucugucaaauuuucuacauagaugaucacauuaucuaugaguaaagacaguuuuauuuauuccuucccaaucucuuuaccuuuuauuccuuuuuguggucuuauugaauuagcugggacuuccacuauucuguugaaaagcugcugugaguggagacauccuucccuuguuccugaucuuagcaggaaagcguugagcuguagguuucucauagaucuucuuuaucacguugaaaaaauuucuuucuauucccgagagguuuuuuuaaaaucaugaaugaguguuguucuguaguuugcucaguguuuuuuguuuauuuguuuuguuuuauggagacagagucucgcucuuuugcccaggcuggagugcagucucacaaucucagcucacugcaaccuccaccucucagguucaagugauucuccugccucagccucccaaauagcuggcauuauaggcgccugccaccacaccgggcuaauuuuuguauuuuuaguagagaugggguuucaccauauuggccaggcuggucgcaaacuccugaccucaggugaucugccaaccucagccucccaaagugcugggauuacaggcaugagccguggcgcccggccuugcucagcguuuuuaucuugguuguuagauuuguuaagugcuuuuucuguguuuauugaaauaaucaugugauuuuucuguagccuguugaugugauggauuauauuaauugaguuuugaaugccgaaccaggcuuguauuucugggguauaucguauuugguuaugguguuuaauuuuuuuuaauaccuuguuggauuugauuugcuaauauuuuguugagagguuuuauaucuauguucauaagagauguugaucuguaguguuuuuuuguuuuuguuuuugagacagagucucgcuuugucaccuaggcuggagugcaguguuguugugaucucggcucacugcaagcucugccucccagguucacgcuauucuccugccucagccuccugaguagcugggacuacaggcgccugccaccacgcccagcuaauuuuuuuguauuuuuaguagaaacgggguuucacuguguuagccaggauggucuccaucuccuaaccuugugauccgcccaccauggccucccaaagugcugggauuacaggcaugagccaccgcgccuggccuguaguuuucuuuucauguaauauccuuuucugauuuugguauuaagggaaugcuggacucaaaauuaggaaguacuccugcuucuaucuuguggaaggcuuuguaaagaauugguguaauuucucccuuaaacguuugguagacuucaccuaugaacacauuuaguccugguucuuucuguuuuggaugauuauuaauuauuaauucaguuucuuuaauaauacaggcguagguuuaggucuuuguuuugguugauaugcuugcaauguugaaagccgauaguuuaauaucaauauugucuuuuauuuuacuguaaaaauacuuugaauacucuguuaucuuaaauuuuauuuguguauuuuuaugagauauugauaaaaaauacaacuuuuuuuuuuuuuuaaucacacagccuaguguguuaauuguaaccuacaaggagccugcaaaaucaucuacucaguuuggauccuacaagcaagcugaauggaggccagauaguaccaugauagcuguaucaguaaguagauuuuaccgcuaaauaguguuuucuuaugaaaucauuacaucgcauuuaaauuugauucucuuagaugacuuucuuucagucuuuugcacucauaaguauuuauuuuauucugauaggaauugcuuuacugauuauucuauguggauuacuccuacuauagcuuuucuucugacucugcuacuuccuuaacaaagcaccuauaucccuaaacauagcaccuguauccuuuucuguuuguuguucucacuuuacuguuuugcccuugaagucuaacugcuuuacuaauuauucugugcguguuacuccuacuauagcuucuguuuugacucugcugcuuccuuccaucccuaaacauagcaccuauauccuuuucuguuuguuguucucacuuuacuguuuuguccuugaagucuuaucuaguuuuuuaaaacauauucacaugauauucuugaauuuauauuuaaauuccucccuuccauuccaaaagauauuccagaaaauaauaagcuuuaugugcauauguuauacuaaaauuuccauauccauuuggaucuguuucuccuuuuuuucuucuguucuauuaaacgugccuagauauguuuaauuuuaccuuuucaguucauguuucaucacugucuaaggcugucauuaugacuuaauaugcauuagcaguaauauaugugguuaauuaacauuauugagcaccuccuauccgaugaguacaauuguaaucaguuuacauggaucaucccauuuaaucuuuagauaagugcuuugaaguagauauuauuauccuucauaauggauguguaaauugaggaucugaaaaauugucuuauccaagguuacaugcguaguguauauuagagagauaagguauaaacuuagcuacucagcuuccauuuacuauauccuuauaucuaauuuaucucuuugcguuggucccuuucuaguccauacuguauauaacacugacuagguuaauagucugaaauguucauaugaugaaaaauacugaguaguucuacgcuuccuauagcaggaguuugcagaugacugaccauguaccaaauaugcccuggugccuguuuguacacagaccauaauguaagaauaguuuuuacauauuuaaauaaucaaaacaagucaaagaagaauauuugcuacaguugaaaauuaugugauacuuaaauuucaguguccauaacuaaaauuuuacuggggcacgaaaauccucacugauuuauguauugucuguaacuucuuucaagcuacaauagcagauugaauugaaguucuuacagcaaguguauguggugcucucauugcuuugcucuucuguucaaugcacuguguaguaacacaguuguaacuucauaacauuucaaguguacacauauugccauucugugacauuuuauauuauuuuuauucuaguacauacucaugucaaaagaaccaaagaagacaaaaagacuuuguuuuguuuuuaaagcacacuguagugugguuucuuuuauuauugaauuagauggcaaaauauuguauuuauuauucaauggcacuauagcuaugccaaaagaauauaagcugacaucacuagacuaagcacuuaucagaauguacugaagguuaaguuagaagaauuaaaaaauuuagcacagaacagcucaccacaaaauuccuucacaaaaauaaaauaugaaaaugaaagugcaguaaaaguaaguuugcuuaguuuuugauaaauugacagauguuauaauacugcucaguuguaaauuucagugguccaugugaaguaugaauugacuaagaauuacugugaaugaccugcagaacaauuccagaugaaaaaaauucucaaaggaguugagaaaauacuaauucaguacaacccgaaguagaaucuaagaaguuguauuaauugauaguaguaaaaauccacauggagcagcaaaagacuuaguuggacagauuuacaaaguuugugaaaauauaagacuuuuaaaaccuaugguuaguguaaguuuuuucagagauggaagcaggaauaucuugaauugcccuccuccacagcuguuauggcuuggguagugauaaaaguuuauuggaaaguuuuuuuguuuuuuuuuuuaccgagacugacuuuuuuuuuuuucuuuacuugaaggaccaccaucuaccacuuaacagacacuaaauaacuuuggaaaauagcuuuugcuguauuagaaaauguuuucaaauaugaauuauguaaaaugucauuaaggaccagcauuaauagaugaaaauuugcacucaauuuugaugauagggaaaaguacuuuaaaccccaauuuaccaaaaagguuauuuccacaaaaagaaucuaauucucauuaguggauguauauuaccaaaaaaaguuguacuuuauguuaaauguuacaguacaauauguuaaagaacuauucuuuucccauugaacggucuugguagucuuguugaaaaucaauuggccauugguauuugggguuauuucuggaugcuccauucuguuucauuguuauauaugucuguccuuauuccaguaccacaguuuuuaaauuacuguggcuuuguaguaacuuuugaaaucaggaaguggaauccuccaauuuuauuguuguauuucaggauauaagucaugucaacccauugucaacccauuguaaguugaaaauaccauaaguaaaaaauuuaacagccccaaacauccaucauaaugucguaaguugaaccaucauaaguucaguaucaucuauaguuuugacuauucugagccagucccuaagaugcuauaugacuguuugaacugguuuucuauuucuguaaaaaauaccauugggaauuugguagagacugcauugaaucuguaguucucuuugggaagcauuaauuuaagucuuccagccuaugaacaugcaaugucuuaucaauuauuuagaccuucaauuucuguaaggaguguuuucugguguucaguaugcaagucuuuuuccugcuucauuaaauuuauuuuuaaguuuuaaauuucuuuuugaugcuauuguaaauggaauuguuuuuaaguuuccuuuucaguuguucauuccaaguguguagacauauaucugauuuuuuccaacuuaacuucaggguacauguguaggauguguggguuuguugcauagguaaacaugugcuauggugguuuccuugcacagauuaugccaucaccuagguauuaagcccagcauccauuagcuauucuuccagaugcucucccucauccugcgcccugccccuccauccucuaacagaccccaguguauguuguuucccccauguguccauauguucucaucauucagcucccacuuauaagugaaaacaugugguauuugauuuucuguuccuguguuaguuugcugaggauaaugguuuccagcuccaaccaugucccugcaaaggauaugaucuuguuccuuuuuguggcugcauaguauuccaucguguauauguaccacauuucuuuuauucagucuaucaucgggggacauucagguugauuccaugucuuugcuauugugaauagugcugcagugaauauaugcaugcaugaauguuuguaauagaaugauuuauauuuugggggguauacccaguaaugagauuauugggucaaacgguauuucugccucuaggucuuugaggaauugccuacugucuuccauaaugguugaacuaauuuccacuccuaccaacaguguaaaagcauuccuuuuucuccacaaccuaaccagcaccuguuguuuuuugacuuuuuaguaauagccauucuggcuugugugagacgguaucucauugugguuuugacuugaauuucucuaauaaucagugauguugagcuuuuuaaaauguauuuguuggccacauuuaugucuucuuuugagaagugucuguucauguccuuugcccacuucuuaaugggauuuuuuuuuucuuguaaguuauuaaguucauuguagaugcuggauauuagaccuuucuuugucagauuaauagauuccaaaaauuugcuaccauucuguuguuuaucugcucacuccaaugauaguuucuguugcugugcagaagcucuucaguucgauuagaucccauuugucaauuuuugcuuuuguugcaauugcuuuugucauccuugucgugaaaucucugccugugccugugucccaaaugguauugucuagauuuucuuccuggguuuuacauuuaaaucuuuaaucaaucuugaguucauuuuccuuuaggguguaaggaagggguccaguuucaauuuucugcauacagcuagccaguacucccagcaccauauauuacauggggaauccuuuccccauugcuuguguuugucagguuugcuaagaucagaugguguagguggguguucuuguuucuggguucucuauucuguuacguuggucuauguguuuauucuugugccaguaccaugcuguuuugguuacuguagcccuguguuacaguuuuaagucagguagcaugaugccucuggccuuguucuuuuugcuuugauugccuuggcuauucggacucuuuguugguuccauaugaauuuuaaaauagcuuuuuucuaauuccgugaagaaugucagugguaguuuaauggggauagcauugaaucuauaaauuacuuuggguaguauaaccauuuucacaauauugacucuuccuagccaugaacauggaauguuuuuccauuuguucgugucaucugucauuuguuugaaaguugguuuguaguuccccuugaagagguucuucaccucccuuguuagcuguauugcuagguauuuuauucauuugugaccaacugugaaugggaguucauucaugauuuggcugucugcuugccuguugauguauaagaaugcuaaugauuuuugcacauuaauuuucuauccuuagacuuugcugaaguugcuuaucagcuuacaaagcuuuugggcugaggcaaugggguuuucuaauauaggaucaugucaucugcaaacaaagauaguuuaauuuucucucuuccuauuugaauacccuuuauuucuuucucuugccugauugccccagccagaacugccaauacuauguugaauaggacuggugagagagggcauccuugucuugugccuuuuuucaaggggaaugcuuccagcuuuuguccauucauuaugauauuggcuguggguuugucauauaugacucuuauuauuuugaaguauguuccuucaauaucugguuuauugagaguuuuuaaccuaaagcgauguugaauuuuauuaaagaccuuuuccgcaucuauugagauaaucaugugguuuuuguguucaguucuguuuaugugaugaaucacauuuauugaauuguguauguugaaccagucuugcauuccggggaugaagucuacuuggacaugauggauaaacuuuuugaugggcuacuggauauuugccaguauuuuguugagaauuuuugcauugauguucaucaagcauauuggccugagguuuucuuuuuuuuuguuuugucucugccagguuuugguaucaagaugaugcuggccucauagaaugaauuaaggaggaaucccuaauuuucaauuguuuuggaauaguuucaguagaaauaauaccagcucuucuuuguaccucugguagaauucagcugugaaucugucuguccugggcugguuuuuuuuuuuggguugcuaggcucuuuauuacuucucaauuucaggacucauuauuggucuauucagagauucaguuucuuccugguucagucuuagggaggguguauguguccagaaaaguauccauuucuucuagauuuucuauuuaaugugcauugaugcauuuauaguauucucugaugauuguuuguauuucuuuggggucaggaugauauccccuuuaucauuucugauuguguuuauuuaaaucuucucuuuucuucuuuauuaaucuagcuagcagucuauguauucuauuaauuuuuuuaaauaaccagcucuuggauucauugaucguuugaauggucuuucaugucucuaucuccuucaguucugcucugaucuugguuauaucuugucuucugcuagcuuuuggguuuguucuuguuucucuaguucucuuaguugugguguuagguuguuaacuugagaucuuuguagcuuuuugaugugggcauguagugcuauaaauuucccucaacacugcuuuagcugcaucccagagauucugguacauugucucuuuguucucauuaguuucaaaggacuucuugauuucugccuuaauuucauuauuuacucaagucacucaggagcaggcuguucaauuuccauguaguugugugguuuugagugaauuucuuaauucuucugagugaauuuuuuugaguguuguggucugagagacuguuaucauuucaguucuuuugcauuugcugaagaguguuuuacuuccgauuaugugaucaaauuuagaguaagugccuugugaugaugagaacaauuaguuucuguuguuuuaggauggagaguucuguagauaucugucagguccacuugaucuagagcuaaguucagaucaugaauaucuguuaauuuucugucuuggugaucugccuaauauugucaaugguguguuaagucugcuacuauuauugugugggagucuaagucuuuuugaaggucucuaagaacuugcuuuaggaaucuggguguuccuauacugugugugcauauauggaggauauuuggcgcuuauuaaauugaacccuuuauguaacgcccuuugccuuuuuuaucuuuuuucauuuaaagucuguuuugugagaaacuaggaucgcaguccgugguucuuucuguuuuccauuugcuugguaaauuuuccuccaucccuuuauuuugggaugugugucuuugcacaugauaugggucuuuugaagacagcauaccgcugggucuugguucuuuauuuagcuugccauucugugucuuuuaauuggagcauuuagcccauuuacauuuaagguuaguauuguuauguguggauuugauccugucaucaagauacuaguugguuauuuugcagacuuaugugguuccuucauagugucacugaucuguuuacuucaguguguuuuuguaguggcugguaaugguuuuuccuuuccauauuuagugcuuccuucaggagcucuugcaaagcaggucugaugguuacgaauucccucagcguuugcuugucugaacaggaucuuguuucuccuuugcuuauaaagcuuaguuucgccagauaugaaauucuggguuggaaauucuuuacuuuaagaauguuuaauauuggccaggugugguggcucacaccuguaaucccagcacuuugggaggccaaggcgggcggauaacgaggucaagagaucgacaccauccuggccaacauugugaaaaaccccaucucuacuaaaaauacaaaaauaauuagcugagugucguggcgcauaccuguagucccagcuacucaggaggcugaggcaggagaauugcuugaacccagaaggcagagguugcagugagcugagauugcaccacugcacuccagccuggcaacggagcgagacucugucaaaaaaaaaaaagaauguuuaauauuggccccaaucucuucuggcuuuuaggguuuucacugagaggucuauuguuagucucaugggccuccccuucguaggugaccuggucuuucugucugacugcccuuaacauuuuucuuucauuuugaccuugcagaaucugaugauuauaugucuugggguugaucuucucagggaauaucuuacugagguuuucugcauuuccugaauuugaauguuggccugucuuccuagguuggggaaguucuccuggaugauauccugaaauauguuuuccaacuucguuccauucuccccaucucuuucagguaccccagucagucuuagguucaguuuauuuacauaaucccacauuucucagagguuuuauucauuuucauucuuuuuucucuauucuuguccgcuuaucuuauuucagcaagauagucuucaagcucugagauucuuuucuccacuuggucuauucugcuauuaauaguugugauugcauugugaaguucuuguaguauguuucugagcucuaacaggucgguuauguugcucucuaaacuggcuccuccuaguauugucagugguguguuccagucucccacuauuauugugugggaguuuaagucucuuucaaggucccuaagaacuugcuuugugaaucuggguguuccuacauugggagcguauauauugaggacauuuagcucuucuuguugaauugaacccuuuauuguuauguaaugcccuuugucuuuuuugaucuuguaguguguuucucagcucuaauaggucaguuaacuuccucucuaaacuggcugcuuaucucucacauugucagugguguguuaaagucucccacuauuauugugugggagucuaagucucuuugaaggucucuaagaacuuggcacguccuguauuguuuugucauguuucuuacuuugcauuggguuaaaacuugcuccuuuagcucagugaaguucguuguuacccaccuuccaaagccuacuucugucauucagcuuucucagccucagcccaguugugagcccuugcuggagagguguuguggucauuuggaggagaauaggcacucugguuuuuugaguuuuuagcauuuuugcauugauuaauuucuuaucuuugugggcuuaucugccuuugaucuuugagguugcugaccuuugaaugggguuuuuuguagggucuuuuuuguugauauuguuguuuucuguuuguuuuucuuuuaacaggccacucuuccauagaacugcugccauuugugggggucuacuccagacccuaguugccucgauuuuuccuguaccuggagguaucaccagggagggcugcaaaacagcaaagauggcagccuccuucuucuuuggaagcuccuucacagggggguacugaccuguuguuagcucagaugugccuggaggagguggcuggagaccucuguugggagaugucacccagucaggaggaacgggaucagggacccacuuaaagaagcagucuggcugcagcaggugugcuguguuggggauuccuucagccccccaauugguaugggcucuccaggacccacaggcuggacugauugagaagccugaaugccaguguggcagccuaccccaccacucagguauacuccguccuggggggaaauuagagcucugucuaauuggggguggcucaagaccccagcugggaagacccacuaccccaugaggaggaguggauugaggucucacguaaagaagcagucuggccaugaucuggcaguguggcugugcuacacugcaggaaaccuuucucuuccaugcuguauggauauaugugauuuuuguguauugauuuuauauccuacgacuuugcuaacuuuauuagcucuaauaauuuuugugugcauuauuuauacaucucuguggucugauuuggaugccuuuaucucguuuucuuguuuaauugcucuugguggaacuuucaauacuauguugaauuaagugguaaaaguggguauccuuaucuuguucuuguucuagcgggaaggcuuucagucugucaccauugaguauaauguuggcuuuagguuuuucauauauggucuuuauuauguugagguuauuuacuucuguucuuaguuucuggcaugcuuuuauuguuaaagguguuaaauuuugucaaaugcucucuuugcgucaauugagaaacguggauuuuuucuucauccuguuaauguaguguauuucauugauugauuuuccuacauugaaucauccuugcauucagugaaugaaucccacuuugucacgauguaugaaguauuugcugaggacuuuugcaucuguauucacacaauauauugauuuauauugauuaccaaaacucaagucaguuuugguagauuguauguuuuuagaacuuugucaguuucaucuggcuugucugauuuguuggaauacaacucuuuauuguauucucauaaucucuguuauuuaugcaaaauuacugguaauguucuuucugauuuuugugauuugaaucaucucccuuuuuucuuaacuuaccuagagguuuaucaguuuuguugauuuuucaaagagucaacuuuuggcuggaugugauggcucaugucuguaaucccagcacuuugggaagcugaggcgggaggauugcuugaggcagggaguuacaggggagccugggggacauagcauaaugccaucgcuacaaaaaauaaacuuagccaggugaguuggcacaugauuguaguccuagcugcucaggagggugagucaggaggaucaccugugcccaggaguucaagguuaccaugaguuuugaucuugucacagcacuccagccugggcaauagagcaagacuccguaucaggaaaaaaacaauuuuuguuaaaguguauuuucuuuauuguuuuuccauucucuuuuuauuuugcucuaacuuuuauuauuuccuuucuucugcuagcuucgggauuacuuugcucuuuguuauuuaguuauuuuaugugcacauuuagguuauuuauuugaaaugucccuccaccgccaccuuuuuuuuuuuuuuuuuugagacagcuuccuguuuuguugcccaggcugaaaugcaguggcaugaucauagcucacugcagucuugauuuccugggcuuaaguaauccucucccucagccucccuaguagcugggaccauaggcacgcaccaccacgccuggcugauuuuguuuaauuuuuguagagaugugaucucacuacguuggccaggcuggucucaaacuccuaggcucaagcgaucauccugccuuggccugucaagugcugggauuacaggcaugagccaccgcacugggccugagaugugccuuuuuaaguguggaugucuacuguuccaaccucugccaguuacccagcuccaaaguugcuuccacauuuuuggguaucuuuauagcagcaccccacucucugcaguaccaauuuacuguauuaguucuuucucaugcugcuauaaagaacugcccaagacuggguaauuuauaaaggaaagagguuuaauugacuuacaguucuacauggcuggggaggccucaggaaaauuacaaucauggcagcaggggaaacaaacaugucccucuucacgugguggcaggagagaagugcugagcagagggagaaaagccaccuauuaaaguaccaucagaucucguaagaacucacucauuaucacgagaacaccgugaggguaccaccucugugauucaauuaccucccgccaggucccucccaugacacaggggauuaugggaacuacaauucaagaugaaauuugguuggggacacagccaaaccauaucacugaggaacccuuauauuugauaagcugcuucucuguuaauguuuucaaaauucugucuuuugguuucagcaguuugauucuagugugucucagugugggucucugaguuuauccuuuuuggaauuucuuggauuuguauauucacggauuucauuaaggcuccugacauuuucaaccauuucucuuuccuccauacuucuauuccuauauuauguauguuguugugauuaauggugccccacaggucccccagacucugcuuauuuuucuuuauucuucuuuuugcuccuuagauugcauaauuucaaaugucuuauuuucaaguacauuuaucuuuuccgucugcucaaauuugcuauugaauuucuguagugaauuuuucauuuuaguuacuguacuuuuuaucuucagaauuuuuucaguuccuuuaaaaaaaauuuucccuuuuaucgauauucucauuuuguuuagacauuguuuucuugauuuucuuuaguuuuuugcccauggucuccuuuagcucauugaacauauuuaagaguguugauuuaaugucucagauuaauaauucaaaugucugggcuuccuuagggaugguuucugccauauucuuuauuuucuaugacugggccauacuuuucuguuucuuuuuauguguuguaauuuuucauugagaacuggacugaguauuauguuguggugacuuuggaaaucuaauucuccuagcccucagagauugcugggguucugcuccuugauuacugaagaguuccuuuuaugauuuuuugaaacucuuuuugcauaguauguauuucuucugauggguggucucugaaguuucucuuuuguuuucucuguugccagccagucauguaagauuuccuuauccuacucccaagagaggggagauuuuggugcacccaucacccaagcaguguacacuguguacccaauuuguagucuuuuaucccucacccgccucccacccuuuucccugaguccccaaaguccauuguaucauuauuaugucuuuguguucucacagcuuagcucccaauuaugagugagaacguaggauguuugguuuuccauuccugaauuacuucacuuagaauaauagucuucaauuccauccagguugcugcaaaugccauuauuuugcuccuuuuugugacugaguaguauucgaugguguauauauauaccacauuuucuuuauccacuuguugauugaugggcauuugauugucaucuugcccauaugacaucaaaauucagcagaugucuugaggguaaaauugguguuaaagaaaaaauuaucgaauaauacuuguugaaacacaguaaggaaaacuuuuuuggggacuaucgcaguauauauagggaacacugcaguggguucuugcaguggcaaagagagauugggcucacuucuucagcaugggcaagugggaauuuauagccaaggagcagugugggagucaauggauagaaaauuaauaagaggaaacaucagggguaauggggauucuggcuaaaacaacaggauucuugcugaagacagaccagggugaucagacaucacuuaggggagauuggaggaugagccaccuaaucagauaucaagugugggggucuugcuaaacuggauuuuauaaggaaaugcacagauggaccuaagagaagaagguucaggagccugacuaaaguuugacuaagcacagaaucuuugucacugguuauguguuugaggcacaucaggucuccaguuaguauggauaccugugcaucucacaaauacaggaaauuuuacuuugccuguaugaaguuugcuuucgagcccuugagccccuucugcagcuucuaaguucagcagaugucuugugggaaaaauuggcuguggaguugaggcauuucaagucugauuauuucuucaacccuauguaacugccaagagcuuugcugauuuuucuuugcuccagcaggcgucugccugaacuaagucugcugcuuucuuagccugugcccagaauuggugaaugcucuuaggggaaaaaaaaucagcuuacuucugaacagcccuccuacuaugaauuuuaaucagucuaggccuuauugauuccauagcuugccugaugccuuuaaaaauauaauuuuuuauguuuucugccuuuuucuagcuguugggagaguuggucugccaugaccuacuuauuguauauuacugugcaguagaauucuuaaccauguaauauaaaauugccuuaauacuccuuuuaugauuuuuugagucauuucauuuuuauauauaaaauccaaagcauuauauaaagauggaaugagcccagauauauccauuaaaacuauuguaacugcccaacaguuucguuuugccugcugccugaauacaauugauuuaucaagacagaggaauugcaauagagaaaguuuaauucaugaagagcuggcugaacagaagcgccauaguuuuauuauucaaauaagucuuccccaauauuuggaggcuaggguuuuucaaggauaguuugguggggcagggaaugggugcugcugauugguuagggaggcagucagagguguggaaaauggucuucaugucgaguccacuucugaguaggaccacaggaccaggaccaguugguggguccacguggagcccuccgccgucagaaaugcaaaaaccugagaagguaucugaaaaggccaaucuuagguucuacaguagugauguuaccugcaggaguaauuggggaaguugcaaaucuugugaccucuggaauaaugacugguaauuguuuacauuuacacuuuagcagaauucaggcuccucuccuccuccuaaugucuugcuaaacagaugauacaaaaauaucagugaccuuucuaaacuauuaccaaauaauacagagauggcucucuguauuauuuauuuuauuauuauuauuauuauuuuuuuuuuuuugagacggcaucuugcucugucacccagacuggaguggaguggcgcagcgcaaucucugcucacugcaaccuccgccucccagguucaagcaguucucccugccuuacccucccaaguaguugggauuacaggugcucgccaccaggcccaacuaauuuuuguauucuuaguagcgacaggguuuugccauguuggccaggcuggucucuaacuccugaccucaggugacccgccugccccggccucccgaaguguugggauuaugggcaugagucacugcacccagccuguauuauuuuauaucauaaugaaagaaaugaaaauaaaaaagaaccuguuuugcaggcagaggcuacaaaaacuuugaacaacuaguagaaaugguuuaaguuaauuucuaaauucugagaagauagaaggacuaagcccccauuccuaacuccucuccucuucucaggaguauaaacaugagccuaaagucagaaucaucaagauaucaaguucuuuagggaaagaauaggugcugaaggaccaggcagagggaaagguuugcuuugccacuccuuaaggcacugagacaggaucugagauuucacaguucucuaagugagcuuaaaaaaguggaauccugugguuucccuucagaaaagggaggacugugucugcuccuggaaguggacauuagcagggcuucccauaaaacucuguuaacugcugcggacuuagaguagagguugcacaggugaacucaguugcugccacaccucauggucugaggaagccggcccuucuacucagagacagugccugagaggagacugcugaagccucagcucagcaguaugugagcuugucugccucugcaaacugucacuuuauccagcaucuguagguuugcauugccagauacccacaucaaagccuaaccucuacagguggcuaauggaacacagcaaagaaaaaaaccacuaagggagcucauuaacuuuacgauguaagaccaaacuaaacaaguaaaauauguggcuccuauugaugagccacagggaugagacagaagaauguaguaaauuaagaaaaaaauuacuaagaacuuucagaaaauguaauuagaacauaaucaggauuuuucagagcuaaaaauuuccuaagagaaaaauucaacagaugaacugauaaauaaccccuugugagagcugaaucuuuuguuccagaagaucaaauagaaacaauuucaugauguaaggcauauagaaauaaaauuauuuuugaaaagauaagagaccugcaggagcaaauucaagagguuugggaaugaguguuauagaaagaaaacaagacagaacaaguauuaguuuaggaaauaauagaagaaacuuaccuaguuuagaaacauugaagguugucagauugaaaaggcugagacuuagauacauuugauugcggguggggcuauguggaaaaaguuuaaugaaaaaacguacauaucuagagauaaugugcagaaauaacugaauuucagucaugagaaaaaucauucagagaaaagggaaagagaaucacauugacaauagacuucucacuacuaacccuggaaacuuaagggaacauuagaacaacaucucauagccaugaaaaaagaaucucuaacaauccuguaccuagacaggauguccuuuaucucgguuaaguaacgguauguucggauaauuuauuucguuuaauaagggaaugccuugguauuggagcuacagugaacaggacaagcaaguggacauguaacuaauuccuagguuagugagagauaggugauaaacaaguuuagacaagaaaaugaaacgugaugaccauaccauccauguuagguauaugcaaugcuuagggacaauuauuaucuguauuaauauucauauuaauaaaaacuuccuauggaagaccauccuauugaaaaauggacgaacaaggcaacuugcagaaggagaaguaugaagagccaauaaaaaugaaaagauaagcaucacuagcaaggaaacaaauggaaauuaaaauaagaccauuuuucaccaaucuaaugcaggcauaaacaggaauucuaggaacaaguagaguguuacugggaauuaauguaauuuuuuggauaaauuuggcaauacauauuaaaaugaauguacauacauacacuuugacuuggcaauccuacuuaagggaagguaccccacaaaauauauaugcaccaaaacauaaggagauauauauauauauauauauauaaauaaauguugauugcagcauugucuguaguugccaaagguccaucaagaaaagaauagcaaaguaaauaagaaacuuccauacuuuggaauaucacacaaauacuaaaaauaguaguaaguguaucuaugaauguggaagaacagucagaaaacacuaagugaaaaaaaucaaauugcaugguaauguguaaauuaagauuccaauuuugugugaaaaugauaaaaguuccuguauauauuuaucaguuuaaaaauuuacucauuucugaguuagaauccaaugcagacauuuaaaaucaaguuacagaagaauguuaaguuuauacaacauuugugauaaaauaaugucauaaaagcagauuauaaaacuguaugauagcuuuauauaaagaaaaaaauuguauuuuagauaacccucuacuuaagaaacuaacagauuuaucaacugugcucgucauaaccaguuacauuagcaggcauuuacaguaucaucaguuuggauuuaaaaacagacuucagcagaagucuaauaugcuguaaaauauaagaguuugugcaaaugucccuggaaaagacauaaggacuacauaaaaauugauaaugauuaucugugaauggugaaacuauuggcaguuuauuuuuguuacuuucuguguuucuuggguuuucuucauugaacauggagaaauuugucauucauaaaaaaaaaauuuaacaaaaauucauuuaugauccuguaugaauuuuaaaauucauauaagcuaaaauguuaauucauguuuuaaauagcccaaguaaggaugaauuaaauuacuagaagcaggucagcauuuacucaauauauuuaauauaagccagauuacuaugacuaauauuauauuuaucuuaacaucuccacaaaguucuagaaauaagacgguggugaaaggauaauaaaaacucaggaccccaauucaccacuccaaaagggaaaaaauaagcugaaagcccagucaugcaagaaacugccuuuccuuuuguuccugagcugauaacuacagauaaaagguuagguuaccuacuccacaaguagcuacuuauguucaccauaucuuauguaaagugccuguuuaaugaugccagacgaauacauaauugacuauuccccuaccugcucuuuucucuuggaacuuguggauuaccauacccuccuucucuccccuccagcccacuuuuccccuuuaaagauugaagcccucaaauucaucuuuggagaaaggcacagaucacagacugucacugugauucuguuuuuuuguuccgggcauaugcuuaaccuuggcaaaauaaacuucuaaauugauugagaccugucucagauacuucuugguuuacaacuauguucuaaauaaaguguuggugccacaaaagaaauagcacucaaauauaaaauuuucuuuuuaauucucagcaaggcaguguacuucuauagaggggugcgcccuuacagauggagcaauggugagcgcacacuuggacaagggaggggaagggguucuuaucccugacgcacguggccccugcugcugugucguuccccucuuggcuaggguuagaccgcacaggcuaaacuaauuccgauuggcuaauuuaaagagagugacugggcgagugguuuggcgggaaaaaugguuauggcagagcaggaaauuggaaugagucaggguggagaaugagcagguaaugggaacgagucaggguggaguagguaaucggaaugagucaggguggaggagguaaucuaaaaagauugcuuuaugaggaaguuaaguuuaaaaguagaaggcaaagaauugaacuuacugacauaucgauucuuugaagagaaacuuagaacuccuaucuaacaacuauaaguaauaaauaagugaaauaaaaauuagauuuucaguggccaaaaauauuaaauuauuuuguuacucuuuauguacuuuauuucuucaacuuacgacaaguauaauuucuucuaacuucuuuguugucuuaauauuuagcguaauauaaaagguagucacuuaauaaauuaaugugaaauuauuucugauauaaaaauaaagcuaucagacuguucccucuguacugucuagugggaauuuuaggggggaaaaauguacauacaaaauggccuacaaauaacauggaggaaucauauguaaaaacuaauguaccaguugcuuaaacuuucacuaaacucuucuuccuuugaaagaugaggaagaguuuuaauuauauacugaauauaaaaauuaugcuauucauaauaugcauacagcacauuugcagucagugguaaauuauugaucuugaaaccaccuuugcaaaaauaacaaugagaaaauuaugacaguaaaagaaaucuaaucuaacccccaucuugccuuuaaccucccaacugcccuuggucauuccugggccuaggccaugcuaacuuuaggagaaauuuauaguuuaaaugauaauggcccuuccccaaaacuaaaccaccuuuguaaagcuaacgaaagacgaggucuugcuguguugcccaggcuggucucaaucuccuggacuuaagugauacgcccaccucagacucccaaagugcugggauuacagaugugagccacugcaccuggccuggauaagcaaacuuucuagguaaccaaagcuuuaucagauucugaaacguuacuaauuuaaugauucuuuuccucaaauguauucuauaguuuuuuauccuuguaugaaauauauugaauaugaauuaacgguguacuugaagauuaaauuguauaauuauaauaguaaauuuugggaggugucuauguucuaggcacuguuguagugcuuuauguguauuaaaauuaauuuguuauucauaacaauccucucaagguagauacuuuuauauucccaucauacaguugagcaaacuaggguacagagagguuaaguaaccugcucaagaauacauggcuaauaaugaaauguuaguaauauuuugaaagcucuauuucugcaucauuauuagagccauaggcaucuccuuaucaauuuguaucuuaaaaagaaaucucacuggcacuuuuuuaaugggguuuaaagaaaaaaauugcucuacuguuuuaagaauccccaccucucucaaaaccaacgacugaucugcuuuuugucacugccaauuacuuuguguuuucugguuuuauauaaauuaagucauacacuguauacuuauuuuuucuaguuucucucagcauauuuugagauucauccauuuugucgugaaucaguaauucauuaugaguauuaguuuacggauuucucacaguugguuuauccauucaucuguugauggacaguuugacuuguuucccguuuggggcuguaacaaacaaaacuacaugaacauugauguacaagucuuuguauggaugcguauuuccuuuucuguuggguaaauauccaugaguggaacagcuacauuauaugguagaaguauauuugacuuuuaaaggaaaugugaaacuuuucugaaguaguuauaccauuuuacauucccgcuagcaguguaugagaauuucuauuuuccucuaucuuugccaacaugugguaggguaugccuuuuuaauuuuagucauucugguagugguguagugauaucucauuauaauuuuaacuugcauuuuucuaauaacuaaugauguugaacauuuuucucauuuguuuauuuguuaugugugugucuuauuugguaaaauguguguucaaaucuuuugcccauuuuuuuagaugggauccuugauuucuuguuguuaaguucauauuuugcaucuugauaucuguuccaguacaauugguugaaaagauuaucccuucuacacagcauaucuuuugcaccuuugucaaaaaucaguugucuacauauguguggguuuacuucuauauacuucauucuguuccaugaucuauuuguauauauuuaacaucauuuugauuacucuagauauauaauaauuuuugaaaucacacaguguuaggucuccaacuuuguucauuuucaaaguugcuuuugcuauuguaggccuuuguauuuccauauuuuauguucaucucaauuuuuuuuuguaaacauuaaaacacaggaaaagaauuagagcauagauauaaggguuauuuuuacuuauagcauuauauguaaauuaaaacuacauuguuuugaaaaaacuuccacugaacaaacauuuuucucaccauguuuacucuuuuuuuuuaaauuuuauuauuauuauacuuuaaguuuuaggguacaugugcacaauguguagguuuguuacauauguauacaugugccauguuagugugaugcacccauuaacucauuuagcauuagguauaucuccuaaugcuaucccuccccccugcccccaccccacaacaguccccagugugugauguuccccuuccuguguccauguguucucauuguucaauucccaccuaugagugagaacaugcgguguuuguuuuuuuguccuugggauaguuugcugagaaugaugguuuccagcuucauccaugucccuacaaaggacaugaacucauccuuuuuuauggcugcauaguauuccaugguauauaugugccacauuuucuuaauccagucuaucauuguuggacauuuggcuugguuucaaguguuugcuauugugaauagugccgcaguaaacauacgugugcaugugucuuuauagcagcaugauuuauagucauuuggguauauacccaguaaugggauggcugggucaaaugguauuucuaguucuagaucccugaggaaucgccacacugacuuccacaaugguugaacuaguuuacagucccaccaacaguguaaaacuguuccuauuucuccacauccucuccagcaccuguuguuuccugacuuuuuaaugauugccauucuaacuggugugagaugauaucucauaguggcuuugauuugcauuucucugauggccagugaugaugagcauuuuuucauguguuuuuuggcugcauaaaugucuucuuuugagaagugucuguuuguaucuuucgcccacuuuuugaugggguuguuuuuuucuuguaaauuuguuugaguucauuguagauucuggauauuagcccuuugucagaugaguagguugcaaaaauuuuuucccauucuguagguugccuguucacucugaugguaguuucuuuugcugugcagaagcucuuuaguugaauuagaucccauuugucaauuuuggcuuuuguugccauugcuuuugguguuuuagacaugaaguccuugcccaugccuauguccugaaugguauugccuagguuuucuucuaggguuuuuaugguuuuaggucuaacauuuaagucuuuaauccaucuugaauuaauuuuuguauaagguauaaggaagggauccaguuucagcuuucuacauauggcuagccaguuuucccagcaccauuuauuaaauagggaauccuuuccccauuucuuguuuuugucagguuuguccaagaucagauaguuguagauauguggcauuauuucugagggcucuguucuguuccauuggucuauaucucuguuuugguaccaguacuguuuugguuacuauagccuuauaguauaguuugaagucagguagugugaugccuccagcuuuguucuuuugacuuaggauugucuuggcaaugcaggcucuuuuuugguuccauaugaacuuuaaaguaguuuuuuccaauucugugaagaaagucauugguagcuugauggggauggcauugaaucuauaaauuaccuugagcaguauggcuauuuucacgauauugauucuuccuauccaugagcauggaaaguucuuccauuuguuuguauccucuuuuauuucauugggcagugcuuuguaguucuccuugaagagguccuucacaucccuuguaaguuggauuccuagguauuuuauucucuuugaagcaauugugaaugggaguucacucaugauuuggcucuguguuugucuguuauugguguauaagaaugcuugugauuuuugcacauugauuuuguauccugagacuuugcugaaguugcuuaucagcuuaaggagauuuugggcugauacgaugggguuuucuagauauacaaucaugucaucugcagacagggacaauuugacuuccucuuuuccuaauugaaugcccuuuauuuccuucuccugccugauugcccuggccagaacuuccaacacuauguugaauaggaguggugagagagggcaucccugucuugugccaguuuucaaagggaaugcuuccaguuuuuguccauccaguauaauauuggcuguggguuugucauagauagcucuuacuauuuugagauacaucccaucaauaccuaauuuauugagaguuuuuagcaugaaggguuguugaauuuugucaaaggccuuuucugcaucuauugagauaaucaugugguuuuugucuuuggcucuguuuauaugcuggauuacauuuauugauuuucguauguugaaccagccuugcaucccagggaugaagcccacuugaucaugguggauaagcuuuuugaugugcugcuggauucaguuugccaguauuuuauugaggauuuuugcuucaauguucaucaaggauauuggucuaaaauuuucuuuuuuuguugugucucugccaggcuuugauaucagggugaugcuggcgucaucaaaugaguuagggaggauucccucuuuuucuauugauuggaauaguuucagaaggaaugguaccaucucuuccuuguaccucugguagaauucagcugugaauccaucugguucuggacuuuuuuugguugguaagcuauuaauuauugccucaauuucagagccuguuauuggucuauucagagauucugcuucuuccugguuuagucuugggaagguguaggguguauguguccaggaacuuauccauuucuucuagauuuucuaguuuauuuguguagagguguuuaugguauucucugaugguaguuuguauuucugugggauugguggugauauccccuuugucauuuuuuauugcgucuguuugauucuucuccguuuucuucuuuauuagucuugcuagcggucuaucaauuuuguugaucuuuccagaacaccagcuccugcagucauugauuuuuuuuuuuuuuuuuuuuuuuuuuuuugagacggagucucgcucugucgcccaggcuggagugcaguggcgcgaucucggcucacugcaagcuccgccucccggguucacgccauucuccugccucagccucccgaguagcugggacuacaggcgcccgcuaccacgcccggcuaauuuuuuguauuuuuaguagagacgggguuucaccuuguuagccaggauggucucgaucuccugaccucgugauccgcccgccucggccucccaaagugcugggauuacaggcgugagccaccgcgcccggccgauuuuuuuuaagguuuuuuugugucucuauuuccuucaguucugcucugaucuuaguuauuucuuaccuucugcuagcuuuugaauguguuugcucuugcuucucuaguuauuuuaauugugauguuagggugucaauuuuagaucuuuccugcuuucucuugugggcauuuagugcuauaaaauucccucuacgcacugcuuugaaugugucccagagauucugguuauguugugucuuuguucucguugguuucaaagaacaucuuuauuucugccuucauuucgcaggagcagguuguucaguguccauguaguugagugguuuugagugaguuucuuaauccugaguucuaguuugauugcacuauggucugacagacaguuuguuauaauuucuguucuuuuacauuugcugaggagugccuuacuucaaacuauguggucaauuuuggaauaggugugguguguugcugaaaagaauguauauucuguugauuugggguggagaguucuguagaugucuauuaggucugcuuggugcagugcugaguucaauuccuggauauccuuguuaacuuucugucucuuugaucugucuaauggugacagugggguguuaaagucucccauuauuauugugugggagucuaagucucuuuguaggucagcaaggacuugcuuuaugaaucuaggugcuccuguauugcgugcuccuguauugggugcauauauauuuaggauaguuagcucuucuuguugaauugaucccuuuaccauuauguaauggccuucuuugucucuuuugaucuuuguugguuuaaagucuguuuuauccgagaguaggauugcaaccccugccuuuuuuuguuuuccauuuguuugguagaucuuccuccaucccuuuauuuugagccuaugugugucucugcaccugagaugaguuuccugaauacagcacacugaugggucuugagucuuuauccaauuugccagucugugucuuuuaauuggagcauuuagcccauuuacauuuaagguuaauauuguuaugugugaauuugauccugucauuaugauguuagcugguuauuuugcuuguuaguugaugcaguuucuuccuagccuugauggucuuuacaauuuggcauguuuuugcaguggcugguaccaguuuuuccuuuccacguuuagugcuucuuucaggagcucuuuuaaggcaggccugguggggacaaaaucucucagcauuugccugucuguaaaggauuuuauuucucuuucacuuaugaagcuuaguuuggcuggauaugaaauucuggguugaaaauucuuuucuuuaagaauguugaauauuggcccucacucucuucuggcuugucgaguuucugccaagagaucggcuguuagucugaugggcuucucuuuguggguaacccgaccuuucucuguggcugcccuuaacauuuuuuccuucauuucaacuuugcugaaucugacaauuaugugucuuggaguugcucuucucaaggaguaucuuuguggcguucucuguauuuccugaauuugaauguuggccugccuugcuagauuggggaaguucuccuggauaauauccugcagaguguuuuccaacuugguuccauucuccccgucacuuucaggucagguacaccaaucagacauagauuuugucuuuucacauaguccuauauuucuuggaggcuuuguucguuucuuuuuauucuuuuuucucuacacuucucuucucgcuucauuucauucauuucaucuuccaucgcugauacccuuucuuccaguugaucgcaucggcuacugaggcuugcgcauucgucacguaguucucgugccauggguuucagcuccaucagguccuuuaaggacuucucuccauugguuauucuaguuagccauucgucuaauuuuuuuucaagguuuuuaacuucuuugccauugguucgcacagaguaauuugauuuucugaagccuucuuucaacucgucaaagucauuuuccaucaagcuuuguuacauuguuugugaggagcugcguuccuuuggaggagaagaggcacucugauuuuuagaguuuccgguuuuucugcucuguuuuuuccccgucuuugugguuuuaucuaccuuuggucuuugaugauggugacguacagguggguuuuugguguggauguccuuucugauuguuaguuuucccucuaacagucaggacccucagcugcaggucuguuggaguuugcuggagguccacuccagacgcuguuugccuggguaucagcagcaguggcugcagaacaguggauauuggugaaccucaaaugcugcugccugaucguugcucuggaaguuuugucucagaggaguacccggccgugugaagugucagucugucccuacuggggggugccccucaguuaugcuacucaggggucagggacccacuugaggaggcagucugccgguucucagaucucaagcugugugcugggagagccacuacccucuucaaagcugucagacagggacauuuaagucugcagagguuacugcugccuuuuguuugucugugcccugcccccagagguggagacugcugaggaaggcgggccuccuugagcuguggugggcuccacccaguucaacuucccggcugcuuuguuuaccuacucaagccucgggaauggcgggcgccccucccccagccucgcugccaccuugcaguuugaucucagacugcugugcuagcaaugagcgaggcuccgugggcauaggacccuccgagccaggugcgggauauaaucuccugguaugccauuuguuaacccuguuggaagagcacaguauuagggugggagugacucgauuuuccuggugccgucugucaccccuuucuuugacuaggaaagggaauucccugaccccuugcgcuucccaggugaggugaugccuugcccugcuucagcucacgcacagugcgcugcacccacuguccggcacaccccggugagaugaacccggcaucucaguuguaaaugcagaaaucacccgucuucuguguugcucaugcugggagcuguagacuggagcuguuccuauuuggccaucuuggcuccacccccccccccccccccccccccccccgccaucucaucaauuuauacagaaaugucugcugggaguuugauugggauuacauugaaucuuuggauccauuuggggagaguugcuaucuuagcaauauaaacaagauguauuucuccauugaaguauuuuuacuuucagcacuguuuucuaguuaucaguguacaaguauuucaucucuuuugccagauuuauccauaucucacaacuuuaauguuacugauuuuuuucauuuucuaauuguucuuauuaguauguaaaaaugcaguugauuuuucuauauuugucuuguguccagcagucauacuaaacucacuuauuauaguuaauuccauuaggaguccuaugcaaaugaccauaucaaaaacaguuuuacuuuuucuccccaauuuauauaccuuuucuuuuucuugucugaauuuacugccuagagucuagacaguguugaauaugaugaaggcauucagucuuuuaccauuaagaaugauguuauaaauauuuuauaaaucucuuucauccagauauggaaguuucccauuucuuccuaauuuacugagaauuuuuaaucaggaauggauguugaauuuugucuaaugcuuuuaaugcaauguauucagacugucaugguuuuccuuuuuuaguuuguuaauaagguaaauuacauguauuuaauuuuguuaaaccccaacccugcauucuuggauaaaccucauuugguugugauguuuuuuuuuuauaagguugaauuuaauuugcuauaauuuuguuuagaauauguuaaugagggaaggagaacuacaaaccacugcucaaggaaauaaaagaggauacaaacaaauggaagaacauuccaugcucauggguaggaagaaucaauaucgugaaaauggccauacugcccaaggugauuuacagauucaaugccauccccaucaagcuaccaaugaguuucuucacagaauuggaaaaaacuacuuuaaaguucauauggaaccaaaaaagagcccgcaucgccaagucaauccuaagccaaaagaacaaagcuggaggcaucacacuaccugacuucaacuauacuacaaggcuacaguaaccaaaacagcaugguacugguaccaaaacagagauauagaucaauggaacagaacagagcccucagaaauaacgccacauaccuacaacuaucugaucuuugacaaaccugagaaaaacaagcaauggggaaaggauucccuauuuaauaaauggugcugggaaaacuggcuagccauauguagaaagcugaaacuggaugccuuccuuacaccuuauacaaaaaucaauucaagauggauuaaagauuuaaauguuagaccuaaaaccauaaaaacccuagaagaaaaccuaggcauuaccauucaggacauaggcaugggcaaggacuucaugucuaaaacaccaaaagcaauggcaacaaaagccaaaauugacaaaugggauguaauucaacuaaagagcuucugcacagcaaaagaaacuaccaucagagugaacaggcaaccuacaacaugggagaaaauuuuugcaaccuacucaucugacaaagggcuaauauccagaaucuacaaugaacucaaacaaauuuacaagaaaaaaacaaacaaacccaucaaaaagugggcgaaggacaugaacagacacuucugaaaagaagacauuuaugcagccaaaaaacacaugaaaaaaugcucaucaucacuggccaucagagaaaugcaaaucaaagccacuaugagauaucaucucacaccaguuagaauggcaaucauuaaaaagucaggaaacaacaggugcuggagaggauguggagaaauaggaacaguuuuacacuguuggugggacuguaaacuaguucaaccauuguggaagucaguguggcgauuccucagggaucuagaacuagaaauaccauuugacccagccaucccauuacuggguauauacccaaaugacuauaaaucaugccgcuauaaagacacaugcacacguauguuuauuguggcacuauucacaauagcaaagacuugaaaccaacccaaauguccaacaaugauagacuggauuaagaaaauguggcacauauacaccauggaauaguaugcagccauaaaaaaugaugaguucauguccuuuguagagacauggaugaaauuggaaaucaucauucucaguaaacuaucacaagaacaaaaaaccaaacaccgcauauucucacucauaggugggaauugaacaaugagaucacagggagacaugaaggggaauaucacacucuggggacuguggugggguggggggaggggggagggauagcacugggagauauaccuaaggcuagaugacgaguuagugggugcagcgcaccaguauggcacauguauacauauguaacuaaccugcacaaugugcacauguacccuaaaacuuaaaguauaauaauaaaaaaaaagaauauguuaaugagggaucuuggccuguaguuauaaugucuuugucugguuuuguuaugaggccucauaaaaugagauaggaagugguuccuucucuuugguguucuggaagagucuguauucaacugauauuauuuauuucuuaaagaguugguagaauuuaccagugaugcugucucagccuagaauuuucuuuguggaaaggauuugaauuggaauuauaauuucuuuaacagacauuggcuuuucaggguacagauuucuuuucagugaacuuuggugguuuguguuuaucaaggaauuuguccaucucauccaaguuguuaaaauuauugucauauuaauaaugugaccucauuauucuuuuaauaccucuagaauuuguagugauaucaccucuuugauuucuguuaguggcucuuuuuugccugaucagugugaccagaaauaugucaguuuuagugaucuucuaaaacaauaacaaaagaaccccagauuuuuauucauugauuuuauuuuucuguuuucuauuucauugauuaccacucugaucucuguuauuugcaugcuuccccacccuccaccacuugcuuuggauuucguuugcucuaguuuaauuuguuucuaguuuaagguagaagcuugucauugauuugagauuuuccuuuuuuucuaauauaaguauuuuaaggcuguaaauuuccucuuuaguacugcuuuagcagcaucccacaaauuuugggaugauguauuuuuaaaauuucccuuuuucuccuuugauucauggguuauuuagaaguaugcaguuaagcuucaaaauauuugugggcuuuccagaauuuuuuuuauuuguuucuaguuuuguucuauugggaucaggaaacauauauuauacacauuuuauuuuuacacacgguauaaaccccagcauacacugcuauuauucuuguuuuaaagccuguuaucuuuuaaagaaauuuaagugaagcaaaugaaauuugaauuuaauuaaauauuuuuuuucugacucuuaccccugucaugcggagacucuguuuauauguauauugggcuacaugaaguuguuccucaauucacugauuuuguuucuguuuuauuuuggguuuuuuuguguguguguguguuucauuauggauaauuuuuauugcugugcuuuucugaucauugucuaaccugucauucauccagccaaugucuuuuucaucucagauauuuuaguauuucuguuucuagaguuuuguuugaguuuucuauauugccuaaccuuuggaacauacagaauauaguucacauuuggaacauuaugaaauauagcaaaagguuuuaauguccuuuugugcuaauuuuaacaucugauugaguuaugcauuguuuugauugguugauuuuucauuaugucucauguuugucuuacucuuccuggacucuucagcuucuucucaacucuggaagucugccaggcuuugucuuagugcgccuucuaagugugcugacccagaaauucucacaaggcaguaagcuggguaagaguaggagggucacuucaguuguuucuuaucucucaaggaugacuggccuucauugcuugaugccaguguuuugaaaaguauuucauagauuuugucuguuuuuguuguuguuguuguucuuguuuuuuuaugugugaaaccuuuguuaugauuugauuugaagccauuuuccuuuugcuuccauacucuccauauugcaagaacauaaaauugcacauaaagaauuagaaagaugaucuuaucugaagaauuuucacccuuuuguuuuuguaucuuacaguguugaaacucuaguuucaaauacauuauaaaauaguaaaguuaauggucaaaaagaaagcaaaccaccugguuuugcugaagaaacuaaguauuuucuuggucauuccuuugaaaaacaggaagccagaauuagaaaguaauuugaaaccuuggauaauuucuugguuuucuuugguucuacuuugaguacaugcccaccucccucuaaaaugauaggaauucaguauuacuguaaaguaguuugggcaaaacacugccacuucacucuguuaggcguaaaaauguuuggcuggaaacagcuaaauauaauauuuuguacuuacagaaauguaaaaugguuguuugaacuucacaaauguauguaugucaugacgcagauguaugucaugaucauguaauagcacuguuuuuaauacaauuucuuuuuuuuuuuuuuuuuuuuuugagacggagucucgcucugucgcccagcggggagugcaguggcgcgaucuuagcucacugcaagcuccgccuucuggguucacgccauucuccugccucagccuccugaguagcugggauuacaggcgccugccaccacgcccggcuaauuuuuuuguauuuuuuuaguagagacaggguuucaccacguuagccagaauggucuugaucuccugaccucgugaucugcccgccuuggccucccaaaauacugggauuacaggugugagccaccgcgcccggccuacaauuuguuguuaaaaaauauuuuguuaacuuagaaaaaugaacuagcugauacucaaauuuuggaaauuaaagguuugcucuguuuuaugucuguaucuggggcuauauuuuguaguaaaucagagaccaaaagauuguuuuugaaauauauaaauaugcuguucugaaguuaauacuguguaaauuuugaguagaguaagcguuuugucuuaaagguguaauaaagccauaaaguggcauuguugcuuuauaaacuuagaauaauaauuugccauauuagugcagaguucaaaaaguacuauauauuuugcaaaauagucacuuacucauuauugaauaaugcaguuacuugagaguaugcaugucuagaauacuuuaugaaguacugauuucacugaaagauuuugaaaucuguaaaaacccuuuuuuucaacauggguuauauuaaaaagucgcuucuauuugcauaauuaggcuauaauucuccaagggaggguauuggagaauaaauuuuuuuucgaaguaagaauuuauaaaauuaaaauucaggguuacaguuauagccuuacucuuuaauucaugauuaauaaaauuucucuuucagacggcaaauggauacaucuuguuuuuucauauuacaucuacaagaggggacaaguaccuuuaugaaccaguguaucccaaguaaguuuguugccuuucauucuuuuaauaugugauuugcauacuuuauauucagaaaaacauuacaguuuugaguugucuguagugauuagaauaaaacuaaaccagcauuucccaaauaguauuuaaaaaauuaccaggucuuugaacugucauuucuugaauaaagaauucuuuaagucugggaaucuugaugauaaacuauaucaagacuauuuucuuggguauucagaaugacuguuaauauauuccaggucuagcauuucucauuccuuauuagggaagagcuaagagaucaugagaggaagaguugaaauguugguaaguuacagguacuuuugcaugugcuuuuguauaugcauagaaaaaaaagaaccucagacaguuauuaccucuugguuuaaauuugggaaaaacguggacuuuugcccuuuacacuguguaguuauguauauuuugcauucuuuuccuuauagcaggccuuaacuuuugaaauaaaagaacauacaauuguaaagcauuccaucuuuuuuuuuuuuuaaucaagccauaaagccagauaaaaauauaagagcauuuaucacauuucuagaugguggaagauauccaaaguuuaauagguauauaagaaauuagaaagacagauuuuacugugugaaaaguuuaaauuuuugaauauuaacagaaaaaaagaaaaacauuaacagcaaauaacuugggaaaaauauuugugguaaauagggccaagucuuacuacuuuuauauaaaagagauauauaaauugccaauaagcacacagagauuccaguagauaaauagggaaaguagucucauuaaaggaaauacuguaacuaacaaacucaagagaaaguauuuagacccaguaguaacccaaauaaaauaaacguuaaauaaaauaaacccaaauaaaauaaacauuaaauauaaccauuuuuauuuuuuaauaauuaaagaauuauuacugcucgcagagguauaauaaaaguuguguugcacacuucugauacacaaaggugugauaauagggagcugguuaacaaguuaacugugguacauccuucucuuauagugauauguagucauuaugucucagaaaaauguauaaacuuaagaacuugaccauauuauaaugccaagugaagaaacaagucacacaaaauuauauauguaauaugaccaugacuguauaaaacaaaacaacgcaagucaucuaaagacaaaaucuagagcaauacaguacaaauauuuauaguaauuguuccugaaugguagaacuguagugauucuucugcuuuucaacucuuaaauuuucaacuaguuagauuuucuugaugcuauagccacuuguuuuuguaacaaguauagugcuaacugagguauucgguuuuggaaaucuuuaaaguacagacuuuuuugaugaugggauucaauuuaacuuguuuauuuuucaauaaaaauauuuagugcaaaaauuuuugacacauaaauauagugcaaaaugauaggaacaucaugauguauuuagaaauuuuaaauucaguuuuauggguaaaacugaaaaaagaauuuuuuugcauucuaagugauaauuuugugauucuuuugaagaacuguuguaaucaaugacuaaaauuagauuuacuggugcauuuuaaacuacuauguuuguuuuauugcuuaauuuagacauguuccuauaaauaaaaagcaguaaucagaaacaacaauuuaacuccauuaauuuauguuccugugggcaugguagagaaauaacuucucuugaaacagugaaaauucuauuuucuuuauuucaguucacuaauaccauuacauguuuauaguguuuuggaauaguauuuugagacccacuuuuuguguuccagaaaaguuuuaagaaacaguuucuuucuuuucugauucuaaaacugcaagagacaccaguuaacuaaguaguccugacaaugcgugaacuuugcuguguuugacucuauguguuaaggcagagaacuaaauaaaaaacauacucucuuucuuaauuugggcauucuuuuacuauauugaaaguuuuagguuucaguggcuggccucaauaaaaugugcauugcuuuagagcaguucgaauaauaguuaaagauacaggcuuuggugucagauagaccugaaauuaaauguuggcugugccacuuuucagcuauaugacuucuuucaaguuauuuaauaccaccaaaaacuuuccucaucuguagaguaggauaacaguaguaaucaucucauaagauuaaaugagaucauucauauuuaaugcuuagguaagcaccuagcuuaugggauaauuaauaaaggacaacuguuauuaucaguaauuuuuuucaccaaguguuuacuucauuucuaagcuuuuaaguaauuuuuaaauauauacauauauaucuacuugauauuuuacuucuuugccagagucuaacuucuaguaacugcuaccuaaaaucucuuauaugaaaauaguucugcagauuaaagucagccuguuguguauuugugugcuugacuguucuaguuauguuacuuagucuagugaguuucuugguuuuucugcagaacccauuuguacaaugggaauaaaaauaacuucuuucauuguuaagaggauuaugugaauucauauucuuaaaaccugaaaaauagugguuauauaagguuuugaggaaaguaaaguuugguuuugacagugguaucuucauugucaucugugccauuauaaacccuucuguaguuugagacacuguucuaagcauuuuuuaauacguauuuaaucccuuuagcaacccuaugagguaguuagguauaacuguuuuacaaacugcugcacagagaggcagaguaacucacccauagucacacgcgaauaaguuguacagcuaggauucagacauaaguguuguagcucuaaagucugugcuauuaaucaguaauauacugucucaacccuguuuaugcuccauccagcuacuacuuugggguuuaucugggaguagagaauggaaaaaggagaaaugaucuggagugguuucuaauaguccugaagaauagaggcaguauaauuacugaggccagugguuaaucauccucuucucacuuaguuauagaaauacuauugucucucguuucucuucuguaaaucuuacaaguucaucacaggaguuuuucuagaguaucuuaacuucccuguauuaugugacagcaucuuaaccucagacugcauauccuuuuccacuaugcuccaucugagaacacaguucagaugccucaugaucuuuccuaguuuccaccuaguguuguuucuagcauccuucuauagauguugggagucagucuauaacaaugguggcagucuuauuaagugacucuguaccucaaagaucauuuauucuuuggugaaugaauuuuccauuuuagaaaucuuagauuccauuguauauuacauuaucucuucauauuaguuacacagaccaguggaccagacuaguugaagguugucuggacauuuuauuuuauggcuuggaaauuuuagugaaauuaaugaaggaaacuuccagggauaagucagaaauaauuuguguuuagcuuuaaaauguguucauaugcuuauguuuaaauagaaguuuaguagauuucuaaauugcacaucauguuuaauuucagcauaaugaaaaaaauuuaaacaaauaugucaucaucauguauacuuuguugagagcagagauuuuuuucccccuucuuccugucuuuucacugcuacuauuacccucuuuuuuguuagagacuagcauuuuugaggcugaguuucuuuaaaaaaaaaaaaaguuucuguacugaaauucaguacauuuaauuauuauauaguaaagauacuggucuuuuucacugaagaaaaaaagucacuccaaaauauaaucaaaucuccuucuccucuucccccuccacccuccccauauaauuucaucagauggcaauacuucuuaccagcucacugcuaaugaauuagugccagcuggaaaggaagaagagcauagcuaccugagguuagcaauuuuuaacuucaacacaacuugccccuucuaaaauccagcuucuuugcagaagaaaccuacaguaagggacagaagcaucuaaaucguaucaaauuuaaaggugacaagagaucugaauuaguuacagacucaugaaaguuucccucaauauauguuucuuuuugcuaauauguugugaguguucuuuuucuagagaggaacuuuagccacuuuuuccccguauuucuaauaauaaaccuuguucuacauucaguuuauaaacuugacaaaguauguuagugaucuugauguuuuuuguucugcuugagccucugaaaacaucccgugucuaauuugauuucaguguguuuauauucuguaaauguacaugggugaccuuuuacuacugaacuuugcauauuacaugcauccauuacuucacauuauaguugcaugagcacuuauuaauaggauuggcaacaguguuauuauauaaguucuggauagugaaaacucccuuauuggccacacuuccaaggauggcaccugaauccaaagaaugguaggacugcccaaaucagagagcccugcacauuguuucugucagacuggaggcugucucaaugugugauaauauaaacgauaagcaguuuugguuuuugguggcuuuuuuuuuuuugguucuaugaaaagucuggugaaaggguacuacgucuuucaaaaaacucuucugaaaauuauuuucauccaucugucuauccauuuaaaaaguauugaauuuuguccagcucuaggcacuguuguagauacuagagaucuaacaguggaaaaaaacaacaaaacaaaaagcccugcugauagaucuuguuauucuucuaguagagggugauaaguaaaauacauuaugaguuaggugauccacucuauggagaaaaauuaagcaggguaagggaauagagaguggaauaugacuuaaaauaguggucagugucuucacugagaagaugacauauaaaaggaucucaaagaugaugagguaacaaaacauauauccaggggaagacaauucuggauuggugagauuuagcagguaugaaaauucauaagaagauaccgugaauaaauuuuagguccuauaauaauuuauaguuaguaagaaaugaugaacuuuuuuuauuagcuguaaaaaugaaaauacagucugauuuuuagguaacugaauccugggaaagucaagagcgcacccgcuuuuuucuuccaguaaauggcaccaccguguauuugaguuuauucacucuuccugcccacuaacaucaauagccagucuauauccagucuaguauauucuaccuuguaugucauuucuuuucccuccucguaauucccaaugacacuaguucaguuuaggucuugucacuuuucuccuggauuauuauuauaucuuuuuuuuuuuuuuuuuuugagacagagucucgcucugucgccugugcuggagugcaguggcgugaucuuggcucccugcaaucuccgccuucuggguucaagcgauucucaugucucaauccugaguagcugggacuacaggcaugcaccaccacaccuagcuaauuuuuguauuuuuaguagagacgggguuucacuauguuggccaggauggucuugaacuccugaccucaagugaucugccugccucggccucccaaagugcugggauuucaggcgugagccacugcacccggccuauuaugucuucuuaaugucagauucaugucuaaaccucacucacuuacccccugccaagccaaacaugcuauugcuuugcuaaacuuuuuugcaguuaccaucaucuuuuguacguuguaugagguagaaaaccuuuaauucuuuguuucuuccucuggauuguuucuucacuuuacauauuuguucagucaucaaauuuuacugauugauuagaguuuuccagugccucuggaauucauuuaacucuauuuuacucucauuggucuuuuuaggggcccucauguccuccuccuugucuauuaaaaaagcuuauucacuaacucauuucucuuccccuagucucuuucaccuacauaaugaaguuuaucauuugcauugauaacaauuuuuuuuuuuuuccaaaacgaaguccaagcucucuggccuggcauuuagaaccuacuuucuccauaucuugaacacaucgaacccacaauuccuauuuaaugccucuauuccuuuguuauuugcucuauucaguaugacuccccugcuaucuuuuuuuauguaagaaauuuaucugaguugguuuucaagcucaggucagacaucuguuguacucuauaaaccuucugcccucaacucuccuauauccgccccuguacccaauaaauaacugaucuggcaugugcauucccauaguauguuuuaaaaauuuacacuacuaauucaucaauaccuucuuacuuaaaaaaaaauccaacaaugagagaucuauaaagauaaaaaguaaaaaaaugugaacuuugcuuuuuuagauucuaaucucauuucacucuccaguuguccuguaucucuugaguaaauaaauaccuaggaauagaauugcugggucauaucacaugucuaguaauuucagauuggauguuagauacuguauuacauuauccauugucugauuuuuguccuuuuccuuuaaagaguauugaagguuguuuuggguggcagguaagcugcuuggagaucuuacugaucuuuugaggcuuuuuguaugucuuuuaggauggauuuaacuguuaagcuagcuuagcccuucugaaguccacugaauguccuaggucuuuaagaaggucucuccauucuggcuagucagaaccgaaaugucucccaguccuauaugaacuggguagccaaaaacccuaguagucauucuuugccuguauuuguggagugucacuauguauuuggauaguauucaguaagacucgggaaaccccugcagguuucuagagcuuuucucuguguggcucccacaucacuggugcucugcuucacaaauagcugcuucugcuucucugaacuuuaaucuuuuucuccucaacuuaacaaggcugccauacuaugcuugguuucucucacucuacaugauggacaaaaccuuaagagguuagauggugacuucugccagaaaaccuguuuguuuuccuucccucaugauaucaguccugugcugccugcugucucaugucugaauaugguugguugaucuauuuuguccaguucucuuguuucugggcacuaguuugguaccagguacucuauuaguagaauaauaaaaugaccaucuguguguccaucagucaguuugaacaauuuucagucuuuuuccacuggaguauauuuaagcacauccaagauaucauuauuucauuucauccaaaaauacuuuuuauuauuguaagcauuccaguaaacaaugaugaaugcaaaugaugaaauaugaggccuggaguuuuaggaaaagaaaucguucugagccuuuccagaauuaugguuggagaacuaaagccucuuagucccagaauuuacauaggacugccagaacuuucuagaucaagccuugcacauuucagaaucaucucaaauggauucauccucauuuauuguaugccugcuaucuguaaaacacuugcuauacacugcuacugaagaugcuaaugaauaauuguuuaaaguuaauggcaauauaaaauaacagauugccagguaaauaucuugaaaagucauaauagcauuucaggguaaagugauuaguugucaagggaaguuuuguagauaaggagacuugaguucuauacuugggagagaagucaggacuuagguaaguuauguugcaaggaaaaacacuauaauuaauugcauucuugaaguuucuguucccccacaccccaaaucuauuagguuauuugccacauuauucuuuucuuuagcuggcacuuaaagcauuugguaucuccugcacagaagaauuugcucaaagaaauggcuguugaauuugugaaucaguuuucuguaucaccugaucuagcccucaaagcauacuugacaugcuuuaaaagcagucuucuuuucuuuuaagacuucuguguaguuuuuaugcuacacuugguauugugguuugauuuuugguuuuuaccaauuugaugagaaauuacuccccgcucaguguccugggaaguuugacuagugguugacccaucccauagaaacauuuuauuuuuuucauggcccuuuaagggccacucauuaacaugaaugccuuaucauucauuggaauagaaaacugggaggcuuuacuuuuaguuacaaaaguuaauguauggaaaauacauuaauaaaaccggcuuagcuucauuuuuccuacuuucuugugauauuuuucuuagacuugcuauugauaccucagauaaauauccagcaguuuagagauguggaaaaaaauauggcaguuggaaucagagaggcccagguuccaguucagauucugcuuuuucccaagacuuuggaaaagccauuuucuaaaguugcuuucugugcugugugucuauaaaaugagaaaaaugagugauuagauucuuaauaaguugcaacugguauuguugucuagguugccuucugaauuauguaaauauaaugugccuccauugcauauuuaugacaauuuauaaguguuuaaaaaagaaggggauucuaguucauuaacugcgagguuuuagagugaacuagaauuugaagaaugacaaaacuuuaagagguugccaaaaaauacagguguacuuguucaaaagcaagucucagauugagucauguaucaaauguaagcaauaacagacuugacuccucuggggaacuuaggcagaguauucauuuauacaauacuugaaaauuccaaguauuaacaaagauagcuucuuuaauauagcgagaaacuccuuacaucauauccuugaauaaugucauaacaucgaugagggaaaaaaauugaucccuggccagggccacugucaauauggaauuuucauauucucccuaugucuguguaguacuguaguuuccucccacaucccaaagauguacgcuuugggugaaucagcaucugcauggccccagucugagcgagugugggguaugugugugagugcgcccuccaauggaaugacaucugguccaaggugggcuucagcuuuggccccaagcugcugggaugggccguggccaccugcaauucugaacuggaauuaguggguaaauguuuuuauucaucuuucuuaaauguauguauagcuuacauuuauuucaaugucuuuuuuuuuuuuucaaaaaacuguuuguauauugcauauauaacuaaaauauaaaagcaacauuuuauaaaacuuucuagagagacaaauuccacacaagugguaagggcaaccuagugucucuagauuuguucuguuucauaaauuggauuuuaacaaauccuauguaaaucaauuuuuguaaauaaaauguaauuguuggauuuuucacauguuagauuuuugcaauaaucugagauuuacaacacuuucugauguauguucacucugauucugaaacuaaauuauauuauuggauuucauauacaguauuaaaauuaguggugguuuaccaagauuaaacuuuaaagcauaucugaaaguuaucuaucuguaaauaagacaaauugucuacagaauuaguuuuauauagucagugauguguaaaccucuuggcuuuaagaaccacaacaacuuugaaugcauuaagaaaacugucacacaauugauccgaaacugcauuaagaaaaaaauuccuacuuuuuuuuuuuuuuuuccuuucacugguuucuugucucucagggucaucguuccaugggcuguccccacccaaccccaccaaguuuccuucauugacauuucuguucuuuccuucacaaauucugccauggcuuguagggagagcaccugauuaaccaauacugagcugggaaugaccgacacuucuuagcuaguucuauaaauuuuguuaguuuguuuuuguuagccccaguuaaucucaaauagauagaaauuuagaacauuauugaggggauuauaaugggauuaaucccuuuugccuaucccauaauguauucagcuguuucauuucuuuuuguucauuugugauuuuguguuuucaaaguaaaaaaucugaauauuuauuuagaguuuacuuuggauuaaaaauauucaauuuauuagagcuucaaaauaauaacuguagcucaaacuuuuaaguuccaucuacaaaucuuaaaaaucuauucguaaaucuagcaaauuucaacacuuuuagaggggaaucuuacaaauuaaauucucuuacguauauuaauguauauuuauaaauaugccuuauaaauauauaauaaauuauauauuuuguuucuucuuaaaauacuugaauugucuaacaagcuuuguaccauuucaugagcagguauuuuugccaaagcaugauauaugcauuguguaaacaccuucauucugcacaagugcacacuaaaaacaaagcuugugggaaaaucguuggaacagaucacuuaaaacuuccuauaacuuugaacuagaggagucacaaauaauaaucuuaauaaaaguuagaaaauaauuaaauuuuuucuuuuccauguaguuucacaaagacaacugcaaguuauaaauauuuuuuuucaaauaaguauaauuuccuacugcuucccuacucuucacauucuuuuccccaguuagcuuaccuagcuuuuaguucagauucuucucagaaucguauggucaaagucugguguuuaauuucccuucauguuucuucucaaaauuuaucaaaacuaucacuaugacuuaaguuggcuggguucuauuucauuagugcaaguaaacaauaacuuguuaucacccauuugugguaaaacugugguauagcuggcucuucuguuugagaccuauagaaaagcucugaauguuuuuuuucuuucaugaguggauguguacauagcacuccugauggagauauuuaucuuuuuuaugggcaucuauauugaauccuuuggaguauaucgauuuaaaugcaaaguguagcuuagaaauaaauguuugggcugggugagguggcucacgccugcaaucucagcacuuugggaggcccaaggcggguggaucacuugaggucgggaguucaagaccagccugaccaacauagcagaacccccgucucuacuaacaauacaaaaauuagcuggugugguaaucccggcuacucaggaggcugaagcaaauugcuugaacugggagguggacauugcaguuugccgagauugcaccacugcacuccagccugggugacagagcaagacuccauuuaaaaaaaaaaaaaaagaaaaguucaguuacauuuucucuugaaaauucagguuuuuguuuucuauccaucuuccuuaccuuguauaguuuaacuuaacuuuugcucuguauaauucguacuauaacauuaguaugaauaugguagguagugcaugucaaaucuauuaucuguucuuccaaacaauuuugcuuuuagugagaaaaccaucauaauuaaaauauugaagcugguuaguuucucaagcacaugacugggaucaaaagcaaaggaguaacuguuaacauuuaauacacucaaaaugucaaaaaacauacgugcauacaucccacuuaugcagggauccacguauuaaacaucaucaauugccuggaauagcuaagacucaggaaauaaggccuccaaggggacacucaucuuuacucauuuaagacauuuguugguuuugggcuauauacaaggcaauggugugaauuagaguugauuuuuucccagucugaagcucauaguuuauuaaggggacaaaagcuaaauucagauaauaucaaauauacuguaaaagugauguguacucuaaaggagcuacagauaaauagcuuugggaggcaguuuagaaagggaauauacuuucaguguauuauugaggaauucuuuguaaagagaguagcaucugagcugagucaugagguauauuagucuauucucacacugccauaaauaaacaccuaagacuggguaauuuauaaagaaaagagguuuaauugguucacaguuccgcaggcuauacaggaagaauggcuggggaggccucaggaaacuuacagucaugacagaaggagaaggggaagcaggcaccucuuacacggccagagcaggaagccggggagaggugcuacacacuuacacacuuuuuuuuuguuuuguuuuguuuuuguuuuuguuuuuguuuuuguuuguuuguuuguuugagacagagucucacucuguugccaggcuggagugcaguggcaccaucucggcucacugcaaccuccgccucccggguugaagcaauucuccugcuucagccuccugaguagcugggacuacaggcacacgccgccaugcccggcuaauuuuuuuuguguguguauuuuaguggagacaggcuuucacccuguugcccaggcuggucucgaacuccugagcucaggcauucugcccgacuuggccucccaaagugcuaggauuacaggcgugagccacugcaugcaacugagcuacacacuuuuaaacaaccagaucucacgauaacuuacuaucacaagaacagcaccaaaggggaaauugcccucaugauccagucaccucccaccaggccccaccuccaacguuggggauuacaauuugacauaagauuuguguagggacagagacccaaaccauguaauuccacccuuguccccugccaaaucucaugucuuucucacauuuaaaauacaaucaugccuucacaagagucccccaaagucugaacccauuccagcauuaacucaaaaguccgaagucucaucugagacaaaacuagucucuucugccuaugagccuguaaaaucaaaaacaaguuaauaacuuccaagauacaaugggaauacagacauugguuaauacucccguuccgaaagggaagaaucagccaaaagaaagggacuauaagccccgugcagaucugaaacacaguagggcagucauuaauucuuaaagcuccaaaauaaccuccuuugacuccaugucucacauagcauuaaguacauuuacaguguuuuguacaacuaucacaauuaccuaguuccagaacuuuuacaucacuccaggcagaaaccauggauucauuaagcagucauucccuguucucuucugcucucagccccuagaaccauacauuuguuucuugucugugucucucuggauuugccuauucuggauacacuauauaaauauaauacagcauguaccuuuugugucuuauuuaauugcuggauacuuuguauaaauggaaucacacacuauguaccuuuugugucuucuuaauguaauguuuucaagguuaauucguguuuuagcauguaucaguacuucguuucuuuuauggcugaauaauauuuuguuauauggauuuaccacaggguguuuauccaugaaucaggugauggccauugagguuguuuucacuuuuuggcuauuggaacaguccugcuaugacuaggaguguucauagcaguuguucauguacaauuuguauuugaacaccuguuuucaauuauuuuuggguauauaccuggaaguagaauugcuagguuacaugguaauucuauguuuaacuuuuugagaaacugccagacuguuuucccacaagccauaugugaagguucugguuucuccauauccucaucaacauuuguuauuuucuggguuuuuuuuuuuauuauauuagggucaucccaaugaaugugaaauaguaucucauuaugguuuugauguguauuucccuaaugauuaaugacauugaacauacuuucauuugcucuuuggccauuuguguaucuucucuagauaaauaucuauucaagucuucuucccacugucuuuuuuuuuuuuauuuuuuuaaagaaagcuucuugcucugucuuccaggcagugucacaaucauagcucacugcauccuugauuucuugggcucaagcaauccucucaccucagucaccagaguagcugggacuacaggcaugcaccaccacaccuggcuaauuuuuugauuuuuuugugaaguugggaucucacuacauuguucaagcuagucucaaacuccugggcucaagcaauccuccugucuuggccccccaaagugcuggaauuacaagcaugagccaccaugcccugccucucccuucuuuuuaauugguuuguuuaucuuugaguuauaagaauuauuuauauauucuggauacuacauccuuuuaagauacaugauuuucauauuuuuuuucucauugucugggcuuuucacuuucuugguaguguauuuugcacaaaaaaguuuaauuuugaugaaguccaauuuauauauauauuuuguuccuuacaguuuuuuuauaucuagaaaacaauugccaaaugcaaggccaugacaauuuacgccuauauuuucuucuauuuuuuuaagaauaguuuuagcucuuauauuuagaguuuuuauucauuuugaauuauuuuuuacuuaugaugugagauaaggauccaacuuaauucuuucguaaaugguuauucaguugucuuaguacagagaauguuguuuccccuguugagugcacuuggcaccuuugccaauaaucaauugaccauagguauacagguuuauuauuaggcucuuaauuccauuccauugaucuguaugucugcccuuguaucauuaccacacuguguugguuacuguagcuuugcaguagguuuugugaucaggaaaugugaauucuccaacuuuguucuucuuuucaagauuauuuuggcucuucgggguuccuugccuuucuguaugaauuuuaggaucagcuuucccauuucuguuuuuuuuuuuuuuuuuuuuaaaagaacauugggauuuugguagaaauugcauuuaaucuauagcuguuugggaaguauuaucguaacaauauuaaauauuccauucaugaacauaauauaccuuuccaauuucuuaguucucccuuaauuuauuuacgcauacaacucuuacucauccuugggucaguuuauucccaaguauuuuauuccuuuuugaugcuauuguaaauggaguuguuuucugaaauuuuuauugcuagcguagagaaauauauacgauuucuguguugaucauguacuacagcuuugaugaauuuauuagcucuaauaacucuucuguggauucuuuagaauuuucuauauauacuauacuauuaugacaucuuugaauaaagagagucccauuuuuuccguuucuguuggaugacuuuucuuuuucuuacuugauugcugucuagaauguccaguauuaugcugaacggaaguagugagagcagcauucuugucucaugcaugaucguagcgggaaaacuuucagucaguaaacagucauuuacuguugaguaagauguuagcugugcgcuuuaucauauauguccuuuaucauuuugaagaaguucccuuccuuuccucauuuguugaguguuuuuaucuuaaaagauuauuacuauuuuuucagaugcuuuuucugcaugaauugaaaucauucugggauuuuuccccuucauucuauuaauaugauuacauuguauuacauugauuuucauguguugaaccaccauuguauucuuaggcuaaagcccacuugguagugguggauaauccuuuuaauaugcuacuggauccaguuugcuaauauuuuguucaggauuuuuuuuacaucuauauucauaagguauauugagccaugguuuccuuuucuugcagugucuuugucugacuuugguaucaggguaauucuggccucauagaaugaauuagaaguccggggaugguggcuuaacgccuguaaucccagcauuuugggaggccaaggugggcagaucacgaggucaggagaucuagaccauccugaccaacauggugaaacugcaucuaaaauaaaaaaauuagcugggcaugguggcacaugccuguaaucccagguacucgggaggcuaaggcaggagaauugcuugaaccagggagucggagguugcggugagcugagaucgcaccacugcacuccagccuagcgacagagcaagacucugucucaaaaaaaaggaaugaauuagaaaguguucccuccucuuaccuauuuuuuuuuaauaacaucuugagaaggaugaauguucauucuuauuuaaauauuguauaggucacuaauuaagccaucuuguuuuggguucuucuuuauugggagguuuuuugauuagugacucaauuucauuacuuauuauaggucuauucauauguuuuauuuccucgagucaguugggaaauuuguguguuucuaggaauuuguccauuuaacauagguuaucuaacuuguuagcauucaguuguuuacaauauucucuuauaacccauacuauuuuuuuguaugaucaguaauaauauucccacuuucauuucagacuuauaaagucuucuuuuuccuuagguuuuucaauuguauugauguuuucaaacaaccaacuugcuuuaauugauuuuucucuguuuuucuauucucgauuucauguauagccacucuaauuuuuaucacauccauccuucugccagcucuuuuacuaguuccauaagguauaaaguuagguuacugauuugaaaucuuuuucuuaauauaggcauuuuaccuauaaauuucucucugaggacuucauucacuguaucccauaacguugcauguuuguuuucauuaguuucagagcauuuccugauuucccuuuugguucuucuuugagucauugauuguuuuacaguguauuuugaauuuccacauauuugaauuuucuaguuuuucuuuuacugauuuuuaguuauauuccauuugguuagagaagauacuuuaugugcuuucagucuuuuaaaauuuauuaagacuuuuuugugguuuaauauccauucugucuuggagaauguuccaugugcauuugagaauaauauguauucugcuguuggguggcauauucaguaugugucuuaggucuaagugguuuauauaguguuauuuaacuucucuauuuccuuauuuucuguccaguucuauccauuauugaaagugggguauugaagucuccaacauuauuacacaucuauuuuucccuucaguuuuguguucuuucuucauauauuaauauuuuguggcucugaugcuauauuugaaucucuuuauaggugugguaucuucuugcuagauugacuguuugaucauuauaaaaauccuucuuugucucuugugauaguuccuaaagucuuuuguuuuuuuguuuguuuguuuguuuguuucugauuuuaccacagccacccuacuauuugcauggaauauauuuuuccuuccuuccaccuucaacuuguuuccuuggaucuaaaguaauuuucuuguagacagcuuauaaauggacucauuugguuuauucgaauccauucugauaaugcuugccuuuuaaugaaugcauuuaauccauuuacauuaaaguacuuacugauaaagaaggauuucugccauuuugcuauuuguuuucuauuaugucuguaucuuuuuuguccuggguuccuccacugcugccuuuuuguuguuguuguuguuguuuuuauuguuguuguugguuugauuuuuuugcauuguaccauuucaacuccuuucucauuuccuuuuuuguacauguuuuaguuauuaaugguuaccuuggggauuaaauuaacaucuugcauguacaacagccuaguuugaaguaauaccaacuuagcuucaauaauaucucaaaacuauguucccguacaucucccucucucccuuuuuauguuguuguuaugacaaauuacaucuuuauacauuguguaacuguuaacauagauauauaauuacuguuuuaugcacuugucuuuugagucauauagggaaaaaaaggcagauuucugaaccaaaaauacugcuggcuuuuauauuuaccuauguaauuacuuuuaucaguguucuuuauuuucuuacauggguuugaguuauugccucuuguuuuuucaggcugaagaacuuccuuuagcauuucugguaguucaggucuacuugugacaaauucccucaacuuuuuguuuaucuggaaauucauuaauuucuuuuuuguuuuugaaggauaauuuuucuagauauuucagcacuugaaauaugucaucccacuguucucuggccuccaugguuuccuaugaaaaguuggcugucagucuuacuugggaucucuuguaugugaggagucacauacaucucuugcugcuuucaagauucucuucguuuuuuugacaguuugaacaugaugugucucugugugcaucuuuuaaaauuuauccuacuuggaguuucuuggaagaaagacucuuggcuuucucagauuuggaaaguuuguaaccaugauuucuucauauauucucuuuucucucuccuugccuuuggacuuccaucauacagacaggcguugguauuuaugauguuguucccauaagucuuuaaacugggucuauuuuuuuuucauucuuuuuuccuauuucuuggauuccauaguuaaugaaaucacucaugucgaauagucacaaacuguuaauuuguugaguuuuacaggacaaaaaucuaacaauuguuaguuacuugauuuuguacacuauauuagucagcauagcuuaaaucaucacaguagaggauuaaaaacaaaacauguaccaaguguuggcucuuaaaucuucuguucagaaaugacacaaaucacuuccccucauauuuuauaggccaaaguaaaucauguggccacaccuaauuuuaagaaggcaggaaacugcaguucugccgucuguccagauacgaaaaacauuaacauuuacaguguguguucccuucccuacuccauccccaauccauuccuuagcauucauuccauuauuucuacgugcagacagagguuacuguguuagucucuuuaacucuaauuuucaguugcuuagagccuuaaauauuagaguuugauuaucagcucccuuacuuucuuagcuuugugaucaagagcaaaguucucaauauuuguacguuucaguuuucucucugaaaaaguggagauaauuccugucucaaaagauuacaaaugauugguugagaggauguguauagaacguuuuguacacuguuucauacauaguaaaugcucuauuccuauucuccuggcauucagugcuuucauaaucuggcuucaacuuauucuucuagccucaucuucugugacucucuuccagucaucugaugcuguaccuuaucaaauuauaguugaauucuaaguaauaauauuuuuuaugagaaagucagaauuuuuuuguuacuguaauuuuuuaaaguuugcucuauuuuaguauguuuggaagacaggauggaaacuuuccugcgagauguaucucuaauuuuauaauggaagucaugaagaaauuagaauuuacuuaaauuugcuuuaaaguucuuguaauacuuuaguuguaauaaaugagaauauucauauaaagaaaaacacgguuuccaguuuuaagauagguaaugugguuucaauucuuucucuugauaaucaccaacagaaaaaaagcugaaauaaaauucccaucuuuaauuuaaacuagagguaucuccaacccuugagcuaaaaauccaaagagaaagauaaauaacuaaggaagagcaucaaacuugagcgcuuaagaaccuacaggauacugauaaaaagcaccuuguuuuaccugcaaacucagaaaggcuuagagcuuagaaggacugguacuacagaauauaggagugaggcaggggccaucaacauagagauugcuugaaaacacugaauaaggauuccuauguucccaccucacaggaaauauacugucugguuuaacaauauguauuauauuuaacagaagagugagaugcuaaaguugucauagugccucuuuacccugcuuggcuccagacuucugucuuucacgcuuugauaucccaggcagguuugagggauccuuccuggagaaauggaaccacugaagaaaaacugcucaacagguacuaguauuugaagaccucaaaaaagugcuggcuggccacuacccugcugaaguccaccaguugacagccugcagacacguagucaccuuuuuauuguuaaccucuaaaauaagaacaaaggacuaaacauuguuagccauuuuaggaaaguuuccaguguaacuuagaaacacauaccagaaaaaaggaacuuaaaguaaacagauacuugaaggaaugaaaacaguuugaggaaauaauuaacaaccuuagacagauuuuggcuaaucaaacaagguaggaugguuuaagaaaacggggggaguggaugagaaaauucucagaaugaaaaguacaauaguagaaauauauucaguaaaagcauugaaagaaacaguugaggaacuuucccuggauauagaauaaaagacaagaauaagagagaaaagagaaaauuagaguuuaauaugagguuuaauaucuaacugacuaggaguuguagaaagagagaacagggaauggagaagcuuauuauuauauuaaggaaacaaaacauguaaauuuccuagaguuuaaacuaaauacaucaguagauugaacaggucuaccaggugcucagugcaaugauaaacauucacauacuuguagaaaaauuaauuauuuugaaauuucagaacccaucggauauauaaaaagaagauccuagguacuucagaggaaaaagagcuagucugugaauaggaaugucauugaacuccacagccacacuugagaaucuaaaaggacauguccccaguguacuuaucucccagauucaaaaguugucaacaucccccucuccccaugcaugcauacuuuuuaauuauuaaagcaacuuucauauacuauaucauucaacccuaaaugcuucuguuuugucuguaacagguagacauuuuaaggaaaccaaaccacaauauuauuacccaacagaauuaauaguuuauuagugucaucaaauacucagucuguguucaguuuucccauuuuaacucagagcuguuauuuuaggaguuggucuguucaaaucaggacauacgucuuuuuuguuuguuuuccuuuuuaucuuuauuuuauauauauauauauuuuuauuauacuuuaaguucuaggguacaugugcacaaugugcagguuuguuacauauguauacaugugcuguguugguguucugcacccauuaacucgucauuuacauuagguauaucuccuaaugcuaucccucccugcugcccccaccccacaacaggaccugaugugugauggucccuuuccuguguccaaguguucucauuguucaauucccaccuaugagugagaacaugcgguguuugguuuuuuguccuugcgacaguuugcugagaaugaugguuuccagcuucaucuaugucccuacaaaggacaugaacucauccuuuuauauggcugcauaguauuccaugguguauaugugccacauuuucuuaauccagucuaucauuguugaacauuuggguugguuccaagucuuugcuauugugaguagugccgcaauaaacauacaugcgcaugugucuuuauagcagcaugauuuauauuccuuuggguauauaccuaguaaugggauugcugggucaaaugguauuucuaguucuagaucccuaaggaaucgccacacugucuuccacaauaguugaacuaguuugcagucccaccaacaauguaaaaguguuccuauuucuucacauccucuccagcaccuguuguuuccugacuuuuuaaugaucaccauucuaacuggugugagaugguaucucauugugguuuugauuugcauuucucugauggccagugaugaugagcauuuuuucaugugucuguuaaagagcuucugcgcagcaaaagaaacuaccaucagagugaagaggcaaccuacagaaugggagaacauuuuugcaaucuacucaucugacaaagggcuaauauccagcaucuacaaaggacucaaacaaauuuacaagaaaaaaacaaccccaucaaaaagugggcaaaggauaugaacagacacuucucaaaagaagacauaugucuuuuuaaguuuccacugaaaggagucuaccucuguguuguuuucugucuuaagcuuucuagcccuauuugaauuuuaacuucuguauauauauuacuuuggaaaauaaaauuuaacuuuaaaaccagauauauuaauacaucgaagacaucucaguaaaucaucacagacuguguguucagcaguuuaaaugugacuccuauaaacuaauuacuuucauguccuuuuuacaggcugucacaucagucagacauguuaguugaacacgaaccuguaugguuaaacauuagcuaguuuagucauuuagacuuagaaggaauuaaguaaguacuccaguucauaguaguagcaggauagaaugguaauaaaucaccacaaaacuuuauaagaaaaauagucuguaacaaaaaaauaagcaaaaauaaguaagaaagaaaacuaaaaaaaugagcaucaaaauauauuucccaaagccaggaacuuugaaagcuauuggacuuguuugccucuuugugcauauuuuaauaguaucgacaaauuauaggaauguacuugacuggaaagggagagaugacaucagcaggcuaauuguugccacaagugauagcugauggugagagacagauaacuguuaaauuccagcacaggcacugaagaagauacuggucuaccaugccauguggagauaaagaauacaaaacaaccuguaguccuuugaagggucgugugugacaguucaguuaaguuggcauugacccagcacucuacugcagcuauuugaugccagggauuuaaaauuuuagguauuuagcuacuuauuacuaaguaacuugugaaacaucuccuaauugcacccuugaauuucaccuuaauucugauucacacccaaagaauaggaaugaaggauaagguguggaguaaguaaagaugaagccacacgauuuggaucacugggacagauacuguauagaaugauacuuuuuuccauaguuguccaccuuagaaagggcccucaggaauuuuaaacaaaaugccuguugguucucuuuagaguuaguucacuuuuauuucaaguggguuuuuuucucagauucucugcucuucuucccacccuccuaacacaaauuacauuggucaaacauuuauuuccaauugauaaguagauaaugucugcuauaauagaauuuaagucuguuuuucauuugagaaucugaaggaugaauaccugauuuguaaguuuuauuucauuuacuuuauuugauuguauguguauuagccacagaauggaggcaaauucagcaucuuucuuuaacucuaugcuguuuguuuuagaggaaguccacaaaugaaggggacaccccauuuuaaggaagaacagugugcuccagcauuaaauuuggagaugaggaaaauacuggauuuacaagcacccaucaugagguacaguacuuugguuaaauuugacauugugugaugacaguagacaauguaguucguaaaucccaugaccaacaggaaaguuaguuuaauuucuuuuaauucaagauaacuucuuaguucuggaaaugcuugauuaacccuuauaagacaauggaaguuuuacagauggcacuuaauacuuaaauuauuauaauaaaauugaauauaccaacuauaaucuuauuuugaaauuuauauuuuauaaggucuagaauuguuugauugagugauaacaguccauauuucccaaaacaauacugaugaaagcacacaaguugaggaaaagagaaagugccuuuguuuccaaaguugccauaagcuucugggaaguuuauauacacuuggaagaaaguuacacuuuuucauccaaguaugaauaaagguuuuaugacaaaguggccagaaauaccagaauaccaaaaaucuauuuuauacccauugguagaaaaaaucuuaccuacaauuuggcuuuauuucuuuaauuguuguuccacuauugauguuuuaguugucacuuaguuuagcugcauaucuuuuccauuguguagauauaagaaaauuuauuuaaacgauacgcagcuguaaaaacauugaggacauucuuuauggaaaaaaaucuuuccaaauauguuguugggugaaaaaagcaaaaugcuuauguugcuaauguuuguuuuuaaaagggagaugagguaucuccaucuuguuuaaaagagagagcauguauuuuucuggaagaauacauaagaaacuggggaugagaacugaguagcuaugggacagguuugggggaaaagcuuuuuauuguguacucuuuuuuaauauugaacuauguaaauguauugaauuauaugaaugucaugcuacuuuuaaaaaaaucccucugacucacaguucuaaguaaagguuuauuucaccauuucucuuguuagaguacuguacagaaugauacugaaacauuaaaacuaugcaaguggcuggguauugucuugccuuguuugguccauccccuucauaucuuauucucauagaaaagaacacaauuauuauuugcuuaaauguaaucaguguuacagaagauugaguucaaaguuacucaucgccuuggucacaagguuauucaucacuucacauuuuauuuauuucagcaugggaaucguuuucaagaaaguaacuugauacauaaggaauucugagugucuguagguaccaagaaaagguggaauuguacaggcuuggcuuucuaccuccaccuggugggaaaccuuguauggugcauggaaauagaauagaaaaagagccaaaaagaaaaaaaaacaauucugccaucuuguccaaguuuaaccugucaggugcuagguuuuaaucuaugaauuuaggugguuggaaaucuguaagguuucucucaaaacuccagugaaauaacugcauuucagaacaaaguuaucagcaccugaaacacauaacugcuggaaauuugaaauuugcuauagauuuuaaaucgagugagaagacaugaaacuuagauuuuuauaaccaauuauuuucccuccugucaccacaaauauaagucagauaaggcuaggauauugguuaugcuguugcuuauagggguaagaguacuaucucaucuuuuauuuuugauuugaagaaaaaauauuaauguuaagcaucuaacuuuuguuauuaauugaggauagagaauguuuagaagguaaaaacauaauuuuaaugagaguuuccccuccccucccuuccccuccccucccauccccuucccuaccucucuccccacuccuccgacagggucucaccuugucacccaggcugaagugcaguggcacaaucacagcuaauugcagcggcaugaucacagcucacugcagccucagccuccugggcuccagugaucucaccucagccuaucaaguagcugggacuacaggcacacgucacagcacgcuaauuuuuuguacuuuauuguagagacaagguuucaccauguuguugaggcuggucucaaacuccuaagcucaagcgaucuccccuccuuggccucucaaagugcugggauugcagguguugagccaccacacccagccaagauccuaaauuuaaacauacauuuaacacacacgcacaccugggauaccacauagcucucauaaaauuaaugaagucaaugauugaagaggcucucuaaggauauaacuuagaguguauuuaccuaaauuuuuaaauguacucauuaacaguugugauauuaaaaauauuucagaaccaggcugggcacgguggcucaugccuauaaucccagcacuuugggaggccaaggggacagaagggcagaucaugaggucaggaguuugagaccagccuagccaacauagugaaacccugucucuacuaaaaauauaaaaauuagcugggugugguggcacacgccuguacucccagcuacucaggaggcugaggcacaauaauugcuugaacccgggaggcagagguugcagugagcugagauugugccacugcacuccagccagggcaacagagacugugucucaaaagaaacaaaaauuuaagaaccaauacagcaugaaaagacauggguuauuaguuaucgaacaggguucugacaucgcccuacuacgccaauaaugaauccuucaguuggccagauuuuucugagggaggggagucaguuguagcaaacacuuaggugacuuggggcaaggucuauuuaccaacauuuauagaauuauuaguauuuuaacaacugacaccagcuuuuuuauuucuaaauuuuuuuagaggugguagucucacugugcugcucaguuggucucgagcuccugggcucaagcauuccuccugccucagccuccuaguagcugggauuauaggcacaagccaccacgccuggcucagccuuuguuuuaacaaguuuguccacuuucaauuaaaugagaaggauauaucuaucucuuccuguagauuauuuauuaugucugucacaguuuuuaaaaagccuaucugcuaauuccaauaucaagauuaucuauaagucuauuuauauugauggauuuuucucuugacucuagguuacauuuuccuguuuauucacacaucuggccagucauuuguuuguugcagcaucacugauuaucauguuauagagauuaugaacucuuaauuuugucagacgauuguugaguuuugucuagcagguagucagauuacuggaggauaacucuguuguauacagugauuuucuagggagauaggguuaggggagagggagaauguaguuuggaauaaacgaugcugacuccuuccaaggaaaaucacugguaaaccagugacuacucugcuaaauugccucucuugacauugucaacuugaaguaaucaaaaggaucagauucuggaauuaaugcaagcagaaagcugaccaauccgggagaacagacuucagaaaauggggucaguguuccaaaguuaaaaguucaguucuugcaggccaggcacaguagcucacaccuauaaucccagcacacugggaggccgaggcggguggaucaccugaggucaggaguucaaaaccagccuggccaacauggugaaaccuugucucuaccacaaacagaaaaauuagcugggcgugguggcgcaugccugucaucgcagcuacucaggaggcugaggcaggagaaucccgggaggcggagguuucagugagcugagaucgcgccacugcacucuagccugggcagcagaguaagagacuguuuaaaaauaaaaaaaaaaaaaguucagccaggcgcaguggcucacgccuguaaucccagcacuuuggaggccaaggugggucgaucaccugaggucaggaguucaagacgagccuggccaacacggcgaaaccuugucucuacuaaaaauacaaaaauuagcugggcaugguggcgugcgccuguaaucccagcuacuagggaggcugaggcaggagaaucacuugaaccugggaggcagagguugcagugagcugagaugguaccacugcacuccagcuugggcaacagagcaagacuccgucucaaaaaaaaaaaaaaaaaaaaaaaaaaaguucaguucuugcuuauauagguggaaaauaaaguuuaguaggauuauaauguuuucuauacaaggcugguuuaugaguuacaauuuaguuacaguuuguuuucuuuauggcuugucuuuacagcuaguuuucauuuccaauuuaaaaagaguguauuuaacauuccauuuuaagacaaugugauagccaugaagucuuuguguaagaaagauaagagggaaguuaaucuaccaugaagaucaacagugaagagggaaggggucuucccuggagcccuuuagucauuuacagcauuuauaaaacaauacaguaaggaagaaagcuaaucuauaaucagagaaagaaagaugacagcugccuagauuauagcugccuauugugugacucaggccccauaauuacauuucuuuaaggcucaaaaguaauucagauuuccaacagcuuagauuuugaauuacauauuuucauagcauauaguagugcaucuaaaacauaaacuuuuuauacucuacccaccaaaugauacacauagauuuuaucacugaaauauaaauuugaaauuaauauauaaugcuuuaaaaagugaaaugucuaaaaacugggaauuuuaauugauuacaaauggcugugaaguucaagaaauagagcuggguaaagaaacaucuguuucugaucuuuuucaguauuuuuauaguuggggaaaaaacagcaaauucuacauuagcugaaaucuuuggaguaugaguaauugaagucaacuuuccaaagaauuaaagguuuaguuuaagaauuaaaauacuaaaagacauuuuuuucaucauuauggauuaaaauauuucagaaauaugcucuuaaguaugaaaaggaauuuaauaguauuuaauaggguauauauaauauacacauaacauuuuuuguuuuuccuuauauaguauuugauacuuugaacacucuuucuuaaauucaucuuacuuccuuggcuuucuugauaucaguuucuacugguuucccugguugucuuuuucuuugugccaguaccuuugcggucucauuuauggguuccucuuuccucuaacccuuucccucuucuugccuccuuugcacaaauauuuagugacagauuuaacuaacacugcccuuggggcugugcauacagaggugagcaaaacaggcuauuuccccauuaaagaaguaaaugcugaauaucuucauaaauauugauaagugaugagaucaugcuauguaacuauuuuugauuucuugccugagaaguccucugaagacggagaauauuuuauucauccucgaauauccagcacacaguauagcaccugucacagaggauaggcucaguaaauguuuguagaaggaaugaacaaugugagacuugcuaauaccuaagaaauauauuggccuggaacuauacuccaauacaguagccacuagucacacaugaauuuauuuaaauuuacauuaaugaaaaguaaauaaaauuucaguuauuuuauugcacuagccauauuucaaguguauagucaccacauacagcucauagcuacuguuuacagauagcacagauauagaacauuuccaucauuauucaaaguuuuauuggacaagugccagagcauuguuaccucuacacuuaauggcucuagauugucauacuguuauuaguuggguuuauucauuuuaugguuucucuaccucuuuuucuuucuuucugcuaucacuucuguuuccaucuucuaauuugcuguuucaauauuuguaguuuuuaacuaguuuuaucaguuaucaaguuugugacugugagugcccauagucuuucauuucuuucaggauuucugauucuagauugaaauauacauagauaaaguugcagauaaauggagauguuuuguaaaugguuucaugaucauuuuugcaugaguauucucuaaagcaguuuuaauauucauacacauugcuuucccaguaugcucucuuaaaaauuaauugauucuaccuacaguuugcagucuguguuggaagaucuccugguugcuacuucugauggacuucuucaucuuauucacugggaaggaaugacaaauggaaggaaagccauuaaucuuugcacaguacccuuuucaguagaccugcagucaucuagagguagcuauacuuucuacaugagguugaaccaguuguuuaauguuugaugucuaguuagguaucuucuauggaugaacacuucuuuggaauuacuuaugcaaggggagaggugggcagaguaugagaggcggggugagagaggcauuuaauaggaaaggacaguuuaauuauuuaggguuguuaggucauuauuuuuacccuuuuaaacuuacagguuuuucuggcaaaaagugagagaguaauuuauuauauucuuaauccuauuucaugugcuuauuuuuuucaucaguagguucauuccugggcuucacagacguacacaucagagacauggaauacugugccacacuugauggguuugcuguuguauuuaaugaugguaaaguuggauuuauuacaccagugucaaguagauuuacugcagagguaugacuuauuuacuuugaaggguuuuuuguuauuguguacuuauuuuauucuuuguuaucaaauucuucucuauuuucaucauucauguaagauuuuaaggguuguuaauuuuuuaaucaaaccaaacauauaaauaguauaaguagacaaaauucucuuggacauguuaaagaaaaauaaugauuccuguucuccucccugcucuccucaugccuaauuuuccacuuuuggaggcaacuacuuguuauuccuuuacugguuauuuugauuuuuaaucuccacuacucugaauauuuccuuuaauuuuuaguucuuaggcuguguuuauugacuucuuacuguugaaagugaccauuuacuucccucuucccugcuuccaccauacuuauauucuucucauguucccauuauaguuauugugauuuugauuagguuacuauuaauuguuuauauuuuuaucaauauguaagccccauuaguaccgaaaccaugugguacugacgcagaaguuuuugcuccuuaguuuagcuaaaagcagguucuugucacacagccaggaaagauuaggcaugcagacauacugaaaggugaggagagcagaauuuauuaaaagcaagcucucagcaaauaaagaugauguccugcuaacaggcucccacuucacagauugauuaccaaaccccagcacacacgcgcgugcacacacacacgcugaagagccccaggguccuacccgcugaacaaggcgugaacuuaaccccauucuccuagugcgcuugugggcauuauucagaaagaaucacucaggaaacggcaaacgggcaguuauuuaucccucuggaucaccaguuucaucugggacaaggagucccaucuuucagccuucaggcacuuuuugggcuugaaaguggguuuucacuggggacccuuggccaacuccugucucugucaguauaauuauuuuuccuuuacugcagauuuuuccuccugcuaggaauuaaugauugccuuguucuuuacauuugcuuaauuuuuguguacuuaucucuuacucaacccaaacugucaguuguguaaauauccucccagcuuuuucaaacauauuagcuguucuguucauuucaucuuuuuuguuuucuuuuuuuuuuuuuugagauggaauuuugcucuuguuguccagacuggagugcaguggcacgaucucggcucaccacaaccuccgccucucggguucaagcgauucuccugcuucagccucccgaguugcugggauuacaggcaugcaccaccacgcccgccuaauuuugugucuuuaguagagacgggguuucucccuguuggucaggcuggucuugaccuaccaaccucaggugauccacccaccucagccucccaaugugcugggauuacaggcgucagccauggugcccagcccauuucaucuucuucuucuuuuuuuuuuuuuuuccacaguaccacaaaacaauuuaauggaggaagagauuuuuuuuuuuuuuuuuuuaccccgaggaacuauaucacuuaaggauggcuuacagaaggaaugagcuugcaaaaacuauaagagagagagaguguguguguguguguguguguguguguguguguaccuaugcaguguaugugugggucuauagguauguaucacacguccacaugcauguucauagccuccaugcacauguaaauauuucuucacauaaacuuuucugacuuuaauacuagaaagaacuuacacugguuuucugaagcccacugugauaucagagaucccuuucuaaaucuaucuuuuuauuuacuuuuuuaaguucuaggguacaugugcacagcgugcagguuuguuacauauguacacaugugccauguugguguucugcacccauuaacucgucauuuacauuagguauaucuccuaaugcuaucccucccccccucgccccaccccacgacaggcccuggugugugauguuccccaccuuguguccaaguguucucauuguucaauucccaccuaugaaucagaacauacgguguuugguuuuuuguccuugcaauaguuugcucagaaugaugguuuccaacuucacccaugugccuacaaaggacaugaacucauccuuuuuuauggcugcauaguauuccaugguguauaugugccacauuuucuuaauccagucugucauugauggacacugggcuugguaccaagucuuugcuauuugaauagugccacaauaaacauacaugugcgugugucuuuauagcagcaugauuuauaauccuuuggguauauacccaguaaugggauggcuggaucaaaugauauuucuaguuuuagauccuugaagaaucgccacacugucuuccacaaugguugaacuaguuuacagucccaccaacaguguaaaaguauuccuauuucuccacauccucuccaggaccuauuguuuccuaaguuuuuaaugaucaccauuuuaacuggugugagaugguaucucauugugguuuugauuugcauuucuuugauggccagugauaaugagcauuuuuucaugugucuguuggcugcauaaaugucuucuuuugagaagugucuguucauagccuucgcccacuuuuugauggggugguuugauuuuuuucuuguaaauuuguuuaaguucuuuguaguuucuggauauuagcccuuugucagauggguagaugguaaaaauuuuuucccauucuguagguugccuguucacucugaugguaguuucuuuugcugugcagaagcucuuuaguugaauuagaucccauuugucaauuuuggcuuuuguugccauugcuuuugguguuuuagucaugaaguccuugcccaugccuauggccugaaugguauugucuagguuuucuucuaggguuuuuaugguuuuagguccaacauuuaagucuuuaauccaucuugaauuaauuuuuguauaagguguaaggaaaggauccaguuucagcuuucuacauauggcuagcccguuuuaccagcaccauuuauuaaauagagaauccuuuccccguuucuuguuuuugucagguuugucaaagaucagaugguuguagaugugugguauuauuucugagggcucuguucuguuccauuggucuagaucucuguuuugguaccaguaccaugcuguuuugguuacuguagccuuguaguauaguuugaagucagguagcgugaugccuccagcuuuguucuuuuggcuuaggauugucuucgcaaugcaggcuguuuuuugguuccauaugaacuuuaaaguaguuuuuuccaacucugugaagaaagucauugguaacuugauggggauggcauugaaucuauaaaugaccuugggcaguauggccauuuucacaauauugauucuuccuauccaugagcauggaaaguucuuucauuuguuuguguccucuuuuauuucguugagcagugguuuguaguucuccuugaagagguccuucacaucccuuguaaguuggauuccuagguauuuuauucucuuugaagcaauugugaaugggaguucacucaugauuugguucuguguuugucuguuauugguguauaggaaugcuugugauuuuugcacauucauuuuguauccugagacuuugcugaaguugccuaucagcuuaaggagauuuugcgcugagacuauggaguuuucuagauauacaaucaugucaucugcaaacagggacaauuugacuuccucuuuuccuaauugaauacccuuuauuucuuucuucugccugauugcucuggccagaacuuccaacacuguguugaauaggaguggugagagaggacaucccugucuugugccaguuuucaaagggaaugcuuccaguuuuugcccauucaguaugauauuuguggguuugucauaaguagcucuuauuauuuugagauacgucccaucaauaccuaguuuauugagacuuuuuagcaggaaggacuguugaauuuugucaaaggccuuuucugcaucuauugagauaaucaugugguuuuugucuuugguucuguuuauaugcuguauuaccguuauugauuuucguaucuugaaccagccuugcaucccagggaugaagccaacuugauagugguggauaagcuuuuugaugugcugcuggauucgguuugccaguauuuuauugaggauuuuugcaucauuguucauaagggauauuggucuaauauucucuuuuuuuguugugucucugccaggcuuugauaucaggaugaugcaggccucauaaaaugaguuagggaggguucccucuuuuucuauugauuggaauaguuucagaaggaaugguaccaguuccucuuuguaccucugauagaauuuggcugugaaucugucucguccuggacuuuuuuugguuaguaggcuauuaauuauugccucaauuucagagccuguuauuggucuauucagggauucagcuucuuccugguuuagucuugggaggguguauuuguccaggaauuuauccauuucuucuagaguuucuaguuuauuugcuuagagguguuuauaguauucucugaugguaguuuguauuucugugggaucgguggugauauccccuuuaucauuuuuuauugcgucuacuugauucuucucucuuuacuucuucauuagucuugcuaguggucuaucaauuucgucagucuuuucaaaaaaccagcuccugcauucauugauuuuuuugaugguuuuuuuaugucucuaucuccuucaguucugcucugaucuuaguuauuucuuaccuucugcuagcuuuugaaugugucugcuccugcuucucuaguucuuuuaauugugauguuagggugucaauuuuagaucuuucgugcuuucuguugugggcauuuaauccuauaaauuucccucuacacacugcuuuaaauaugucccagagauucugguauguugugucuuuguucucguugguuucaaagaacaucuuuauuucugccuucauuucguuauguacccaguagucauucaggagcagguuguucaguuucauguaguugagugguuuugagugaguuucuuaauccugaguucuaguuugauugcacuguggucugagagacaguugguuauaauuucugguuuuuuacauuugcugagggguacuuccaacuauguggucaauuuuggaauaagugugauguggugcugagaagaauguauauucuguugauuugggguggagaguucuguagaugucuauuaggaccacuuggugcagagcugaguucaauuccuggauacccuuguuaacuuucugucucuuugaucugucuaauguuuacggugggguguuaaagucucccauuauuauugugugggagucuaagucucuuuguaggucucuaaggacuugcuuuaugaaucugggugcuccuguauugggugcauauauauuuaggauaguuagcucuucuuguugaauugaucccuuuagcauuaugcaauggccuucuuugucucuauugaucuuuguugguuuaaagucuguuuuaucagauacuaggauugcaaccccugcuuuuuuuuguuuuccauuugcuugguugaucuuccuccaucccuuuauuuugagccuaugugugucucugcacguaagguaggucuccagaauacagcacaaugaugggucuugacacuuuauccaauuugccagucugugucuuuuaaucggagcauuuaguccauuuacauuuaagguuacuauuguuaugugugaauuugauccugucauuaugauguuagcugguuauuuugcacauuaguugaugcaguuucuuccuagcaucgauggucuuuacaauuuggcauguuuuugcaguggcugguaccaguuguuccuuuccauauuuagugcuuccuucaggagcucuuguaaggcaggcuugguggugacaaaaucucucagcauuugcuugucuguaaaggauuuuauuucuccuucacuuacgaagcuuaguuuggcuggauaugaaauucuggguugaaaauucuuuucuauaagaauguugaauauuggcccccacuaucuucuggcuuguagaguuucugcuuagagaucugcuguuagucugauaggcuucccuuuguggguaacccgaccuuucucucuggcugcccuuaacauuuuuuccuucauuucaacuuuggugagucugacaauuaugugucuuggaguugcucuucucgaggaguaucuuuguggcguucccuguauuuccugaauuugaauguuggucugccuugcuagguuggggaaguucuccuggauaacauccugcagaguguuuuccaacuugguuccauucuccccgucacuuucagguacagcagucagacguagauuucaucuuuucacacagucccauuuuucugggaggcuuuguucauuucuuuuuacucuuuuuuucucuaaacuucucuucucacuucauuucauucauuugaucuucaaucauucgaucaaaucggcuacugaagcuugugcaggcaucacauaguucucgugcgaugguuuucagcuccaucacgucauuuuagguccuugcuacgcuguuuauucuaguuagccauuugucuaaucuuuuuucaagauuuuuugcuucuuugcaauggguucgagcauccuucuuuagcuuggagaaguuuguuauuacugaucgucugaagccuucuucucucaacucaucaaagucauucuccaucgagcuuuguuccauugcuggcaaggagcugcguuccuuuggaggugaagaggugcucugauuuuuagaauuuuagcuuuucugcucugguuucuccccaucuuugguuuuaucugccuuuagucuuugaugaugcugacauacauaugggguuuugguguggauguccuuucuguuuguuaguuuuccuucuaacagucaggacccucagcuguaggucuguuggaguuugcuggagguccacuccagacccuguuugccuggguaucacuagcggaggcugcagaacagcacauauugcagaacggcaaauguugcugccugauccuucuucuggaagguucaucuuagaggggcacccagcuggauugaggugucaguuggccccuaaugggaggugucucccaguuaggcuacuuaugggucagggacccacuugaggaggcagucugucuguucucagaccucagacuccgugcugggcaaaccacuacucucuucaaagcuguuagacagggacauuuacgucugcagaacugucugcugccuuuuguucagcuauacccugcccccagagguggagucuacagaggcaggcaggccuccuugagcugcggugggcuccacccacuuggagcuucccugccacuuuguuuaccuauucaagccuuagcaaugguagacaccccucccccagcuucgcugccaucuugcaguucaaucugaguugcugugcuagcagugagcaaggcuccaugggcaugggacccuccaagccaggcgcaggauauaaucuccuggugugcuguuugcuaagaccauuggaaaagcgcaguauuagggugggagugucccgauuuuccauguaccaucugucauggcuuccuuuggcuaugaaaaggaauuccccgaccccuugcacuucccgggugaggugaugcccuguccuccuugggcucacacuccaugggcugcacccacugucugacaagcccuagugagaugaaccugguacuucaguuggaaaugcagaaaucacccauccucugcaucacucaugcugggagcuguacacuggagcuguuccuauuuggccaucuuggaaccucccauuucaucuucuuaaagaaauuucucugggagccuucuggccugcuccaaauuagacugcuugcuuacuauaaucuuuaacacagcuguuuuuuggccuucugucauaauuauccugagauucccuuuacucuuauuugugucggaucuuuuaauagcuaauagcuaauuaauauauggauuuggcugcugugacagagaccuaaaauuaaaauaauuuauugaaaacugugaauuuugguucguuugguuuacuauguccuuuaccauaggaugagcugacugaguuauuuacuuggggguccuccuaccuuuagagccauacccuucccucugucccucccuucugcuccccucuccccucucugucuccaguguuccuuggaaaagaguccugcaguccuuucuagaggauauauacuuggcuaccccaguauucugggauuugaguuacagaagaguuaagcuagcggguccaaauucaagaugugaaccuuuauuuucuaucccuguuuucagugugguccauaggccucugguggaggugguagggguggggguguuuuguuuuguuuuucuccaaagaaaaauauccaguuuuccguaggaguggagguaggguauuuauuggcugcucagcuuuggggaagugcucugggaggaccugguugcuucuuuaaguagguuuugaaccacuucuacuacauuuaauuuagccuuucaaagaccccugaauucccaagccuuucguguacccuacaacuuaaauuuagacguuucucagcauucuucccugucaguuaaggauucuacucauugauaugcuuuccagcuucuaaaauuuucuaaugccgccuccuauuauuuuugucuuugcugcuuuauguuuuuuuaaacaaaaacucuuuucucuucuagaaguuacaguuuuaggaguccaagaagcuaaauauuuauauucagucaucucucuuuaacuggaaaggaauuuaaguuuuuaauggccuuuuuuaauuguugucauucuguuugguaucaacuuuaauauuccuaucuacuaucuuccguuaucaacuuuauucagauaguaagguacuaaauaauguauuugugaucaccugugucagaacauaaauaagaauaaaaauaaacuuuugaugaauuagaaaaaacucuuuuuuuuuuccuauaaggugcauauauauuuguaauuaucuuugggacuuaaauguuuagacuggaaauaaaaauauuagagcugaaaaagugauugacucuuuuccaaguacuuuagaguuaguacaaaauauauucucaguguuuauuaguauguaauuaaauaauuuuuucuaauaaguuaaggauuuaaaaacuaaugaaaagcagaugggcauuacuaaauaagguauagauagaaaauacaaauuacaagaaaacaguaccuauguauuaaugguaauagggaaauaacuaaaugacauuuaacagauguguuaaaaugugauuaugucaguccucuguggagacucauucaguaggacuagauuauuaggacagaaccuccugaggacuaaaagagcuggagaaaaaauauauuuuuuaauaugcuugaagcccuuagagagcaaacaagacaguaaagaguugccagacuaagggaggccagcaauccagugagcuaagcccaauauuuaagccuacaaugaacaugaacaaauuaggcuauaugcaacaacacagauagaucuuacagacaugguaagcaaaaaacagcuagacacaaaggaauacaugcuaugauuccauuuuagguaaaaauuaaagggcaaauaauguaggcauuucuaaauuagaguauauaugggugcauguuuaagugguaaugauuuaaaagaaagaaggaggugauuaccauguaaaucuggauauuuuuuguuguaggggugugaggauacagugauugggaagggcacuauugggagacuuuuggguacucaugauucuuggccugaguagcaauuccacaaguguuugcuuugugauauugagauguacauuucauuuucauguauucuuuauuauaauucaugacagaaaaguuuaaaaaauuugaauauucuucuucuauauaacuugaagaaaaagccaaaauucuuaugguggccuucaaagcccuaauuaucugaccuccuguuacaucucuuaccacauauacuacuuuccuuucacaacccauccacuucacucuauccacacaggcuucuuugcuggucuuugagcaugccagaaaugcuccuacauuagggcuuuuacacuuguuuuauuucuuugaggacuuuccucaaaaggcauccuuauagggaaaccuguuuaauauuacauccuuccccuguacucccucuucaccagcauugcuuaauuuuuuuuguauaguauuuuuuaaccuccaguauucaauauacuuuuuuaacuugucugucucuugacucaaauguaaagcaagcauacaaguagagauuuuggugugcuaguauagccucagcaccuagagcagugccuggugaaugguaaccaccuagaaaauacuuauuguaggacugaauuucagucuaagcagcaguucagagaaauaaugcucacugcugucuuuaccauuugugacauaaaauguccaguuuuauuauuaaaauuaaaagauacaauuccuacuaaagcaaagauuccguguuuagauaguagauuauauagcugauuguggaauuaaaugaaaucuguaggauucuaguucauauaguugugauuauauuguaucuuuaauguuuacuauuaggaucauccaaaaauaaagugcuauauuauagugugccacuuuuucugcuaacugaacuaaugauuaugaccuuugccuuggaauuuaucaucuaaaaugucugugauuugacagauaggagcaaacaacugagcugaaucuauucucuauauauggagauggcauauggaaauagcauauaugcuuacuaauaaugucauuuauuuauugaaugcuuguugaaugguaggcauuguccuaaauaguuuacauguguaucuucauuuaaucuuugaaacacccugagagguaaauacgauaagaaaacugaagcuuaaaaaagaucaaauacuuauuuugaggagugaaagcaguccugagcugucaggcuuccagauaccaugcuauuaaccauuacacuauaaagaagggaauuguagagaauaguaagcaauuuugcuucuaaagaauaaaccaaacagaauguacuacuuuucacugacugagaaguuaaauacuaugugcuaggugaugagaauaauuacagugagcaaguuagaugcuguuuccgcugucaaaauguuuacauucuaacaagaaagucaucuuuauuugaauuuggagaugaauuuccauauuuuaguguuuuuuaaauaaauuaacuagcacuggacugagcugaguauuuaucagaccaauucaugagaaguuugagguuuuaagggagacuauuugguaguauuuuaagggagacuauugugguaguccuggugggauauuuuccucugcagaugaaaccaaauaaagcauuaugaaauuguauguuuauugaaggagaauuauauugacuacgguaaauuuggagaaacacuuuuuaagccuuaacuauuuuucuuuauuauagcagcuucauggaguuuggccacaagauguuguugacggaacguguguagcaguaaauaacaaguaucgacuaauggcauuuggcugugugagguauaauugauguaggcuuuugcauuuuuaagaguuguugcaaaaaauacugguuuuuuuuuuuguaaacauaagauguuccuaacauacuuauaaacugcaucaugcuaucauaauuuaucagucaaccuuaauaugaaauguaaaaguauuuuauuagauugaaacaaacaaaaguaaagggcagauuuuggagguugagcauguuaauuuguaaaaguuagcguuuucuucagugguggaaaauugaguuacaaguuaaacagaauaaaucaguuaaaguuuagguucuuuauuguuuaaaagaggauuuggaagauuuuuuuaaaucuuaauuuuuaagacaucagcauucaugacgccuucaaauuagugagugugcuuuaguuaacaagcaaauuuaaagugcacauauaaaaccaguuucuugccuuaguuuauuaaauagagauuuuagaaaaaaauugaauaaaauuauuuauucaacaaguaucuguaugccuaucacauaccagccauaguucuaagcacuugauacauuagaaaacaaagauacugaacuugguugagcuuaaauuuuagcucauaaauuuuagcuaaaauaaaacgauuauauuaguuguuauaaugccuugcaauguauauagugcuuuuuaguuuucuaaacucuuucuuaaauaaaaaauccuauguugcccucaaaaugagacuugguuguucuauagaacauauaucuaguauagucuccagccauaucaucaccacccaauuuaaguaucaaagauuuuuuuuuuuuuuuuuugagauggagucucgcucuguugcccaggcuggagugcaguggagcgaucucagcucacugcaagcuccgucuccuggguucacgccauucuccugccucagccucccgaguagcugggacugcaggcgcccaccaccaugcccagcuaauuuuuuuuguauuuuuuuaguagagcaggcauuucaccguguuuggccaggauggucuugaucuccugaccuugugauccgccuuggccucccacagugcuggauuacaggcgugagccaccgugcccggccagauuuuuuuauuaguauaaauaauucacauaaaucacuuucauuacacucuuaauaaacucuuuguaaaguagggaauccucauccucaacuuuuucucaauacauugauccucauugagcaguuaaauguagaaauacgaguaaguuuaacuuaguacaagagagaaggaaaagcuuuuuuuuaauguuuguggauuggauucagucauauuuuguuuagaauuuuaaaauguauguucaugaauacauuucaccuauaauuuuccucuuuacucuucugaguaagguuauggcugucucauaaagcaaguuaugagaaucccucccuucuuugucuucucuauucaucuuugaauguuugguagaauuugccaaugagaagccaucuagaccuagaauuuucuuauuguggauuuuuuuggacuacugauucaauucaguuuuuaaaaauauacauauauauaauguauauauuuuagauauauauauuuaaauauuauaaauauauauaauauauauuuuaaauauauauauauauuuauuuuauuuuauuuuauuuuuugagacagucucgcucugucgcccuggcuagagugcaagagcgugaucuuggcucaccgcaaccucugccuccuggguucaagugauucuccugucuuagcauccugaguagcucggauugcaggcaugcaccaccaugcccggcuaauuuuuguauuuuuaguagaacggaguuucacuguguuggucagucuggucucaaacuccugaccucgugauccauccaccucggccucccaaagugcugugauuacaggugugagccacugggcccggcccaguuuuaaaaauagauuuaagaagauucagauuuuguaucucuuccuaugucauuuuggcaaguugcauuuuuuccaggaauugguuucuuucuuauacaccuucaaacuuacuggcauaaaguuuauaauacccuuuuuauuucacauugugaaacaaaaauaugcauacaaaguaguacauaauccagauauucauaguuuuaacguuguaguagaaacacccaucucuucacaacuggaucaguaaauagaacauuacuggucuccagucacaaacugccucugcuacuuccuagucacaacucuuauucccuccuugacucacuuaguaacuggucaacauugugagauucauccaugucauuuaccaguaguuguaaucauuuuuuaaauugguuuauaaauaacguuccauugucugaauauagcauaauuuauccacuuugcuguugacauacuuuugccuuauuucuugguuucuaaaaaaggagacauucucuuguauaauuggaauaucuuuaucacaugagauaauuaaugauaaaucccuaauaggaucuaauacccaauuuauaugcaaauuaacccaguugccaccagcuaaauuucuucuauagcuccuuuguuccaaacagaaucgaucaagauucauuaauaauauuugguuauuauuucucuuuaguuaccuuuuaacuacaauaguccuuaugccacuuauuuucaugacauugacuuuuuuugagucugagucgauucuuuauagaauauccugcauccuagauuugccuuauuguuuccucaugauggcauuuaccuuguuuaucugacaccugucgugacuaaccuggaagcuaguucuuguugagcaauacagucaagugacuagaaagcccacacaucaggcauggaaaaguauuuagagaaaauacacagagacagaagcaguggcaagugugcaguuccauuuacugcauuuggggccagcacaaggguggguguuagaauccagaagaaguacuccucccuaggcuaugggcuuauaagcuacaugauugggaaguacuagcccuucccaggauaauguagguagacucuuggccuauagcuuuucagucaccucaguuuucaucagcuacgagacuacaaguucucuucuagcaugcccauggguuaggguuaaaguuuugugauucuagcuguugacauaacaaaccagugucugcuaguccagaucugccaacacuuaucaggacuaauuaccuugaacacuaggugauagcugguguccuuagaguuguguaagaagccagcuuccuuuuaggaugccaguuugcagcagaucaguauuuuaacaaccuuccuguuaaccuaaauauuuaaagguauuacuagauucugguuacacauuuugucaugggugaugauauauauuuccuaugguaucauuuaguaauaaugucaaguuguuucaguauuaaugacacuaaauuugaucacuuauggugauaauagucauaucucucuuauagagauuugcuuuggaguuaguaaguccugucuuuuuaaugaaaauauauuuuucuguuacauugggcuggugagaaauggaaggaaaaguaguuuaaagaauacaagcacuauagaauaccuaaaagauugucagacuuuuauaaguaguaacuuagcaccuacuucuuauauuuaaaacauggacuccucacuaacauuuuagagcucagcaacccaggguuagcaguugacaguugucagaugcaaagcaaaaacaaacaccugcuacccacuuagugcugucucucagcaagaguugaucuauuugggcagguagucuggaaagaaaucuuuuucagauauuuggcuucuggguaugauugaaugacagaugacauuuucccucccaccugauacagccaagaaaacggacaaaaauaugaaagagcuguuuugaauucagaacacaaacauaagguaacaagggacagugauuucugaaagaugagaaacaaaauuaucucucuguaacugcccuuaguuuuuauuauuuugaguguuuguaggcugcagcacaggauuggggagauacauccugagcugagauaagcacauggaaaucagagaaucugggaaaaccaaggcagcuagaguucauaauauagacaccaaagagguggcacaaagagagaacuucagagagcuguagagggucucucuugaauauuaaacugagacauggaagauauuagaaaaagacugaaauuaaacuucuagaggugaaaacuaugaugucugagaugaaaaacauacuguauggaacuaacaacagauuagacauugcagaagagaagauuaaugaacuugaaaaacagaaauuauccaaaauggaacacagaaaaaaaagaaaacaaaaacagaguaucaguaagcugugggacaacuuuaaggaggcuacuauugcaggucuuuuaguuagucccaguucuaauccuugagaagagguaggaccuggaugggaauggaucaaagcugcugugaagaaaccaucugauuucuccuaccaccaaaaaaaaaaaaaacaaucugguagucauaaaccagugucauccuauuaugugcaaaagcauucuuauauuaaaaagugucuuuaagaacauuuguuucucuuucucacuauaaauguugcauaaguaaucuaaaacaggagccucauuuucaaaugcugaaugugcauuaaauuuuugaacugagaauauaccaugagcagaaaugagacuuuucuguuauccucguaguucaauuuugaaauguggcuuagacguauuauagagauuuuacuucuggcuucaggcccuucagaaauuugacccuuguaaagauguuuuaaauuaaguaauuauauauaccauauacacaaaaaagcauauagauuuuaaaaauaaaauguuuauaaauuaccauccaacauaagaaauaauacaucaccagugcugaugaagccuccuguuuaccccucuucuuugauacucccuucuccaccagaguaucacuaaucugaaauuuguauacauuaacucuuuguuguauuuuuaccacaaauauauuuacuauuaauacuguauaucuacuauauauauaucaaauauguauguuuauauuuacuaugcuuuuacacacacacauguuuuauaucuuaaacguauauacuguugaccguugaacagcccagggguuagagguaccaaccccccaacacaguugaaaaauuuacauauaacuuuugacucgcccaagacuuuuaacuacuaauagcauacuguugacuggaaaccuuacugacaauauagucaauuaacacauacuuuuuauuuuauauauauuaauauuauauauuguauucuuacaauaaaguaagagaaaagauuauuaagaaaauuauaaggaagaaauaauguacuuacuauugauuaaguggaaguggaucaucuuaaaggucuucauugucaccguguucauguugaguaggcuugaggaagaggcaaaggagguaugucagguguggcagaggcagaagaaaauacauguauaagugggcccaugcaguucagauccauguuguucaaggguuaacuguauucgcuauccauguggcuaaaguucauucauuuucagugcuguaagguauaguauuauauugcuauaccauauguacuauagccaaauaaaaguucauuuuuuuccucauguugcuagauaggcuauuuccuuuuuuaaaaauuaucacaauaguacaauggacauuguacauaucucuaguaaacauuagacaauaauuucugggauauaucuggaagugaaauugcuagauuagaauaugccuuuguucaaauuuaugagaugacugcaacuuauugacaaagugguuuuguucuaguuuacacucccaccagcaaaacauaagaguucuauaaugcuuuuucuauuuguauuugucuuuuuucacuaaaaguuuuucguuguuguuuucacagugguucugugcaggucuauacaauagauaacagcacuggagccaugcugcuaucucauaaauuagagcuaacagcaaaacaguauccuggugagucuuuuuuuuuuuuuuuuuuuuuaacauuuuuaauguacugguauugccauuuguagcagaugcugauuuuaaguuaaacaauacaugucaugcuauaggucaaauauuggggcucuggguguguaaacuggcucaagucuggaaauugauugaggggccgugauucuguuuuaauaauucaaauuaguauuuuguccauuugaccuagaaguuuucugcuuguauaaauuaagugggaaugcaguaggcuuccuaucaguuucacuuccaggaacaccauaauuaauuagccaaugcccaaguucuacacaagucagacuauucugauugcugcuuugcuucugcuguccauuacaguagcuacgcccaccuuaccuuugauaguugagugccgucacuuggccccugcuaccuccggauccaguuauucccauuuuguauuuaaauuuuguaguugagugacugagguucccacuguuagaucugacauacagagaagugcaauuauaggguucuucaaagauguagcugcugcccuuguaaaucuguuuugcaaggcaucagucaaggguauaucuucuggacccucccagcugggaugaguaggucuaaagugacuaauccacuccaccuucugaaucucccuaagccuuuggaucccuuccucuacauuaaaccaagggagaucaggcauuuccagcucacucacagugggccaucuuuuaauccauauuucagcuaaccacgcaaaucaacuauuagaaccuuuuuuaacuccccgagcugcagcuuuaaaugcagaaucccuacuuagugggcccaaaucaauaaauucagccugauccaacucuguguaccuuccaucauuaucccacacccuuaauauccauucccaugccuacucuccagauuucuauuuauguaaauuagaaaacucaagcaguucccauagugcaccuccucaugggucauacucucaaccucaccucuagaggccugccaggacuuuauugauaggucuagaagcaaacagagguguugggaguggcuccugaggagaaucaacauuaucuugccuggcgacugccucaggggagggcaucacuguugccucaggcagcacaggguuuauaauccucagacaaagguggaagggcuaauggcagcauggguccaggaggggauguugccacuauuggggauggggaaagcuguuucuucuggcaaaaaaaaagguucaccagaguuuacaaacucagugaaucuagcuucaucaggguccucccacacauccccuuuccaaguugcagggucccauuuuuuuccaaucagugccuucacuuuaacaguagacaccuggugaggcugugcaugcaccuuuuguugcagaucagccacucaaaugauaagaguuugucucuguguuuccacaauuuuagcucuuucucuauaggagauaagacccucacucagggcaaucuuagcaguuuugaggcucaguaucugcuucugggagauggaaucccugaguucaucauuuucuuucaucaccuuguucacugaacuuaggagcaaccaacuagcuucauuauguuccuugauucuccacauauggucaaagguguuauguauagagucacuaaacuccuugcgucucacaagcaaugaaucaggagugccaaaugcauuuauuuugcauaacucuauauaaacaguucacgucaaggacugucagugcguacuauuagaaauagaguccuuagcauuuuggggucuaaugauauuaggcagccaacucuagaaaccccaaaaccaaugaaggaacuccauccuuaauauucuguaccucuagaaucacuccugguaccaauaucuguauuaguaagguucucuaggggacagaacuaauagaauagauacauacauauuuauaaaggggaguuuauuaaguauuaauaaaugaucacaugaucacaaggucccacaauaggccaucugcaggcugaggaggaaggagagccaguccgaguuccaaaacugaagaacuuggagucugauguuugagggcaggaagcauccagcacacgagauguaggcuggggggcuaggcccgucucuauuuucacauuuuucugccugcuuauauucuagccgcacuggcagcugauuagauugugcccacccagauuaagggugggucugccuuucccagcccacugacucaaauguuaaucuccuuuggcagcacccucacagacacacccgggauuaauacuuuguauccuucaauucagucaaguugacacucaguguuaaccaucacaauuaggauauuuaacuauucauguugacuuaguguuacccacauuuauaccaguauuuuugcccaccauaucuuugaccaacucauaccuucuucuugagaccauuuucugccugaaaaaccucccauacaucccuuggaauuucuuuuaaugaaguuuuuugaagguaaacucuacuuugggagagucugaaauguacuuauuuugcugcugugauuuaauuauaguuuaacuuggugugcuguuuuggauuggcaguuauuuucuuuuuauacauugaagaauuuguuccagugccauuggauuuccauugcagcuauugagagguccucugucaaguugucuucucuuuucaauagauuggucuuuauagcuaccuuucagaucuugucuuuguuuuuggcuuucugcaguucaacugugauguggaagggaagaauuuuguuuguuuuucaaauccugcuugagacuuaggcuugcuggaugaagauuuacaucuuugaacuauuucuggaaaauucucaaccaguauuucuaaauauuccucuccccuaaucuauuuucuggaacucagauauacauuacacuuuuuuccauguuucuuaaccuaacuuuaaauuuuuuaaaauuuuguuucucuagacugcauucuagaaauuuuuucuccaucuagguuugcugauccucuccaguuaugccuaauaauguuguuugaucuguccaucaaguucuuaauuucaguuauuguauuuuuuauuauuuaaaggcuuauuuagcucuuuuuccaaucuguaugcauccugcuccuuguuugagucuucuccuuuauuuucauuggcuauaaaaagcaguuauuuuauauucugugucuguuaaucccaaaaucugaagccuuucugagucuguuucugccaugucuugauucuuuguguucuugcucguuuguguguguauuuuaggauuuuugacugagagccgauuguuuuccuugaagcauauuuuuuguguguguagcgcuuugagaacuggauaacauuugaguuuuuccagagaggauuuaaauuucuuugcuuccgcuggucacuugggagcacuacaucagucugugacccuuugcauuguauucucuguuugaaccacauuaaauugcacaaauuacaaaucagagugaggguuuguggcuucagauuaucaagggaguauuauuuuccauucacuuccacugaugaaacaugaaaguguuccuugcuaauucuuuuccuacauggcagaggcuuuuuucucauucucucuuauaccauggauauaguccauuguagucccagcuuuacauggguaucuuuuguuagauuaccugucuugggcaagcucugagcuuuaucuccuguuccuaacaugcugugagucaucagagguagaaguaaaggucuccaggguuuggcagaaaaauucagggaacaagcacuuugucucaguauuuuuuauuguuuugaggauuuaaguauucuauucaccaucuuaguuuuuucaguguggaagucauucagggugucauuugcuguacuuccagaaauagaaauuugcuccuuacguuuuuuuaaucauucuuacuguguagcuuuuuuuaaggccugcauauguuuuuuucuaaagacagcuuuuacuguaaccuuauccuuguuuuacagaaacugauuuauacaaagccaaagacuuuuaagauuacgcaguuauaaguuaaucaagcuaauagugacuagaaacagcuuucacuucuuacaaaucaccugugcacugaguuuguucugcuuagaucaggacaaaacuaauggccuuacuaacuuuaaguaguccuaaaugaccaggauuuauuuuuggaagcagucauaccuuucuacucauuuagauuugaaaauacagauuguauuugaaaaaaaaaaaaaaacaaguauuucugaagcaacuauuuauuuuuaacucuucucacuauuuccuaacagacauuuggaauaaaacaggagcuguuaaauugaugagauggucuccugacaauaguguuguaauagugaccugggaauacggaggccuuucuuuauggaguguuuuuggagcacagcugauuuguacacuuggaggagauuuugcguaagucaaaaaagacaauuuuuagauaaaauaacuccauuauuucucacaaugcaugcauacaaaaaccuugugucagaacuucccuuuuugccuugacucuuaccuuaaaacaauuugcaaaguucauaaucuguucgaauauacugauucucugaacauucauuuuuuaaaaaauguacaucucauuccacaaaaauguauuuauuuauugaaccccugcuguauauaugacagcauguuagacacaaagcagaaucaggcaugguucugcuuuuagguaguuuauaaucuaaugagggugguaaggcauguacauaaauaguagaaaguuacguuaucucauuagguuaauguagguuagcccagugauugauaggaguagguugguaucucugcccacuucauauacuacccugaaccucaguucugaugaaaugagcacaccuuuaaaagcugcauaucucuggcaagaagucacuuggaccucggaaaauguggcugagagauauauacaccuagguguauuaacccacaguuuuguauuucaugcauuauuauguauuucuauuuuaaaggagcaaaauccguuugauuuuuuaaaaaacacuaaauuuuauguguauuauauguaauuggaaggcuguauuauauuuaguuucuguucuguuucaguuauaggucugauggcaccaaaaaagauccccuuaagaucaacucuaugguaaguacuuucuauaaaaaauuggcaugguauuaaaaaaacuuggauuuuucuucccuuuuuucacucauuuuuauuuauuuaauuuuuugagacagggucuuacacugucacccagguuggagagcaguggcagaucauagcucacugcagccucucuaagcgauccuccugccucaagcuuccaaguagcugagacucuaggcacaccacuauccacacacgguuaauuuuuuugauuuuuaguagagacguggucuugccauguugcccaggcuggcccccuuuuuucacucauguugaucugauaaaaucacaaaacuauuuuagucucagcagacucuucauuauacaguucuugcuugaugaaagucuuuuguuuuuuuuuaauuggaaggcugccugguuuucaguauuugcauuuuguuuagauguggccagcaaaccccugucaucuuuaugaugauaaugacuguucagaugaggccuuuuuuguaugugucuucucauggccugcuugcuuuuaacaugaggugaaaugcucauugggcauuuuuccuggaggacaugcacuugugcauuacuugaggauaucuguaucuauauaucuauauauauguauacaguaccuugagcauauuuuuuaaaauuuacauagauguaugucaaagagaauuauggucacuguuguaaacaauacagguugaguaccccuuaaccaaagugcuuggaaccagaaguauuucagauuuuggaacuuuuuggauuuuggaauauuugcaaauacauucuuggggaugggacucaagucuaaacacagaauucccuuauguuuuauauauaccuuaugcacauagacugaagcuaauguaaugaauuuguaauaauuuuguacauaaaacaaaauuuugacugcagcucaucacaugaagucaggugugggauuuuuuuacuguggugucauaucagcccucaaaaaguugcagcuauuggagcauuucagauuuuuggauuagggaggcuuaaccuguauuuuuauuuuuuaccuauuuucaagaguuucuguagaaaacagagauauaaaaccccugucuuuacauaacaaguuuuucuugcuauagccccucugcauaccauccuuuuuaaauuagugacuaugaggcuugucgcuucucuucucucuugcuccacagaggaagacauucuucugaucuugaguuucuuguagaauuaaaaccgccaugguugccuaaaauagugguucccaaacuuucaccaccaaggaccccuucugaugucuuugcccaccuccauaguuuaaaauaaguuuucaccacacauuucuauaaauaccaaucagugcuucugaauggcaugcaagaaccaguguuguccgucucacuaaguugauauuuuaaccacaaacuaagaaucuaagcauuauuaguuaaaacuuaggcagcuuuaucauaggaaaacauaaaaguucuauuaaacuuuugaaauuuugcaacaauucaugggcuaccccugccccuucaccauuuucuuggcuugaagauugagaaucacuaaucuuuaaaaauacuaucauggagucuaguuacagaauauuaaaacugaaugguucuggaggaauuuauuugaaccuucucauuuuacagaggaagaaacuuauaucccgagaaacgagacagcuuggccaagguaauauauacaaaaagccaagcuauaaugaagacucuagucucacagcuuccaauccaauguuuuuugcuccauacaaaacugcaucuguuguaggggcuucuuugccaggcuucuacuggguaaccuggggugucuucuguaaggaauuucuuuguauuugagaggcagcuaaauuaaagcaauagagaaguuacagagcacaguagguauuuuuaggauuaagacccugaaauuggcauuaagaaugguagguaauguuuucacuuuugcagauagagagcagugauggugauuuccucuggaguuaguuaagagguaacugaaggugugauucuugucuguguuaucacgguuucuccaaccuucacaaaucauuaauaaugcuaucauuggcuauuucagaauuugaauaauugaagcuagaaagggauacaaaagccuuuuauugcucugacuuuuuuucucccuccucuucucucuaagagcuggggugcagaaggcuaucaccuauggguaaucagcggauuugguucucaaaacacugaaauugagucugaccucaggaguguaguuaaacagcccagcauccuguuauuucaguuuauuaagaguguacucacuguaaacccuuguaugguaaguauauuuaaagcucugauuuuuuagugucuuuuguguuagaagcucagacccuucuuuaugacauauguauggcguauacuucuaaaauuggcauauuaucuucuuuucuaugauucuuguguuucuuuuuaauuuauauuaaauuuauaccaaaauuuuauuucucaacggguuguguuucuuuggucuuauuuuuuuaaaagggucauaagcaauuugacggaaagcaauguuuauauauuuauuuaaauaauuugaguaauuuagucuuuaucugaauagcauuucccaaaguguguuccuccaggcacuacuuaugagagauauuaguagcaguuccacaggauuuuuuaaaaguuuuguuuccauauaagugucaaauaaagguaaaacaaaauuguagagauugauuguagggcuccagaggcuuaaauaugccauugugcaucaugaaaauccaggaggugguauauuaaaaacaguguuccccaugcuuauuuaacugugaauuuuuaagaaauagcuuaaagaaaguaugucugaggacuugcuuuuagaaacaccgccccaaacacugccucuuguauuucuaucugaaauaguguauacuaauauuauuauauaucgcuaauauacaguaaugguauauguuacauguuagaaauguguaucuuaauaccuaccaucaauggcuuuuuaauggauauuugguacaacaaauuucuaauuaaaauuuacgaacauccauaaaaaaugugaaaauagccugaauuucagauccauuauuccacuugaagacuaaggauccccagaaaagaagagagcauuucucccuccccuuccccaucccaaauaauaauuuaaaagcacccuugaguuuuaugucaagccagcauuuggacuaaaauggaaaaaugacaaggguagggugcuacuuugucugauuucaauaguuaaugagucuacucaccuuugagaacacuggcuuucuagcugaaaucucauagucacuaagagcacuauucuuucuaauuauaacagugcaugagauuauuguguagucuuuguccucugugaagaaaaucaacaucgagauacauguacauuuccuauaauaaaacuaaaucgauguguuauuuuugccugcguaauauugaguuguuuuuauuuguuuuccuccuuugcccuuuuguuccucuuucccucauuuagaguaaccaagagcagguguugcuucagggugaggaucgcuuguacuugaacuguggagaggcuucacaaacccagaaucccaggaguucuucaacacacucugagcauaagcccagucgagaaaagagcccauuugcagauggagguuuagagucucagggauuaagcacuuuacuuggacaucggcauuggcauguuguacagguaaaucuuuaguuacugauuacuagagacuuauucuuugauaggauaucaccuggaacagauuauuaaauauuucaucuguuaacuucaggcaacugagaauccuuuuaaccauuuugucaugucccucuucugcuuuucuguguucuuguccucuagucuucucccuccuuucuuuccacuuggcguagaguguauccccaccuguuucaagucuauuaauaaugucaagaacuagaaguuuauguuuugccuucucauugagaacuauuuauuuuacuuucagccucuuuuuuuguauaaauuuagcucuacggauuugcacaggcaaaacaaaguguaauaaucucauggaaaguggcaacaucagcuaguacucuguacagcugaccuuacagucuuaaggggccacguugagguuaaucaugugacuuuggacccaaauugcagacuugugaucaguagagagcuuuauuguuaauacuuuuauuagcuaaucuuauuccaaauuauuuauucauucugauaucacuuuuaaauuaacagugucucacaguaauucugauaaacugacauuuaacauggaaauuaauucucaauuuugauaccaaguaaaauuauuuuggggaaaccaguaaguugaaguuucuuaaaagaaacuugcauacauaauuucagucuuccgacuguuuucuuucccuuuuugauagcaaaauauuuuagguacaucaaagcccacucuuaguuucuuuuagucaguuucuguuuccauaauucuuugccuuacuuugacucucuauauguuuacccuacuagccuacuucagcucccauguuauuuucaguugacuuugagugaagauaaugagagacaaaaaaauggucaugugaaagguugaaggauuaucuccuacauugacaucugguauacacuaaaagaaaaugaacuuaacuuacauuaauaaauucauagaaucaaacaauguacauaccauuuuauaauuaguaacaauuuuuaaauaaaacugcacuagcuacuuccuugacuaaaauuuuccacugcucccuucucuccuauagccauuucucugcuauuuucauuuccccauacuuugaacuauucauucuacacugaccuagcaucaaugccaguucugccuagccaggucuguguuaccagagagccaaguagagcagaggaucaaagaagguaggucuggaacuaaaaaaucgaucaggcaauaacaaaaauugaauuuccuuccagcucaaaaacucagugauucugugauucuuaagcaucuaugaaguaccccauauaagagaaacauuuuaacacugauuuuaggacuuuggguacuagcaagauuccacuguuauucuguucuuuagauagcuaaagauauuuagacagaugaacuuuuaaaacuugaguuuaccuaguuuaucaguuuccuuaaaaauaacauaaauaaugccacauugauuguuuuguacugcugaaacaaugaaaaugggcucauagaauuuuucaagcuggaaggaccuaagagaucauaaaguccaacuggauuugauacaugaggaaacugaggaucagagaaguuauaugacuuguccaguucacccagcagaguaguggcagacuuaucuuuaucaucacucuacguuaaaguaaaaaucuaauguauuuuaaaaccgagguacugagcauuaaaucacauaauacaccacugaccuugagcuaaaacuuagaauucgccuauuuggcaguuuguacuuggaguugcccuguauuucgcuggcacuccagcuacaugauucagugcaguuaugguggcgguguauagggcaguauacagugucuauauaaugcuaaacuuuuacguucuaggcuuuuuagccauuuaugaugacucccugaagaaacauaguugccugguuuaauuugccccacaauaguauccuuuuuucuaagauaagugaccacauccucugucaaaguugauuuuguuugcgugauuuauucguuguauguaugcuucuuguauagcuuagaugaacuccaacuaauucugcugcuuguucuguuucucauuuagaguacuagcuuuuuguuuguuugcuuaaaccugcuaccuuauacuccuuagcuuccagauuggaagauucuauguuacuuaugauuuuucuuuaacuaaaacaaaacaaauacauacuugucagaagcaggauugguaacuggcaguaaaggcggugcuuuuuuuuuuuuuuuuuuuuuuuuuuuuuugagauugaauuuuguucuuuguugcccaggcuggagugcaguggcgugaucucagcucacugcaaccuccaccuccaggguucaagcgauucugcugucucagccucccaaguagcugggauuacaggcaccugccaccaugcccggcuaauuuuuguauuuuuaguagagacgggguuucaccauguuggccaggcuggucucaaacuccugaccuugugauccaccugccucagccucccaaaguacugggauuacaggcgugagccaccgcacccagccaaagcaagcaccagcaagcaccagccaaggugcuuuuuaaaaaguuuuuucuuaccuauaaguuuuaaaacuuuugaagucauuuguugacauauggggcacaaacuauugaaauuuuacagaacacaaaguuucuaguuuuaggccauguuccuucuaagacugccauuuauuuuaaugcucaguauuuuguaugauguaagcauuuacuucugaaagguacauaaaucuauuauccauuguucugaggguguugguuugaugguuagcuuggcuauuuagaaagaauaagcuucacaaaauguggaagauaagcaccuacaggguaucaggcacuauguuagggauuucaacagagaguauuuaaaggcucuuucauucauaaauuauuuacugucuuccuacaguauguaucaaguguaccagguauuuggcacagaacaaaucugcuaggaggauggcucccacagucucacuaguuauagacaaaacuaaucuaggcaggagacagaguuuuagcagaguuacuuuaaaauuuaaaaaucauaauaacaaaugagggcggauucaguuucuuuaagagaaacugaaacauucuaagauaaggguagaguuucuguaccuuagcacucaguuuuccagugauguggcaugacuucagugcccugagugugcuuucaugaccuguuuuuuuugucacugaucagcugccucuuccuuacuucugccauucccuuuuaucaaguauuagagguagagcucagaguucagaugacacauagaucaauaaaguugaccuacuggagaaaauacauaguaucuuuagacacaaacugcaugaaaaauaaagcuucauucuaaacuuaacaccuuaaguuuuuaaaauacaucauuuguggcacuucauagauuuuuguagaauaaagaauaaauuguuuuauagauauugaucauagugugaucauuugauaagauuuaacuuugguucccauuauuagaaacucuuuguguuagaauccacuuuugcaguaagaucccagcuccuccauuacccacccacacguuucauaaguacucaugaaacaccaagguuugagggagguaaggauuccuuuuagugcaauggaugauugacacaguuauacucagguacauccuccugcugugagugacugcugaaaaaaguugaaaaugcuuucaaguuuuauuucaccacccaaucauuaccuuaaguguaccauuauucugaacuaauuuuacccaucauagugaucuuuuugggggucuggggggcagggagacagagucucacucuguugcccaggcuggagugcaguggugcaaucucggcucacugcaaccuccgccuccaggguucaggugauucuccugcgucagcuucccgaguagcugggauugccggcaccugccaucacgccuggcuaauuuuuguauuuuuaguagagacggguuucaccaugcuggccgggcuggucucaaacuccugaccucaggcaaucugccugccucagccucccaaagugcugggauuacaggcaugagccacggugccuggcccauagugaauuuuauuaauuuauuaagcuauugauuuaguuggauuuuaaguugacuuaagucaacuuaauaaguauaacaaauaauuaguaaguaaagcacuugauaauaagugaaguauaacaaacaguuuuaucaaauuuuaucaagguuaauacagauguuuagagcauauugcuuuuacuuaauuuucugucuucacauuacauacacaaucuuacuggguuugauugcuguugacuuagcuuuuuaauuuggcauuuaguuuuucaauaugugacaacuuuucuuagaguaaaaugaaaaauaaauuugaacagaucgaagcuuuucuuauuccaagaacagaagacucuuuguucaguucuguuaauucucgccccacuccaacaugugcucaugaaaacuaaucagcaggcuagagagaucaaucucauuaaaacgaaaauuuacuuuaucuacauugauaucccaugucaauuauuuaaauugaaagguguuguuagggugauacaaagacaccauguucaaagauguaagacagacaacguggaaaaaugaacgccuuuucuugcagauagaguuaauauuuguaauauauuaaaaguucuuguagauaaguaagucaaauaccccaauagaaaaauaauagcuuacauacacucuuucauguacauauauauauguuuguuuagagauagaauaaaagcuaaccagugguuguaccuaaguaacagagaauuucauuuugucaauuuuuauauugcauaauuucauaaguuuuuuuuuguuuuuuuuuuuuggagacggaguuucgcucuuauuccccaggcuggagugcaguggcgcgauccuggcucacugcaaccucugccucccggguucaagcgauuguccugccucagucucccauguaguugggacuacaggcaugcaccaucaugcacgguuucguauuuuuaauagagacgagauuucgccauguuggucaggcuggucacaaacuccugaccucaggugauccaccugccucggccucccaaagugcugggauuacaggcgugagcaaccacaccuggccuaagcauugcuguuuuaaucagaaaaguguaaaaguaauaaaaauauuuccauuaaaaaccagaacuuuuucugaggcuguaauuguauuagauuagguuguuuuggaaugguuuauaucagcaaacccaaacuguucaucugcacaauucauagcugcccucacaggugccuucucugaaaaucucuugucagucuguauuuauugaauucaauauuuaaaacaaacagaaacauaaggggcaaggggcagggagaggaaagccuggugccuagaaacaugaaauaacguaagauguaaaacauugauucauauacaaaugguaaauuccaagugcucugcuacuaacuagggggcaccuuaaacauuguucggcaagaugaaucucauagugugauaacuuaaugcuuuaaguuuaaauauauuucauaaguuuuaccaaucugauguguuauuuucuauagauuuccagcaccuaucuagagagcaauuggccuauacgggugaguuguuauuuuguugguguuaacuuuuguugacuagcauuugcugcaagaggcauucugggaagagcccuucaguggguguacugagaaaaauaaaacucuugaucuauuguaacauugcuaguauauuaacaucuauaauuuugucagauauaacugaauauuuggacuuuaaaauauuuaauuagcaaacauuuauuaauugucuguuugccugacacaauacuaagcucuuuaugccuaauaaaguauauagguuugcaaggaaaaguucuuauuuuuuuuuuuaaacaguuuucagcuauugauaagcuuggacagaauauugcugugguuggcaaguuugguuuugcacauuacucuuuacucaccaaaaaauggaaacuuuuuggaaacauuacccagguuagucuuuuuugagauuaaaaaccuauuucucaaaguauaagagaacuacaauaugaaauagcuauaaaguuuaucacuaaguaauuuugguuacuuauuaaaaauaaggaaaaucagauauaaaaaagugauauugaauaauauguaagauuugauucugauaaaauacuugauauuugauaaaggaucuuguguugaaauaguugguuuauuuuuaauucuuuuuaagaucgguaacuauaauuccuuagccugaggauuuauucuuacauuccagcuugaguuuaucugaugugaucagaauagauuuccacagaauuugagaucauuccaugccuauucugugugugauguauaugggauagugagugugcguguguguauguguauguguguguacauauacgcaugcaguuggaagagaaggaaaucaguacuuauuaggugccuauuguguguuaggcauuuuaaggcacuuucauauauguuaucuuacucaucugcacagcaacccagugaaggcacuacuguuacugaucuuuugauguaaacacacacacacacacaaacuaggauucaguuacucaucugauaagugauuaagccagaauuuacacuaagcccuaauggguguuagaaugaugaugcuauauagcacccaguuauuuuuaaugguauacuugccuucuuaaagaaauauuuauuuuuauaaauaggauauggaucauuauuaauaaaggcucuagaguuaucauuggagagagggggaguaagagcagaaauaauuugaucuuuggcugggcgugugguggcucacgccuguaaucccagcacuuugggaggccgaagcaggcggaucacuugaggcugggaguccaagaccagccuggccaacaugacgaaaccccgucccuacaaaauauacaaaauuagcuagguguguuggagcaugcuuguaaucccagcuacuugggaggcggcugagacaugagaauuccuugaacccaggaggcggagguugcagggagcugagaucgagccacugcacuccagcaugggugacagagugagacugucucaaaaaauaauaauaauuugagcuuugucuggguaagaauuuuuauaaauauauuacuuuguuauaauuucugguagcauaagguaaauuuuuuaaaaaauuuuuauuuuaaggagcaaaauaugaucgugacagguggcuuagccugguggaaugauuuuaugguccuugcguguuauaacauaaaugaccgucaagaagagguaaguuuuuucucucagaaauaacagauuuuuauauuuuaaagcuauuaagcaugaauuaauuuuauauagaaaauagucgauugaaaacugaacaaaacauuuuauuuuuuaaucaagaauguagcuucuuuuagguagugggauuuucuuuucagguuauuacuuuaaaaaauuauuaagugacaauugagacuuuuaagauaaccuuuucuaaggauuuuagcugucggacauucccuauggaguuugaaaauaaagaguuaaaagcaaaaaauuucaugauauaagaauggcuguccucagagauagauuuauuuaguuacugauuuacaguaaccccuccuuaauuaugggggauacauuccaagaccaucaguggaugccugaaacuguuaauaguacugaacccuauauagcacuaucuuuuuuccuauacauacauaccuaugauaaaguuuaauuuguaagagauuaauaaugacuaauaauaaaacaauuaugacaguauauuguaauaaaaguuguaugaauguggucucucagaauaucuuaguauacuguacucaccuauuuucagaccaugguugacuguagauaacugaaacugugaagagcaaagccauggauaagagagacuacuguaucugguuuuuuguuuugagaaacagcuggucuuauuauguaucaggucuaaaucugcaggucuaggccaggugcaguggcucaugccuguaauccaagcacuuugggaggcuaaggcggguggaucaccugaggucaggaguucaagaccagccaggccaacauggugaaaccccaucucuauuaaaaaugcaaaaauuauccagguaugguggcacaccccuguaaucccagcuacuugggaagcugagguggcagaauugcuugaacccggaaggcggagggugcagugagccgagaucaugccacugcacuccagccugggcaacagagugagaccccgucuuuaaauaaauaaauaaauaaauaaauaaauaaagcaggucuaaaaggaauauuuuauaauaguacauucaguuuugaucacuucauuuuuugcuuacucauagaaugagccuagucugcaaaaauauguaaacauaauccauuuacuguuaaagcuuagauaguucuuuuaacuccuguuacuaaaaaaaaaaaaaaaagucggaaguuaaaaacagcauguuuaaaguauuuggucaucccuaguaguuaucuuguuuuuauaauuuucuucauuuuuguuuucuucagcuuagaguauacuugcgaacaucaaaucuggacaaugccuuugcucaugucaccaaagcacaagcagaaacauuacugcuuagugucuuccaggacaugguaauaguauuuagagcagacuguucaauaugccuuuacaguauugaaagaaaaucugauggguaaguaucuggcauaugagaagucacuuuuugcuccuauuuaccacguuucucuuuuguaguuuuuguuuucucaaaacaguuauuccacuuuuauauucaaucuuguuuuuguuagagguaaaaaaagcaaggaguuuuaauuagugauauugauauaauagcuaaaaaaaaaagaaauaucguacacuaacuucuuuagcuuaucuuccuggagucauuugaaaaaaaucuaguuugggaugagguaaacccuuagauacuaaauuuuuuuucacaaccuugaaaauaaaugguuacugacucuccuggugcucucgauacuuggugggaauuugaaggaguucuacaacuuuaagacuguaggaagcauguccuuagcaaacugacuuauauuuccacugagcuagauggcuguagucuggggcaguaaaaaaucagcaguguuguugcugcugcacguugccuuauauuugucuuggcaucuggucuacuugcaacguauuuagaccacaccucuugaguuuuauuuuuguucucagagguuaauugaaguauguauuuacugaaacagcacagugauugagaaguaaugcaagauaaaaauuaagacaucucacuagccucaaugauugaaccaucauucuuucucaacccacuaguuuuuuccacuuaaauauuuguauucuuauagcuucuucccuaguuuucgucuucccuccuauuuguuacucccuuucuuucucucucauccccauauacucugguuccccucaaccuugccaacuuccugaucgaaggauauauggggagaagaugauagguaguaagacaucugagucuuccauaagcaugaaaucuaauacuauuacuaguggaaaagaaagaaaaucuuauuagcauuguuguugagguauguggguuucuuuuguuuuuacaguccaaauacuacugcugguauucaaguucuucaggagguuuccaugucacgcuacauuccucacccuuuccuggugguaucugucacucugacaucagugaguacagagaauggaaucaccuugaaaaugccacagcagguaccacuccauuaucaaaggucuuuggaguuuacauuucuguuuuuaguauuugaguccauauuaggaaguauuuguuuggcaaauaaauacuaagugucuaaaauguaccuuauaugagaaugcuggguugcaguggcaaauuaaaaagacaugguuucugcucaggcauuaaauaaauaauuacauacauaaugaauuguuccuguuacguguaccaaaaaguaguacacauuacugugagagcauuuaacaaaaaccuguuauagucugaacagucagagauuucuguaucauuuaaauuaaaacuaggagaauaaguagaaauuauccaaguuaagaggggauggauuuucagguggaaggaacaguagugcaaaggcccauagacaaggcagaacaugacacacucagggaauuggaagaauuuuagagugacugggacauggaaagugaaagaggauaugagucuuguagauaauauugauaauuuuagacuuuaagucuaaaguguuuuaagguagguauuauuagaucuaagcuuuauaauguuuacuguaaggaggaaaaugaacugaaguaagacaaaacuacuguagggagagcaacugggaggucauuguaaugaucuaggucagugguguucacagucugaacuugggcagugaaaaaggauauggaaagaaguagaaugaguauagaauagcaagggcuuuauaauuaguuaauuaugaggaaagagaaaguauaaucccguaguuucuggguaaaguaacaggguaagaaguagggcgaccaggacccacguugcauaacuuucuauuucagugguuucuaaacuucaugucaacugggaaccuacugucagaggaaaauucuauguggauuuauuugucaucccugucugggcagucugucuuuuacuuccuaucgaggcacuucgaucaaaccucaacacuccauaaaauaauuagaaaacagacuagacuagacuauccaguuauggggaauuuaauauuacuuauaugaaucuaaaaucaauuuuguuaccuucuaucccaguucucuauucuuuguagaagacauuguaaaagcuagucccucuuccacaugaugacccguaaaauaucugcagacaguuaacauuccuuggcuucuccuucucuccucaaaccucucugucaucuuaucugcaugcuaaauacuuccauauguccaacuauuucauuggauguuuauucuagaccccuuaagcaucuuggucucccuucuuuuuuuuuuuuuuuuuuuguccuuuuuucuuuuuuuuuuugagauggagucucacucuaucgccaggcuggagugcaguggugcaaucuuggcucagugcaaccucugccucccaggcucaagcaauucucccgccucagccucccaacuagcugggacugcaggugcacgccaccacgcccagcuaauuuuuguauauuuaguagagacaggguuucaccauguuggccaggauggucucaaucucuugaccucaugaucugcccaccucggccucccaaagugcugggauuaagggcgugagccaucgugcucggccuuggucucccuucuauagguaaaauugguuuucuccuuuaaaauauaguucccauuuccucugcaaaccuuauuuaaugguaaccaguuaguccuaauugauaagggaauauacuguuuuacagaaguuuagauaaaaggugugaaaaaaagugacaauuuaaaaaucauuuugcaguccugaggaacuaaucagucuuaucacuaaaaaugggaaaaccagauaugguaugcuucuugaggugauauaacaugaaguucacaagaauuauugccaaaaaucuugaacccaaaucaaaucaaguauagagagucaucuucccuaccacaagggagcagaauacaagacauucuguuggacagcuacaagucacuaacaugggggaagaaggagugaaucuucuagauuaaauaagacuuugaagccauaaaaaccaaaugcagugguuaaaagucauuugugaggcaaaugugauaaucacuacccugcagaaccaagucaguaagcucauuuguaucuucauucaaaucagcuaugaaaagacacuguugaaacaauuagggauauuuaaauacuaauggagagagaaaguagggaauaauuguaaauuuuauuggaugugauacuagcauuguagcuauguuagcagaugcccauauauuuuaggaaugcauauuaaacauguagaaguaaaauggguagcaugucuuaauugaaaauauucugacaaaacugaaaaaaaaauaagggauggauggagcacauaaggcaaaaucuugauaauugugaaucuggauaauggcagugugaaaguucauuauacuauucuccauacuuuuaaucauguuuaaaguuuucauauuuaaaaaaggacucuuauauaucccagauagaguaggcaaccaguggcaucaguaguccuggauaccauauuuugagagggccuuucacaaagagaaggugcuuaauuuggcuagagcagauuaagaaguuaaaauugacugauuaccauagagggaagacaaagaaugcuggagcaaaguaaguuuucauuuaauacuaaaguuuucaaaaaaaauaguaguaacagugaaaacucuucaacagcaagauagucucuccaugagagugagcuccuuguuacugaaacucucauagagaaucaucugccagggguuuuuuuaggguaagagauugaguuugggguuccuucaaauuuaggauuuugggcauacauguagcccuugcuuuuucugaaagcuuuauuaaaguugcuugagagugcuguugcagucaucuuuaacguuaucagaaaguguugaauacuaagauaggauacugauaauacccacucacugaagaaaagagaaguguacuuuuuuaaugaauuaguaugaaauguggugaaaucuaccaucuuaaaacuuaagguagucauuauaaacauuacucauauuguggugaauuacaguaaaugccuuuaaggucuuuugaaguguuuuaguguaugcaguucccagucaugcuguuuugcugcagguguuugucuuuuucuuuuuccucugccaucuagcuacauuuuacuguuauccaggugucugacucuucuaguugccacacaccuaaauuccauguucacuucucauaccuccaaauuacuuucuggauagauaaccaauuuuuuuauuuagucauuucuuuauacauaauccccuguagaaucugaaagcaguaagcaagaguaguuuguauagccaaguauuuugcaacuagaauauauaggguggcugcuguuuucuugaugaacccuaaaugaucauugguagcuuaaauucagccagccagcaugcagcaaagccugggacacaaucccacaaguuuugaauacucacucuuuccucccugaaauucuuuccuucuguuuauauagcauguauagcauugugcuucccuauuucucuuuugucuuccaaaagcucaggugauggcccgcugcucuuuuuacccuggcuagugugccugagaaacaucugucugucuccuucaguuuaccagccucaccuuuuuuuuuuuuuuuuuuuuuuuuuuugagacggagucuugcucugucacccaggcuagagugcaauggugcaaucuuggcucacugcagccuccgucucccggguucaagugauucuccugccucagccucccaaguagcugggauuacaggcaccugccaccacgcccggcuuauuuuuguguuuuuaguagagacgggguuucaccauuuuggccagguuggucuugaacuccugaccucgugauccacccaccucagccucccaccaaaugcugggauuacaggugugagccacugcgcccagccuggcccagccucaccuuuaagcuucugaugcugguacagucgucucugauuuagugauugcucacauuuuuacuuggaauucuuaagaauuuuuuuuuauuuuuucaaauuaaaugagccaaaaagaaaaagggaaacucuuugguuuucccuucccuaauuucucuuccugucuucuaucagugauaauaacuucaacuucucuagcaccucagcuaaccuggaaaucaucuuugguucaucucuuuuucuaccuuucaugucuaggauagcaguaaguucuguuuuuuaaccaaaauguuccuuccucuuuacagauagaaaugacuugauaucugagguuccuuuuaaaacagggcugcucaaaguuuaaugugcauaaugguuuaaguugcgugauagggcucaauuggaaaucauuauacuaggcucucugagguuugauugaaauuuuucauuauaaaaaggcagacuauuuccucauuucugaagucaacacccaugaaaucugccucuccucaguaaccuauccugauuaacucugauuuuuuaaauaacugucuuauucaagaaccauaaguaguggcuucuuuccugcugcucuuuuaccuggcuuucugaauccuccuugaaggucuguuaccauccagcuuuguucucauaaugucccuagucuagccagacuguucucacuuucccaauaguuccaugucuucguuuuccauuagauuaccaacccuuacucucccacacguguaugucuuccucaucugucagguucacugcauccuuuuaaacuuucuguuguuaugacagcuagaucacugaagugaucucucauuuuuauaaacuucuaaaguugucuuagcuuuuucaggauaauucaacucugcccucaaucuuaugucacuggugguguucauuaauugcauuauguguuaggcuuuguaccauccuagccagaaagcuccuuauauucccacagagccuagcagaauggcuguacauaguacaaccucaauaaauaauguagauuguuugaccuauaaaccuuauggauuggggggagaugcggaaagcauaccgauacagaaguaugaauuuagcugcuuuuucuuaaauuucaggcucguggugcagagagcauuauguuaaaccuggcaggacagcucaucaugaugcagagggacaggucaggcccacagauccgggagaaggacaguaacccuaauaaccaaaggaaacuugugaguaaaguacuagucauuucuuuucaaacauuaagaagguaugggaugaggaugaaggaaugaaacaauuuaagagaagaguauuuuaugauuuggaaaggagaaauuaaguccauaaaaucagucuuaagccucuggguguaagacugacugacuggaggauaaggucccaaaaugaucaugaaauguuccauacuccauauguuaacugcuuaggcaucauucauugcaaauucuaauggaaaaaauagggauagacuggugaaguucaugggguguuuuguuuucagauuuaaguguauauacuuuaaaaggccaggauacuuuuauuaacucuaauucuaauuagaucccuuugcuuuucccaaaaaaauauuauacuaucauuugaaagacuuaguaaacuaguaccuaggaacuuaagaaccugcagauuuaauaggaaaacaacuugauucuugucucuccuucuccagcugccauucuguccuccuguuguacuagcccagucuguugaaaaugucuggacaacgugucgagcaaauaaacagaaacgucaccuucuggaggcccucuggcugagcugugguggugcagggaugaaaguuuggcucccucucuucccuagggaucaccgcaagccccauuccuucuugucccagcggaucaugcugccuuuccacaucaacauuuacccgcuagcuguucuguuugaagaugcuuuaguccuuggugcugucaaugacacuuugcucuaugauucuuuauauacucggaacaaugcuagagaacagcuggaggugcucuucccuuucuguguuguggagagaaccucucagaucuaccuccaccacauucuacgucaacuucuggucagaaaccuuggggagcaagccuugcucuuggcccaguccugugccacauuaccuuacuucccucaugugcuggagcucaugcuccaugaaguacuggaagaagaagcuaccucacgggagcccauucccgacccucugcuucccacuguggcaaaauuuaucacugaguucccccucuuccugcagacaguuguccauugugccaggaagaccgaauaugcccuguggaauuaccuuuuugcagcuguuggaaacccuaaggacuuguuugaggaguguuugauggcucaggauuuggacacagcugccucuuaccuuauuaucuuacagguaacaauucucuucuuauaaaggggcaagaauuaaugagcuuaaacuuagaaaaauagaaauguccuguuuugacaccaugauuguguuuaaggaauucauagucaaauuuucuguuuauaucuuuaauuuggaagaauucagacagauuccuuugaauaucauaaaguaacauugcagagauauuuuuuccauuguccauaaauaggccuaaaacagauuaaugaguucagaguaguguuuugaaauuuuaauauauugaagaaauuuaauauguauauuagaauacauguaauaggaacauggaagaaauauuacauaagauuauugaaauauuacauaagaaacauagcaaagaaaguauuauuugagauauuagugaguuugagcuucucacaacaguagauuuguuuccuuucaguguggguuacugaggggacacuuauuagagcauggucauaacagagcaccuugagcuagucuuccccaaagcaagcugagaaggcucaggccugccacagcaaagacccucauagcacacaguuuuucucaaaauaauggcuucuuugcaacuccugaaaauuuauuucauuagcuauuugacaaaagggcuugacaguugguuauuugauaggcuacacuuaaagauucuuuccaguuacugcaaaguuguuuccauugauguaagaagcuaaccauaaaccugguuucaaucucugccugaagcagauuuccugucagcuucuuugcuucaugacaaugaacugaaaccagaggagacacucaagcagaggccagguggccuugaaguaugauuccauggcuaacccuaaagaaaaagacauaggguuuuaaaaauagaaucaaaauaaaugcagcuguuuuuugguuccgggucacucccugcaacuucacuguaucucccugacaauguaauuuuuuucugcaacagaauuccuaaguugcuauggauuggcagauaauaauuacaauuacaguugucuauuaggcaccuuuccauaaagaccaagauaggcagguuaaauuugugaaagaaaaauggaggauucugaaugugcagcagaacuuuacuacuugcuauugcccaaagcaaagauucuagucacauccucagaaaacucugcaacaggagacagaccugaccuauuuuggagucaggcaaaccucccuuuuuuuucuuccuuuucugcugaucuucaacaauuuacuuaacucaguuuccucacuuguaaaauacaaaugauaugccuaucugcagagucacugggagaaauaaaugaaaugacuuaaaguauauguaugcuaucuggcauguaguaggaguuuaauaaauuauaguuuacauacaccagaagaguacuugccucgcuuuuccuuguaugguacuuuuuaaucuuauuauuaaacuaaccccuguggugguguggcuacauucuuugaguuuagaaaacgagauaaagaauugcucauaucuucccaaauuguguaguauaaaaagaaugcuguccugguuguuuuuuguagaauauggaagucccugcaguaaguaggcaacaugcuacccuucuauucaacacagcacuagaacaaggcaagugggaccuuugucgacacaugauucgauuucuuaaagccauuggcucuggagaaucugagacaccuccauccacacccacagcucagguuaguugcaaaaguuacacaucuucucuaggccauacacccacguagcaucuuucucuaaugguacugcauaugguguguaauccuaggaacccaguucaagugguggauuugaguucuucaggaaucgaagcaucaguuuaucccagucagcugaaaauguuccugccaguaaauucaguuuacagaaaacacuaaguaugccaucuggucccucuggaaaaagguaaaauaauaaagagccauuacugcuuuuugggcauucaugacacauugcauuucaagacauuuacaaaauuaggucuuaauggaaacaacuauuuaauccaauugcaguuucuuuuuccauucccaaaaagcagaggccacacagaaggcuucccuuuuuccuuccucccaaguucacuucagcacccucugaauaguuucugccccuuuuucuggaauagaucuucauguaccuguucugaauguaacaaacuuguuuaagacagagucucacucugucacccaggcuggaaugcaguggcaccaucucagcucacugcaaccuccgccuuacagguucaagcgauuauccugccucagccacccaaguagcugggauuacaggcauaugccaccacacucggcuaauuuucauauuuuuaguagagacgggguuucaacauguugcccaggcuagucucgaacuccuggccucaaggauccaccugccucugcuucccaaagggccgggauuacaagcgugagccacccuaccuggccaaaugcuacaaacuuuuuuuucccauaaguuacugggguccaggugguauuugguuacauuaauaaguuauuuaguggugauuugugagauuuuggugcacccaucacccaagcaguauacacugcaccauauuuguugucuuuuaucccucacccccucccagccuuucccccaaguccccaaaguccauuguaucauucuuaugccuuugcguccucaugguuuagcucccacauaucagugagaacauacuacauuugguuuuccauuccugaguuacuucacuuagaauaauacucuccaaucucaucaggucacugcaaaugcuguuaauucauuccuuuuuauggcugaguaguauuccaucauauauacguauauacaaguuucuuuauccacucguugacugaugggcauuuggguugguuccacgauuuugcaguugugaacugugcugcuauaaacgugugugcaaguaucuuuuuugaaugacuucuuuuccucuggguagaaccccaguagugagauugcuggaucaaaugguaguucuacuuuugguuauugagggaaucuccacccuguuuuccauagcagcuguacuaguuuacauucccaccggcaguguagaaguguucccugauggccacauccaugccaacaucuacuguuuuuugauuauggucauucuugcaggaguaagguggcauugcguugugguuuugauuugaaaaugcaacaaacuuuuaaauuaccucugaugauagaggaccaaaaggaagauagauaaaucuguagguaauccaaaagccuucuuaaagucguaauuuuaccuuuccuucuaauuauacuuuuugauauaaauuuagugcuaaugcauuugacacucuugugaccuauugauuagagaaguuauuacacagucggggagccaaaugaauuguaugcuggagacugaaacugcuaucacccauagaugggauauugucuucugagagaugacuaugaauucacacuaacauuauaaaaucaugagaauuuccucugguuugugaggccuguguauuccuuccuauguucuucuguuguugucucauuuuuuuccuuaccuaauccuuuguuuuauauuguucauauucucuuuuuuuuuuuuuccccaggacaacaugaacauauguuuauauucuuacuaccgugcuugggcacauagugagagcuuauugaacguuuguuauugucauguuuuacuggguuuuuuuguuuuuugagauggaguuucgcucuuguugcccaggcuggagugcaauggcuugaucucggcucaucgcaaucuccgccucccagguucaagugauucuucugccucagccucccaaguagcugggauuacaggcaugcaccaccacgccuggcucauuuuguauuuuuaguagagacgggguuucuccguauuggucaggcuagucucaaacucccgaccucaggugauccgccugccucugccucccaaagugcugggauuacaggcaugagccaccaugcccagccuguuuuacuguuuuuuaacaagugcuuacuacaugccaggccuuauucuaagcauuuacauacauagguccuauuuuaaacaacucuaugaggguuauccacauuguauaggugaagaaacagaggccuaggaaaauaaacuuaguuauguucacacaacaaaugaguggcagagccaagauccgaauccaggcaguacugcaccagagacuaggcucuuuaccccaccacuaaacugccucucacuuaaagcaccacauuauccaguuaccaaaccaguucccccacauuagcucauguaagucaggaaugagagacuauacuuaggcaaguuguaauuuuuaaaaauugguuucaggacuggcaagguggcuaacaccuguaauuccagcacuuugggaggccaaggugggaggauugcuugaggccaggaguucaagaugagucugggcaacacagcaagaucccauccuugcaaaaauaaaaauacauuggcuaggcaugguggcaaguaccuguagucccagcuacuugggaggcugagguggggaagauagcuugagcccaggaguuugagguugcagugagcuaugaucacaccacugcacuccagacugggugacauugugaaaccuugucauuuaagaaaaaaaaaguugguauucuuuucauaugucugcaugacucacacugagaaauuuaauuucacuuugccucucuauccuuaguuucuuugaugugcucuccuucccucuuuucauugggcuuuucaaauauagcauagagguuugcugccuuucuuucugucagccacccaucaccugcuuccuggucugacuucuucugucccccuuuuccuguucccuguauucauucuacaaaugugucuuaagagccuucuguguuccgaggguugugguguaacacggaggagaagcguugauacuuuaucuucauugucaaucagaauuagaucuuggaucucuuaucuccuugucagcuuuaucaguaccucugcguaauaaggaugugaaauccuccaguaaagauuauucuguagcuuucuuguguuuccacuuacagauggagcaaagacagugacugugcugagaacauguauauugacaugaugcucuggagacaugcucggcgccucuuagaagaugugagguuaaaggaccuuggcugcuuugcagcccagcugggcuuugaacuaauuaguuggcuaugcaaggaacguacccgagccgcccggguagacaacuuuguaauagcccugaagagacuccacaaagauuuccuguggccacuuccaaucaucccagccucuucuaucaguucuccuuucaaaaauggaaaauaccgaacugguaauguagacuucaugucacuuguacaaggagaauuguauuuuacuccguguauuuacacauuuugcuauuaguugauauucaaggaauuauuuucauuccaaacuuaggaauggauaaaagccaacuuuuuguacaugaguuggaaugcccacuguuugaccaaagauguaaauaaaguagaaccuaugucucuaa

SEQ ID NO: 192787 - RNA, 113229 nt, Homo sapiens
cuuugcgcgagugucuugguugagcgcagcgcccauucauugcccgcgagcguccauccaucuguccggccgacuguccagcgaaaggggcuccaggccgggcgcagccgccacccgggggaccgaggccaggagaggggccaagagcgcggcugacccuugcgggccggggcaggggacgguggccgcggccaugcaguccugugccagggcgugggggcugcgccugggccgcggggucgggggcggccgccgccuggcugggggaucggggccgugcugggcgccgcggagccgggacagcagcaguggcggcggggacagcgccgcggcuggggccucgcgccuccuggagcgccuucugcccagacacgacgacuucgcucggaggcacaucggcccuggggacaaagaccagagagagaugcugcagaccuuggggcuggcgguaaggaccuccacccggcccuccgcggccuccccuccgcccugcccgggcucugccugcgcggccucccggcuccuacccugagcucugcugcgcuccgcgugguccccgcacccugggucccgggccguggcguggaagcaaauucgugccuuugguccucgugccuucuuacuucuuaacagcuuacuuucuccugcacccagucuucgugccucaaaaguguacauuuuuaaaccacccccagcccaaguggcccuguggauggaccuaaacuuugcaagaggaggaagacccccugauuaagagugggcuuaccgguuagcuccgguugcaacugaaauccaaccccgaguggcggaaucuccaccccacuucacgauuuucuuuccuccaaaucauucuggcuugcucagaguuuuccuuuucuuuuaaaaagaacccuaauuaggcgauuucaaugagguucccacaaggcuuuguagucgcaaaacacagaggugacucuuuuaacucagaggcacuuuccucugccuugcguuuuaauuuuagagcauugaugaauugaucgagaagacggucccugccaacauccguuugaaaagacccuugaaaauggaagacccuguuuguaaguggccgggagggcucccuuggacuuagauuauucuggccuauuugucuuuugugguucccugaaaaucgagcucugggguaaggauugcucaggacugggaauguguggauuaaaauaaaacaguggcggguaccuccggagccgcgggaaggugggauauuugguucucggagcagacaguuuuguguuaggagagagucgguguugugcgguucuuggucuuuauccuagggcccccgcgagcuuccccugcguuuuguagcagauuccccacuucccaggcacccucucaccggccagggugcucucauacuuuggguugagaggugucauuaccugcgcagacccggauagacucaaaggaucuaggaauugccuaaggucgugcaacuggggaagugaccagacaucucgccucccucccccaggcuucuuuagaucgcaguaucuuccaauuguuuucuuaccucacguccaaauuuuauuauuuaccaacugaaagacagcaguacuuuucgaguccgaaugguuuuucuuuucuuuucuuuuuuuuuucguuuuuuuuuuuuuuuuuuuuugagacagaaucucugucgcccaggcuggagugcuguggcuugaucucggcucacugcaaccuccgccucccugguucaagcaauucuccugccucagccucuugacuagcugggauuacaggggcgcaccaccacaccaggcucauuuuuauauuuuuauuagagacaggguuucuucauguuggccaggcuggugucgaacuccugaccucaggcaauccgucugccucggccucccaaaaugcugggauuacaggcacgagucacugugcccuaccccgaaugguuuuucuagaaaaacacacaaauaagauuuacauuuguuuaagaaaggucaguuuagucauagacuuucuuagaauuuuauuuuagguuuaaaauauuuuuaaugguccaagauugcuuuucagggguauuuuuauguggguauuugacuuccaugggguggggggacaauccauaagucaagggcacaggcugagcucuuaaaaaaaaucucaucugguuaucucacuuucaaucauggagauacuuaucucuuuuucuucuagagucaaaugaagagagagcagcuguuuuauuuuguugcuaugauagaaaggaucuagugugcagauggcaagcuuuauuuuguuugaagguggacauuugagguauggagccuaucugcuucagguuggcugcucaggcuaugcugagggcugcugccuuuguugguuucaaaucugauggucguugaaaaccugcauguuuugcugaauugaacuaauugagauuuagggauggucggagggaagccuuaucuauuuccauuuuagaaaaucagaauccuggcugggcacgguggcaaaugccuauaaucucagcauuuugggaggucuaggcagguggaucgcuugaggccagcaguuugagaccaguuugggcaauauugcgagaccccaucucuacaaaaaauacaaaaauuagccgggugugguggugugcgccuguaaucccagcuacuccggaggcuaauguggcagaaacacuugagcugggcaguggagguugcagcgagccaagauggcuccacugcacuuccaccugaguaacagagugagacccugucuaaaaaaaaaagagaaaggaagaaaagaaaaaaucagaauccuaauucauuugaugugugaagagugaagaguuguguaucuuuaaagcaggguauuuuaggugaauauuugaacaagugaaucccuuccugagacuuucaaagucagggaauguuuagguuagcuauuuuuauaauauauauacucuaaaauaaaguguucuuuucagagcauuagagccugggaaacauggcaaaguuguguauccuuuuuuaguuuaguucuugguuccagcugaauaauuugaacauuaagggauucugauucuucacuguggaagugggcuccugaaaaguaauuugcaacuugaauauaaacuuaauuuuuuuauuuuuuauuuuuauuuuugaaauggauucuuguucuguugcccaggcuggagugcaguggcaugaucucuacucacuacaaccucugccuccccgguucaagccauucuccugccucagccuccugaguagcugggauuacagacgugcaccaccaugcccggcuaauuuuuuguauuuuuaguagagaugggguuucuccauguuggccaggcuggucuugaacuccugaccucaggugauccacccaccuuggccucccaaaaugcugggauuacaggcaugagccaccaugcccaugccauauaaauuuuaaaccuagcagcuucugugacauuuugagcuuguuccaucuaguuugggaugauucacgcagaaaauauugcacaaucagaaguccccccauucccugaaauggaccaguucuccaacaaagcuuguuucuuggaauagugagcuggggguguugggagaguggaggaggaugcaucugcaaaggaugaauuuugacucugaggugugcacgugucauggugaaugaauauucuccagguggggagagcaaauuggugcauguaagcucugguaguagcauuuccauuuaauaguggagcaccauuacucaaacuuggcuucaugugaaugccuguguucuaguguagucagaaaggaauucuggauuaaauauuuauuugccauguacagagaaaacuguagugagagcuaguuauaggaguguuaaaugucuucauugcagaguaaagauugugaucaguuuggaaauacuuggguuacuuauuacacauaacucaguaaucucagacauuuauguagugcuuaccauguacuggacacucuuuaacgugcuuucauguauuaauguauauuacaacccuaugaggaaaauaccauuaauacuucuguuuuaaaaaugaagaaaccgugauauucagaugaugcaugacuugcccaaggucauagcugguaagugauggaggcagaauucaaacccaggcagcccagcuccacuguccacacuccauccacuacuuugcucucucuucauuuuguccuuugcaaggucguggguguacaaaguggaaaacuucuguccugacucaccuggaauauccaguuuacagaugugcacaaacccaguugcacuagaaucacccugccauaugccaacugccccaguggaaacgcagcagcuuccuggcagcacagacgugggaacacucaagccugcugcuagggcaagggaaggggucacggaagugcaauacugaagaaugagcagugaugcucugcuagauaaaucugggggaggcugcuggagguagugggauuaacauguauaggacagaauggccggacagaaccaggggaggacgggugguucaucagucacuaaggaugcucccccucuucuuggacaauucagaaagugccuugacaaaauacuuugaucaugaacuggcugcuaaguaagucauuauucagagaaacaagcaaagcuauucaguucaaaauccuguccugcucaagugaauccugcauuccccauccacacgcacucaacaacaacaaaaggacuagaaggauaugugucacuggcaacacugauuucucugaauggugcccuuauuagugguuuuagcuuuccuuuaauuacuuugcaguuuuggaauuuucugcaguguagguauucauuuuauaauuaauucaaaguuaaaaauuacuuuaugaccaaagccaguuacuuuuagcuaugguaugccucgcuguguagucuuuucagugaauucaucucaaggcaacuagacugaacuagacugaacuaaucauagauaaacugcagggauuaaaguuuacacaaaauugcacauugcuuguggaagagagaggagaaacuaaacccuccaauguucacauuauucaacuagaacugaggagaugaguugucagaaugauggacuugugccagcugaauguuccagagugauuucuacuaaaugguuaauggagggcagugagcggagggagggagcauuguguaaugcagcugcagguguuggcuuugucacccuaguuggguugcgcacucuccugaacugaccccaggggcaacuaggccguggcagcuguuccccaggccgaggccacgacuugucuuuagccagaugaugcccauugccagguccugccuguaggccccgcagucugugacaaggcuuuccuuuggccauucccgacucauucaauucccagcuuauaggaauuauuauuucuucuuuaggaugauuccaauaaauuuccauuaaaugacuguaacaguaaagauuagcuaaaugagagaaacaaaggcuguaaugagcuugcuguagcaagggagucagacuugcauauuggcagaggagaggaaagcuuuauuguggaaaaaagggaagccuuuagguguguucugauuggagguuguuuacaagggaagcugucugaggauuuacuagaagucgggcaacugaugugauugguuauggguacauguuuggcuuagccugguugguccuauguuggaagugggacaaaaauuagggaagcuaucaguuauuaaucgaguucuggccauuuggggccaauuguuagggaaguuguuguucgguuuccuggauugucacuagagauagcaaucuggcuuucucuguaagucuaacuuguagcaggcuggcuuccuugauuguuuauucuaaguaagcggguuaguuuccuggacaggugugggugaaaguucuauuuuuaaauauggucugguaauugucuauuuguauauguagucccucacagcagaaucuguuuuguccauauauauauauauauauacuuuuuuuuuauggugaaaagauauauauauauuuagaauuaggcagcuggacucaguuuagaugaucccaauuuuguuggcaacauccaaagcaucauaaucaggagccagucgaacauauaccuucuucucuccaucaggccgaaucaggguguugcccuuggccacaucauugucauagagcuucuucacagccuguuuaaucuggugcuuguugacuuuaacauccacaaugaacacaaguguguuguugucuuccaucuucuucauggcgacucaguggucagcguaaacuugaugauagcauaguggucaagcuuguuucuccugggggcgcucuuccgaggauauuugggcugucucuggagucgcagggucuuggaccgccggaaggugggugaugugcggaucuucuuuuuuuuuguggcuguggacaccuuucaacacugccuucuuggccuuuaaagcauucucuuuggcuucggcuuuaggaggggcaggagcuuccuucuucgcuuucggcgccaucuugugaaaaagcucuguuuuugucauuaauucucaauaggcagauuggacugucaccuuguugccuaauuguuaaauguuuacugacuacuauugaaagacacucugaggauauacuuuuuuuuuuuuucugagacagagucucgcucuguugcccaggcuagagugcaguggcacggucuuggcucaccacaaccucugccuccuggguucaagcgauucuccugccugagccucccgaguagcugagacuacaggcacgcaccaccaugcccagcuaguuuuuauauuuuuaguagagacgggguuucacuauguuggucaggcuggucucaaacuccugaccucgugaucugccugccuuggccucccaaagugcugggauuauaggcgggagccaccgugcccagugaggauauacauuugaauaaacauagucacuaucuccaaggggcuuacaucuuaccuucuuaauauaaauagaucagacagacaguuaaaaaguucuaggugccaugaaagcuguggguaaaaugucaugagcguucagaaaugaugugaaaugggauggaaagacagaguuaagaguuggaauauaucuucucaauguaaagaagcaaagaugaagcugggagcagugacucacgcccauaaucccagcacuuugggagggcgaggcggguggaucaucugagguccggaguucaagaccagccugaccaacauggugaauccccgucucuacuaaaaauacagaaauuaccugggcgugguggcgcaugccuguaaucccagcuacuugggacgcugaggccgaggcagaagaaucgcuugaacccggaagguggagguugcagugagcuaagucgcgccauugcacuccagccugggcgacagugagacucugucucaaaaaaaaaaacaacaaacaaacaaacaaaaacucaagcaaaggcaguaccuucacugagaaaaaggaaauggagaaaugcaaugugcaagacauaauucggcaagcacuugaauguuguugcgggaucaucccugauggaaucuuaaauaauuaugcuaucaauuauuugggggauauucagauaaaugucgaaguauaucaugguaaaaguggaggggugaaaauauuuguuuuaaaagugaugagauuacaggcugacaccuguaaucucagcacuuugggagguuaagguggguggauugcuugagccgaguaguucaagaccagccugggcaacauccugucucuuugaaaaaaaaaaaguaaaaaaaaauuuuuaauguguugaguccuaaaauaaauuaugaucaguuuuuccuuucuuauuaaaauuagaaucccaaacuagaaaucucagucuuggcugggcacaguggcucaugccuguaauccuagcacuuugggaggcugaggcggauggaucacuugaggccaggaguucagcaucagccugggcaacguggcaaaacccugucucuacuaaaaauacaaaaauuagcuggcugugguggugcaugccuguugucccagcugcucaggagucugaggcaggagaauagcuugaaccugggagguggagguugcagggaagagaagguugcagugagcugugauugcgccacugcacaccagccugggcgacagaaugacuucaucucaaaaaacaagacaaaacaaaauuaaaaaacccucaaucuugauaaaguaucuuuuuuuuuuuuuugagagaagucucgcucuuaucccccagguuugagugcaauggcucgaucucagcucacugcaaccucugccuccgggguucaaaugauucuccugccucugccucccagguagcugguauuaagucaccugccaccacgccugucuaauuuuuguauauuuuaguagagacgggguuucaccauguuggccaggcugguuucgaacuccugaccucaagugauccgccugccucggccuuccaaagugcugggauuuuccaaagugcuggcauuacaggcgugagccauugugcccggacuuuuuuaaaaaaaaaaacaaacaaaaccaguucugcucugucacccaggcuggagagcaauggcacgaucucggcucacugcaaccuccgccuccuggguucaagcaauucuucugccucagccucccgaguagcugggauuacaggcacccaccaccacagccagcuaauuuuuguauuuuuaguugagaugggcuuucaccguauuggucaggcuggucuugaacuccugaccucaagugaucugcccgccucagccucccaaagugcugggauuacagucaugagccacugugccuggacuauuuuggguuuuuuaauuuuauuuuugagauggggucucacucuguugcccaggcuggagugcaguggugugauuacagcuuacugcagccucgaccuccuggguucaagugaucucgcacuucagccuccugagcagcugggacuacaggcgcaugccaccaugcccggcuaauuuuuguauuuuuucuagagacaaucuuacuguguugcccaugcuggucucgaauuccugggcucaggaagaaauccuuccgacucugccucccaaaauacuaggaucauaggcgugagccaccuugcccgaccaacuuuauuuuuuagagcaguuuuagguucauggcaaaacugagugaaagcuacaaagauuucccauuaaacccacugccuccacacaagcguagagucucccauuaucagcauugccuaccagagcauuugcuacaauugaaccuacauuaaugcaucauuaucacccaaaguguuuuuuuuuuuuuugagacggagucucacuaugucacccaggcuggaguacaguggcacgaucucagaucacugcaaccuccgccuccuggguucaagcgauucuccugccucagcuuccugaguaggcgagacuacaggcaugaacuaucacgccuggcuaauuuuuguaucuuuaguagagacggggguuucaccauguuagccaggcuggucuugaacuccugaccucagaugaucuacccaccuuggccucccauaaugcugggauuauaggugagccacugcgccuggccucacccaaagugaagauuguuuacguuaggauucagucuugguguugcacauucuagggguuuagacaacuguaguauaacaucuguucauuauuaucauuuuuauuuuaaaacauuuuauuuuuauuuuauuuuauuuauuuuauuugagacaguaucuugcuaugucacccaggcucgacuacaguggaaugaucacagcucugugcaaccucgaccucuccggcucaggcaguccugucaccucagccuuccaaguagcuuagaccacaaggagaaccacagcaccuggcuaauuuuuuaaauuuuuuuguagacaugggggucucaauauguugcccaggcuggucucaagcuucugggcuuaaaugauucucucauuuuggucugccaacaugcugggguuguaagugugagccaccacacccagauccuauuauuauuauuauuuagagacagggucuugcacugucacccagacuagagugcagcgguaugacuauaacuuacucuaaccucaaaacauauucagugcuaucaaacugaaaucaauuauacuguauuauaaauauagugcuauucuugagggcuauuaugguacauaggaccauuugcccauacauaaagugcccuagacugcuuagcuuuugguuuuuggauugguguuugcuaucaccuuuguuaucaguggguuauuaagguacuauugccaaaucuccuucuacagcuuccuccaucugcuuccauucugcacuuauugagagucagauguagaagauaagauacugcuucaggcacuugguguacaaaagucaggagguaaaagaugauaaagauauccccagcuauagguuauaacuuauaaggaaauagauauugaauaguuugaugggucugcaaauaggauggagacuucgucugaaguuauggcaugagcagaggcauggaaguguggaaauacgugguuauuugagggacggugaauagaccaugugguuagaauguuagauugcagagggacaugaaaaacaagguauggggccacaauauggagggcucagagccaaaagggauuuauuuuccccccucuaaguaauggguagacaggaaaaguuacuauagagggaaguggaaggauugauccuguguuuugcagagugccucugagaucagaggagagggagggggagaagcgggagagggaaggggagccuccaaacuaaugcaggucuaacuuugguggaaggggagagaagcagaaugaagacuggguaggaagagucuuacaguacagaacagaucuaagagaguuuccaucaggcccacauggaguccuggagcuacagcugcccaugggaggagucuuauaucuccagagaaugaaugagucugcauuaguuuuccggcagagcuuagucacuggcuucgggcagcccaggagaagcauggcggguuuuuuuuuuguuuuuuguuuguuuguuuguuuguuuguuugagacacggucugguuaugucaccuaggcucaagugcgguggugcgaucucaguucacugcaaccucugccucccaggcucaagcgauccucccuccucagccucccuaguagcugggacugcuggcgugagcuaccaugcccggcuacauuuuguauuuuuuguagagauggaguuucgccauguugcccaggcuggucuugaacuccgagcucaagcaacccgccugccuuggccucucaaagugcuggaauuagaggcaugagacucaugguuuuggguuuguuuguuuuuuucuuuuugagacagagucuuacucuguugcccaggcuggaguacaguggugcaauccuggcuuaccgcagccuccaccucccagauucaagauucucccgccucugccgggcgcgguggcucacaccuguaaucccagcacuuugggaggcugaggcggguggaucacaagaucaggagaucgagaccauccuggcuaacacggugaaaccccgucucuacuaaaaauacaaaaaaauuagcugggccugguggcgggcgccuguagucccagcuacucgggaggcugaggcaggagaauggcgugaacccgggaggcacagcuugcagugagcugagaucgugccacuggacuccagccugagcgacagagugagacuccgucucaaaaaaaaaaaaaaaaaaaaaaaaaagauucuccugccucagccucccaaguagcugggauuacacgccuagcucauuuuuguauuuuuaguagagauggaguuuugcuguguuggccaggcuggucucgagcuccugaccucaggugauccacccuccuuggccuuccaagugcugggauuacaguugugagccacugugccuggccagaagcaugguuuuuguacagacguggugguugauccagagaggcaggagaugaggcugucagucaguuucuagaugggguagugauguugaugucauugauuaacagagggggaacagggagaaguggaagaagagauugggucuugcuugagcagaauuggguuugagguauucguggaacaugcauuuggaaaaguugaagcaaaaguugcaaaguagagucuagagauccagagagagaagagauggaguugcagauuuagugaguuuuccgacaaauucaugagaauuagugaaauuucccagggauggaguguggggaagaaagaaaagccaggauauaaggaaauaaaacaugcagaaggagagaggcagggcagucugagaugaagucaucagaggcagaaggauauauuuucaggcagggaguuacggaccccugugucguauucucgaccuuucuuaggcagaagagggaagaaagucugcauaaagacauaaggauccuccgaggugggaggaguugaggggcugcauuucugacgaucucucugcaugagagacaggaaggcugagacugaguacuagggaaaagugaauuucagaagagcuauugugugcaucuggguggcgaggacccuugaucggucugcagggagggucugcugagagcaucuggguggcgaggacccucgaucggccugcagggagggucugcugagauugaauagcgggaauuuguaaggccuguuugaguguccuccaccccaccaucagucagugacuuggaagcaggaacagagaaauguggugacugaguucagccgaggggaggacuucaagguccacuagucagcucagugagguugagagagagguggggcagccccacccacauucugccugcaagcucagugacccgccucaggaggcugggagugagggcccgggcugaaccggggcgcgugcuagagaauagggacgugagucgcugugggcgaaucuguguugugacuucuauucuucauguccucuuccccacuccaucaaauagcacugugccuugcuuaaacaagucucaguuauacgauguacggauaacuuugaucucauuuugacucaaguuugcuuuacuuuuuguaaguccagaguauucauacaaaaaugcaaacugagaauuuuaguaagaauucucaaugccuguaucaucaacauacuaacugacugaacaaugaagaaauaaaauuuugggaagucugaaauuauuguagacacugcauuauuuuauacaacuuucuuaauagcugcagguuuccacugauaaauguuucucugaggcucacacauuuugggauguaguugaaccaaaugugagaacaauuuaugcauugauucaucaucaugagucugugaugggugaguuccugggcuagccauacgugaaaguuuaggugaauuuucauugcaacacauugauucaccuguauuuucugagcauuuacuauaagagauuacaauuuacuuggugugauucucgguuggacugcaaauuucuccauaugacuuuuuuuugaggcagggucucacugucacucagguuggacugcaguggcaugaucauggcucacugcagccucaaccuccugggccaaacagauccucccacuacugcagcuuccugaguaucuggacuacaggcaugugcuaccacauggacuaauuuauuucauuuuguagagacgggggucuugcuguguugccuaggcuggucucaaacuccuggguucaaaacauccuccucccuuagccucccaaauugcugggauuacaggcaugagccacugugcccagcccauaugccuuugaucuauaaaaaauuaucuuuuucucaagcaugauacacuguuugaguuggacucuuaggacacagucuucccuucuuguucuugcucuguaggccaugacaauguaccuuuggggcagcaaagagggaaaacaaauccucugggaccugcacugauucucauuucaaacucagcauuuggccugaauacauaggucagcugguauuccagauaaauacuaugaauugcaauguuucucuguacauuucuuaacauuuguagauuaaaugaaaaggggccucccacaggaaggaguaugauccaaguucaaggaguaaaauaacaagacauaucaucccuugucccacuccccacagugaauguuguuuugguuuugcuacagcugguagggucuugaagcuaugcaucucucgggugaucaggaagagcugcagagacugcucacucauacggagacaagggaccaaggagucaucagaaacauagaugggacacgccucagcuccuuuugaguggagguguccugaggagagcgguaaccccugagggucaggaaggacugaaugaggcgugguauuaauuggcugagcaagaagacagggaagagccuggcaggcuuagagcaaggagacucagagccccagguugggccugcgugccgcugcccugaccauauccuuacacguggcacagcucugcuggucugcaaggguuuuagguucaguuuccucuguacgcugugcagagcguagcguauggauuggcuuggcuuucucgaacgauucaacacauuccgugauucagcugacuuggcuagugaaacccuccucugcccagggaggaaacuugacaaguaacagggaguuggcucuauggacugcguaagugggcuugauccagguggcuaugggggagagaaaggagugcuauaaaugacugggugauguuggggaaaggaucagcaugcagauggaaucugcuuccaaauucugacuucccuucagaaagaugagaaaguccugccaugcugucauucauggucuguuuaucuugauugacaccccagccccaccccaugguucccucucagcuucacagcugaggauuaggauguuggcaagaacaaucugcccaggcagucucuguccucacauucuggccccagcuuuccccuuacccucuagcagagaaaggccuuucucaaacuggugacauugggcaaauucaaauaugaguguguugguuuucaguccugaugauuuccuuggagaccuuuuccuagugucuugccaagcacauggagggcgaagagugagggaggcucugacgcgguuaguggcugcugugugugaggcgcugcuggcugggcuccccagaacauggucuguggauggccuacugaugccugggacugaugggauguacacccauguacccauguauuuuacaaggaggauuucauucuacaugcaacauuuuaauuuuauuuauuuauuuuuuuucugagacagagucucgcuuugucacccaggcuggggugcaguggcacgaucucggcucacugcaagcuccgccuccuggguucacaccauucuccugccucagccucccaacauuuuaauuacaaauacacaauauaggcacauuguucaaaacucaaaagcacaaaaauauauacagggagaccaggugggguggcucaugccuguaaucccagcacuuugggaggcugagacuggaagauugcuugaguucaggaguuugaaaccagccugggaaacauagugagaccuugucucucuuaaaaaaaaaaaauauauauauauacauauauauauauauagugaaaagcaagccucccucccacaucuauuaucuuguauuuauuaucaauuucuugugaaucaucacaaagauguucugcuaauauauaaacagaugcacauauaauuauuuuuaaaauauaaaugauaacaauauuguggguauauauauauaugguguaaaacuuuagguauagcauuuuuagauugucaaagaagcaaaaagcaaaaccugaauacauuuucccuuauaauugaggccaaaagaaauuguaggguuauguuugggguaauggguuaaggaugggaaacaaugugugcauguguguguguguguguuuaguuguagcagguaucuugacucauacagauugccuguccauuuuaaugacauuuuuccaguucuuguggaaauucacauaaacaggauauuaaaaccuaguccuaguaauguauugaaaauuuaacagcuacuugggggccgaggcaggcagaucaccugaggucaggaguucaagaccagccuguccaauauggugaaacccugucuccaccaaaaauacaaaaauuagccgggcaugguggcaggugccucuaaucccagcuacucgggaggcugaggcaggagaaucgcuugaacccaggaggcggagguugcagugagccgagaucgcaccauugcacuccaaccugggcaacagaagacuccaucucaaaaaaaaaaaaaaugaauauuuaacagcaaaaucaucuuauugcuauuggaaaguauuuauuugaugcagugguuagugcaaaacuguugcuauuuuaggcgcaguggcaaaggaguugcuauagaagggcucuuauguggaaugauguaaagaggaagcauucauucuaaauucugagaagcagaauuuagcaagcagaagcagcgcaaguucuuaccugcagauucuuaggaagugaugccuagaggccacugaacucuguucuugguacauuaggaccaggagauuaugcaaugcucugaggcagaauaaacaaggucagaagcaggcauuuauucugcaagaaaagaauuuacuguguagguuccugaaggauugccugaauuccuucauggcugagagugcaaaauaaugcacagcugcuggcugcccugcauagcuguaggcaaggauccggaagaugccaucuugucuccaaguguuucuuuuucuuuaggcagggucucacucugucacccaggugggagugcauuggugcaaucacugcucacugcagccuccaccucccaggcucaagcaauccuccugucucauucuuugacuuuuuuuuuguagagacgaggucucacuauguuggucaggcucgaacuccugggcucaaacaauccuucugccucggccucccaaagugcugggauuaacaggcgugagccacugcccccagccuucaagcguuucuuaauggauucccccuuuucucauuuggucucuuuccccccugguuaguuucauuguaguucauguucaggaauuaggcuugugcacaggagcaagcugguuuuguccaguugaaaggaaaagggugaggaaugugcucugcugugagcuuugcucuggggggaaaaucuaguuuucuuuuucccuuuucccauuugcuuuccaagguuuggauggcacaaucaccuucucagaaugcuucuuuuacuacucaggaggaaaaggcugccacuuugggauugaaggaccccauacuguuuccucuagaaagguagcucuuuuccacgggagaagagguguacagugguaggaauuguguccuuaguuaggauuugggguuuuauuuagacaucaucaugucccuuaacuuggacuuagacacuggauucugugaaguucaguuucagguugguucagcagguagaucucugaucauggacuuuucugucuucucuccuuuucucugcaucuauugcuaucuugacaccaaaguuacucaaacucugggcuucuagguacacuggguuuguucuccugcagaucuggccaaagugauauuucaugagugggucugagaaauggcaaccagugaacaaacauuugaaacaauucagacacucacuaggcuguauguuuggggaauucuuuuuauuauauguggguguggaagccugaggucuuagauuuuaucacaguaagaagcagcuuaccccucuguucaucaagucacagacugucuuggcuucuagcugggaaguuuuuguugggaaguuuuguaguguugggcaauggaugagugaauggaaagaagcgugacuagggaccuacucuuaauggcucgaaaauguccauuaacuuguuguauaggggacagcucauucuauuaacucacuuuguucucaacagaagguaaaauugggcauaacuaccaagcuaucaugagaaccaauccaggaaaacucauuagucccaagcuggauaggggcagaguccacaggugcuugagaaguuugggugguccuauagagacuagaguauauauuuaucaccuuagaaacuucuuugucucauguuugacaguuuuuaugcuucugggucuuacagauaauuaauauuuuguucuuuauuuaagcuaguuugccuuuuuuuuuuuuuuuuuuugagauggagucucguucuguugcccaggcuggagugcaguggcgugaucucggcucacugcaagcucugccuccuggguucacgccauucuccugccucagccucccgaguaggugggacuacaggugcccgccaacacaccuggcuaauuuuuuuguauuuuuaguagagaugggguuucaccguguuagccaggauggucucgaucuccugaucuugugauccacccgccucagccucccaaagugcugggauuacaggcaugagccaccacgcccggcccacuaguuugccuuuuaaaaauuucagguauuuaauuaaaguguguaagacaucaguggcugcucugcaggaugcugauuuguaucuggagacccagaacugaugaauugggccaguggguuccuggcuggucuaauguggcaucuucucuuccuuacuguuugaggacauggggcagggcaugaccagugccugaguggcagguggugacugaagggagggagaugggaacugggcuguagucagggcucucucgcaaggggcuugaccuuuaccuauuaccuccuggacaccugugcggagagguaugagagaauggguuuucuugugaaaggaaaauucaaaucucucuuuacuugagagucuagggacuucagacaucaccaucccccauagcagcucugaugauuuucacauuugaaugaaacacuugaaauuuuuaaaaggccaauuaguauaaaugaagaacaaaauaauuaauuauaaagacccacagucuugaaacacaguggcaggcaccaucuuaguucuuguguuucuucuucugucaagugaaaaaauaaacuaccauuuuuaucuuccgcaauacucccauucaauugagcugcuucuuuuuauuuuuuaucuuuuuauuucaauccugcuccuucuguagucaauugcgcuucuugacuggucuccuggagcuaauugucaggacugggguggugccccacccccuuccugggauccuagccuucuccuuccuuugggugagauccuaucuacuccuucucaggagguggccucugcugcagacccauaaaacuuuaacccuaccuuuccuaucagugagaauuaacauaacagcuagggcuacuaucacaggaguggaaaauaaaccauaguaaagagaccuuccaaaagucugcaagcaaaaucuaaacacauuugagcaccucucuauggggcgagagcauagauuuuugcugaaggcaggcagagggguggcauuuuguguucucagagggaagcgaucuggaguuugauuuaguucaggauucuucucagcuucuagccccgagcuccagggcuucuaucaccuccaugacuuuccugaaucugaguccuugaagugcauuuuucagaaaacuuggguccuacucuuccccuuccuuugggugagauccuaucuacuccuucucaggagguggccucugcugcagacccauaaaacguuaaccccaccuuuccuaucagugggaaugaacauaacagcuagggcuacuaucauaggaguggaaaauaaaaccauaguaaagagaccuuccaaaagucuacaagcaaaaucaaaacaacacauuugagcaccucuauaugcagcgggagcuagauuuuugcuacaguaccuagugagggacuguaauuuuggcucuuggcacaauagccaaauuccuaucccucuaauccuauugugucuccuggggcuggguaugaggaaggagaguccugcacuggaagaauuaccuuagcgguuucacuuacuaugaggacuguugguuucaguaacccuuuuggcucccaucaauguccauuuagcuauuucuaauuauuucaacuacuauaauauuauuuuucuccaggcaugcagccaaauaaagucagccauugaguugguucucucagccgugcugcuuguggaacaacgugacugcaaggccauauugcuucccuuucccaugccaggccgugugagugagagagcaaucagugcaaaucuuugggcuggauaacuggcggugcugguuugaccuccggccgggucacugagggauuguuggggaggcugcugcaccccucugcacagacuuccaacauaucccagaaccauagcaccagcucucuuaagccagaggauaauguuaguuaguaaagagaaugaugcuauuggggucgauuacuuccacuaguagaaucuuaaugaugugugggaaaccaugucucuggcaaagugcuggaguucaccugagccuuuuuuuuuuuucuggagacagugucucgcucuguugccccgguuggagugcaguggcgugaucucagcucacugcaaucuccgccucccugguucaagcgauucuccugugucagccucccaaguagcugggauuacaggcacaugccaccaggcccagcuaauuuuuguguuuuuaguagagacaggguuucaccauguuggccaggcuggucuugaacuccuugaccucaagugauccuccugccucagccucccaaagugcugggauuacagguguaagccaccgugccccaccaaccugagccuuuuuuaacuggccagcugggcccaagaguauuaucgugucuccuaaaaaugacugauacaguuuuuuuaauuaguuuccuauggcugccauguaauauaguaccacaaacuagguggcuuaaaacaacaggaaccuguucacucccaguuccguagucagaaaucaagauguuggcaggguuggcucauuucuggaagcucugaaggagaaucaguucccugccucucucccagguuccuuggccuguggauacauugcuccagucucugcugccaucaucacauggcauucuucuugcaugugugucugugugucccaauuuugcucuucuuauaaggacaccaaucauuggauuacggcugacccuaauccagcaugaucucauuuuaacuugguuacaucaguggagacccuauuuucaaguaagguuauauucagagguaccaugggguuaggauuucaaagcaucauuuuugggaacacaauucaacuuguaacacuccucuuauccaucucccuccuggacuauagugcuggccucuuacuguaucucccugggccggggucuccccucagugaccuuuccacaccaucaguagaauuaucuuacuguauuguaaaaagaaucauacuauccagcuuuauuuccaaaggcuaaacucaguuugacagacagagcccuucacagacuguugucauuggagagcuggaccaacgcagaacagggaccuguccccccugcacaggaucauaauugaagccggacucgccuacaaggcacugcuaauuaaucuuuccuccuacugggcgucugaaucauucugccccuaagaagauuauuugggaggugauuggacuuuuugcaugauuguuccuagggauguuguccuugccuaucuucucagauguggguuuauugcauuuuuacuuauuuccuaaacuuucaauggaagaaggcaagaucaucuuccauaagguaguuagauuauauuacucaugaaacuaauaacuucaagacucucuuuccuuacucuacuguggcaaaguaccauaucucucucuuuuuuuauuuuuuuuuuuauugaucauucuuggguguuucucucagagggggauuuggcagggucauaggacaauaguggagggaaggucagcagauaaacaagugaacaaaggucucugguuuuccuaggcagaggacccugcggccuuccgcaguguuugugucccuggguacuugagauuacggaguggugaugacucuuaacgagcaugcugccuucaagcaucuguuuaacaaagcacaucuugcaccgcccuuaauccauuuaacccugaguggacacagcacauguuucagagagcacaggguuggggguaaggucauagaucaacaggaucccaaggcagaagaauuuuucuuaguacagaacaaaaugaaaagucucccaugucuacuucuuucuacacagacacagcaaccauccgauuucucaaucuuuuccccaccuuucccccuuuucuauuccacaaaaccgccauugucaucauggcccguucucaaugagcuguugggcacaccucccagacggggugguggcgggacagaggggcuccucacuuccccguaggggcggcggggcagaggcgccccucaccucccagacagggcggcuggccgggcaggggcugaccccccaccucccucccggacgggguggcugccgggcggagacguuccucaccucccagacggggucgcggccaggcagaggugcuccucacaucccagaccgggcggcggggcagaggcgcuccccacaucucagacgaugggcggccgggcagagacgcuccucacuuccuagaugggauggcggcccggaagaggcgcuccucacuuccuaggugggauggcggccgggcagagacgcuccucacuuuccagacugggcagccaggcagaggggcuccucacaucccagaccaugggcggccaggcagagaggcuccucacuucccagacgggguggcggccgggcagaggcugccaucucggcacuuugggaggccaaggcaggcggcugggagguggagguuguagcgagccgagaucacgccacugcacuccagccugggcaccauugagcacugagugaacgagacucugucugcaaucccggcaccucgggaggccgaggcuggcggaucacucgcgguuaggagcuggagaccagcccggccaacacagggaaaccccgucuccaccaaaaaaauacgaaaaccagucaggcguggcggcgcgugccugcaaucgcaggcacucgucaggcugaggcaggagaaucaggcagggagguugcagugagccaagauggcagcagcacaguccagcuucggcccguggaaagagggagagggagaccguggggagagggggagggggagggggaccauaucucuugugaauuuauuuccugggaaagcauguggagugcggagugugugugugugugugugugugugugugugucugugugugugugguggagggugaaaguauuuuacuugaggauaaagauugaugcaaauaauauucagauagaguucaauaggguuaaaacaauguuaagugucuuccuugccaguuugcugucuuagguuuugcuuuaccuacguuuuucucugauagaggaaaaauaaaauaaucaauucccaggguuaagugacugaguccccaagaagaucuuaaagaagacagccauuugccuaaguaguuaaaucccaguuaaauuuuaguagcaugaucuaucucuaugcagagagguaaagaaagaaccaaaugaugucauuucuaucuaaaaaguacccuucaguggcagggcgcgguggcucacgccuguaaucccagcacuuugggaggcugaggugggcggaucacgaagucagaaguucgagaccagccuagccaauauggugaaaccccaucucuacuaaaaauacaaaaauuagccagguguggugaugugcgacuguagucccagcuacucaggaggcugaggcagaagaaucgcuugaaccugggagguggagguugcagugagccaagaucgagccacugcacuccagccugggugacagagcaagacucccucucaaaaaaacaaaaaaggacccuucaguauaagagcuguccauguagcagcucucaacuuaguccagugaguuaaagugugagauuggauuaguaauccuuuaauuuaaagucgugugaccucagccaagugaccgucuucaauccucaguacccuaggcugugcgaaaagcauaugguacaauuccugguggaauaauguucaauaaaugucaaaugcuauuauuauuuugugauuauaugaaugacccgagaaagggucccaccugcauccaaguacauuuauacuucuuaauaaccaaagugccuucaugagaaugcugguagaaacugcauaaggguguguuuuuuugcuuuuguuuuuguuugagaugggggucucacucugucacucagguuugagugcagcggcgccaucuuagcucacuacaaucucugccucccaggcucaugugauccuuccaccucagccucccaagaaucugggaccacaggugugaaccaccaugccuggcuaauuuuuugccuuuuuugguagagacgggguuucaccgccuugcccaggcuugucuugaacuccugaccucaggugauccgcccaccucagccucucaaagugcugggauugcaggugugagccacuguucacagcccugcaugagggucuuugauuacaacugauauuuucuauuguugagugauggccuuuuuauaaguugcccuuucagugacacaaaggaggaaugugcaacugaguagaacaauuuuagagaaaauguagauuauguguuaauuagacugaagcugugccuacuuccagagaguaugaggcaguuuagaagguaaaacacaguauuuuacugggaguaagacagaauuuuuauuuagcguauauacagcagaaauagaaagggaacagaaaaagccuggaaugaggcaaguguuaaaaugggcaguucuagcaaacagaaccgaauaaggaacagucaaaacagugaugggggggccaaccuugaggagaaauugaguguuguuuggggacuuuuuuuuuuuuugagaugucgcauacaguacuuaguguugguuggauggaugacucuuacauuuuccauauaguuauucugucauaaauacucaaacaaaaugagggauuuaaacuguaauuagagcucuuuucugagacaucugucuguaacauuucucuuuuucccacaauuaggugaaaaugaaauccuugcaacucugcaugccauuucaagcaaaaaccagaucuggagaucguauauuggcaugggcuauuauaacugcucagugccacagacgauuuugcggaacuuacuggagaacucaggaugguaauguauuucucaguucaggaacaggaugacugugauuugcauaauucucuccauccuccaucuguccccuugcagucucagagccuccacacugacacccaccuccuagugcugucuccaauguccgggaaccuaccggguuucucuggaucgagaaauguucuugcucaaauguugaggaaauagaaguuucuucccacuuccagucccauaaaaucuacuaggaugcuaaauuguggaucuggucaucucuuccucuucugcagcuuaauuucugugcuguauuugaguaagaugugaaaccugcaggugggcagauucaggccuuuacuccuccuuggagacccugggacauaggcuacuucugagcuaucucauugagucauugguggagucugggagagaaucuugguccacugucuucucucaggauuccccgccuaccacccugcccagacggagucuugcuguguaucccagucuggagugcaguggugugaucuuggcucacugcaaccucugccucccagguugaagcaauucuucugccucagccucccaaguagcugggauuacaggcacccacaaccacccccggcuaauuuuuguauuuuuaguagagaugggguuucaccguguuggccaggcuggucucgaacuccugaccucaggugauccgcccgcuucagccucccaaagugcugggauuacaggcaugagccacugcgccuggcccuucugucaggauuuuuaagggggacagauaauuguguucccuuccccucccacccccaaaauuuuugauucacaacugacugacaaaaagacaugguguuggagaucauaauaucagcuuuauugcuagcacuuucuagagaaagagaacaugugcauucuguagacaggcucuucuagaaaagauaugagagaggccugagcuaugcaugcucaguuacuuauuccagucuuaccucaacaguuagauaagucacuccuacuucuucuuuuuuuuuuuuuuuuuuuuuuuuuuuuuugccugagacagagucucacucuguugcccaggcuggagugcagugggaugaucuuggcucacugcaaccucugcccuucgaguucaagugauucuccugccucagccucccgaguagcugggauuacaggugccugccagugugccuggguaauuuuuugcauuuuuaguagagacgggguuucaccaucuuggccaggcuggucuugaacuccugaccucaugauccacccgccuuggccucccagagggcugggauuacaggcgugagccaccgcgcccagccaagucacuccuacuucuagggguguguguguguguucaucugugucugucuccuguccacucugguccucacugauuguguggugugugugugugucuguccauccaugucugugucuccugcccacucugguccucacugauagaacaacacugaaagcauuucuccugcauuugagaaaauacuucuaguccacuuccaugcuauuuuguuguuuuccauugcuguuugcuguaugauguaaagaaccaaaaaggccaggcaugguggcucacaccuguaaucccagcacuuugggagguugaggcggguggaucaucugagacugggaguuugagaccagccugaccaacauggaaaaacccugucucuacuaaaaauacaaaauuagcugggcgugguggugcaugccuguaaucgcagcuaguugggaggcugaggcaggagaauugcuugaaccugggagguggagguuguggugagccaagaucgcagcauugcacuccagccugggcaguuaaggacaucugccucugcuguucacugggauauaaugucuaacuguggaggaggaaagguggggacuccuaggcucuuuuuucccaucuuuuuggauuggugccauuuuauacaccagaaacacugaguugaaauuuuauuucaaaugaugaauuagucuuaaaaggaagacaucuuauuugaaaauauagguguccacuuuucauuuccagcauggaaacaaaucagacauagauggaguauggugauaauuccuaggugauuuuuuaaaaguuaguuuguggaagagguaacuuuaauuucuagcaggaucaucaugacaugaggacagaguaagugguugccucugcaauucaaaguauuccuagcaaggggcacagauuggcuuuuagauuaacauauguaaaaaccaacuuuacuuaagggaaugcaggcuucacuaagugggaaaucauaaguuguaccaacaggagcuuuugaaauacccaaguacaugcucccaaucaaugaguguuaacaauuugauaaacacuuugcaucuuugucugcuuuuccaucauugcaaauguaauccuggugggugcaugugcuuugucguagaugcaauuauuuuuaucauaucauuauaggagccagaucucucagcacaaucauuccaguauugcugucccuguacauaacucuuaguuucaauaugcuccacuuuauuaauaaggggacaggaaaaucaaagaacuaguuucucuguagcgucugugaaugcguuugcauugaugaaggcuucuuuuucauugugguauugguaaaaauuugaaugguaaauuccaagguuaauuucaaaagaaaauggccuguuucucuucccccuuaagaaaagccucaaaaguacaugaacgggcugcagcauuccagccaucugaauacuggccagcagccuuugcucuugguggccauaaagaauauucaccauauugcuuucuggcugugggcggauguuaauuuaccguaggagcagccaguguuuugagaaggagaugauguuguccuguacuuuucauuuacuuuucaggugcauuuuaaauacuauuucuuucuauucucugaaagcugaucugaaccagagagugauauuacaccccaccagcgcugauagggagggcugugcacaugugggugguagauuucacauuaucauccuucugaaugguuuccauagagauggaaccaacaaauuccggagacgugaggggaaaauaaauggaugacauagccucgaaagaaaacaaacauuugggcucuugaaagaaaauuuacaucaggucuagaauuuauuuuauggguuucacuauuccaaauuuucaacuacugauaacaucagaacauuuacauauuccuuguagcuauuucuguuugguauauuuuugucagcaggauuaaaaugagagaaucucaggaguguuuguccugcaaacccccauaacccccuuucccaauuccaaaagaaagucacagccaaaaugauagagaacacuaauuauuuuggguuaaauauuaaugccauguugaauauaucaagcauccuauuugagcugaacuaaaugccuucuuggaugugcagauaccuuuuuauauguuaaaauauauuuaggaacaaaccaguugaauuagucauuuggaacauagacauuauagaugacaggcauguuuucuuaaucacuauguuuuaccuaauugagucaaacucuuguaaacaugauggcaggccuuuugauaguauuuuucuccugaaaugaggguuauuugucaucucucagauccaaggcucacuguccuuuaauagaucauuguuaagagcauuaacaccuguuuaauuucaguagugccaaaaaccucuagacuaauacaagaaguuuacauguaaaaggagugagauuacauauuuggcauauuugcaagacaacaauuuuaaaggucucuaccuuuagcaaugcuaaauaacauuaaccucaccuuggacuuaugaaaggauugagagagaaauauuacauaagggacagaaaagauguaacuaauuugaauaaauaguuuuuaaguggaaauauguaauaauaucuaaacagaauucugcagaagugcuuuuaggaaaggucuaucagcauaugcuuuaaaaacuuuuuuaaagaugaaaacgaaaaaaacuccaacuuuucaagagccaaugggucauugaaaauacugauccuaagccaggcaugguggcuugugccuguggucccagcuccuugggaggcugaggcaggaagaucaugugaguccagaaguuugaggcuguagugcccaaucaucgcacaggugaacagccacugcacuccagccuggguagcauagcacaagccuguauacaaacaacagaaaagaaaauccugauuaggccaggugcgguggcucacgccuguaucccagcacuuugggaggccgaggugggcagaucacuugaggucagguguucaagaccagccuggccaacauggcaaaacccuaucucuacaaaaaauacaaaaaaaauuagccaggccuagugauaggcaccuguaaucucagauauuugggaggcugaagcaggagaaucacuugaacccaggaagaggagacugcagugaguggagauugcaccacugcacuccagccugggugacaguuagacuccguuucaauaaaaaagaaaauacugguuauauacuaggucuuuuuuuuuuuuuuuaagacaaggucuccgucugucaccuggacuagcguacaguggugcucuaauagcucacuguaaacuggaacuccuuggcucacguaauccuccugccucagccuccugaguaggugggacuuacaggccccucgccaggcuaauuuuuuuuuuuuuuuaaauuuuuaguagagacaagguuucucuguguugcccaggcugaucuugaacuacuugccccaagagauuuuccucccaaagugcugacaggugugagccaccacaccuggccuguauacugagucuuaaaacauacacagacacauauagacagaaagcuagggauuuuaaaaguuuuugaaugucuuaugaauucaaaauaacuuacagaugcuaauuuacaguugcuauuauucacuugaauaaccuuuggacaguacauuagucugauuugagcauuaagaaaaaucucucauauaggugauguuauuuccauugagaggcaagagauauuggcuagagcgacguuuaguuauuuaucccaguucacaaguacacucaugcccugcguagugauauuuuggucagugacagauuguguauaugacaguggucucauaaaauuguaauucuguauuuuuacuguaccuuuucuguauuuagaaacacaaauacuuaaccauuguuguacaauugccuauaguauucaguacaguaacaugcucuacauguugguagccugggagugauaggcuauaucacguagccuagguguguaguaggcuauaccuucuaaguacacguaaguacacucuaugagguucacacaacaaugacuaaaucaccuaacgauguauuucucagagcauauuucuguuaagccaugcaugacuguagaaaauuaauaagauuaaggcuuggcacaguggcucacuccuguuaucccagcaauuugugaagcugagguggaaggaucacuugagcccaggaauuugagaccagccuggacaacauagugaaacccugucccuacaaaaaaaaaaaaaaaagauugaaacccagggcuucagcugggcgugguggcucacgccuguauucccaacauuuugggaggcugaggugggugggucuuugagcccaggaguuugagaccagccuggccaacauggugaaacuccaucccuacaaaaaaauauaaaaauuagcugggcgugguggugcaugccuguagucccagccacucgggagguugaggugggaggauugcuugagcccaggagguggagguugcagcgagccaagaucaggccacugcacuccagucugugugacagagcaagacucugucucaaaaaacaaaacaaaaaccaaaagccagugcuucuuaauacuuaguaguuuugaagaugcaaggauaucugugaaucacuguaguguuuaagagaaugcagacagauaugcucuuucuggagaggaacaugguacuaugcucugggagccuuagaacuaauuaucagggugggcgugauaauuacacaugacucacgccuguaaucccagcacuuugggaggccagggugggcagaucaccugaggucaggaguucgagaccagccuggccaacauggugaaacccuaucucaacuaaaaauacaaaauuuagcuggguguggugucacgcaccuguaaucccagcuacucaggaggcugaggcaggagaauggcuugaacccaagagguggagguugcacugggccgagaucgugccacugcacuccagccugggugacagagcaagacucuaucuaaaaaaaaauaaaaaccccaaaaaacuaguuaucauauauaauuuggaauucuacuucuaagaauguauccuuagacaaagauaaagaucuuaacuauuaugcuauuucuaauauuugaaaucaaaaguauucaacuggaaggaacucguuaaauaaaucaagauuuaccugaagaaauuauaacuuaaauaauuuauuucauaaguuauuuaauaccauagagcaguuaaaaucauguuuuugaauaguauuuaaagauguuauguuagacauuguucauggaauaauguuaacugaaaaaaguuaagauacaaaaacuucuuuuauuuuuaguagagacagagucucgcuauguugcccaggcuggucucgaacuccuggugcaagugauccucccaccuuggccucccaaaguguugguauuacagaugugagccuccacgccuggccaguacuacuuuuaguauaaauagauuaugauguagaaaagagauuggaaaaaaugcaccugaauguuaacuguaguuauguuaaaguuuggaaauuaagugauuuuauuuucucaauaguuaucuggauuuuccaacuuguuacaaagaacauguauaacauaaucauaaaaaaggugguaaauguguuccugacccauaagagaugguuaaugaaugguagcugguuucuuuaacauuuggaacauacaauaaaaagaaaauuuaguguuaaucaucuuaccucccagagaaaaccagcuuacauuuugguucaucuacuuguuuuuacaaacuuauaaaaacgagaacguuuuguauuuuauguauuuauuuuuugagacagagucucacucccgucacccaggcgggagugcagaggcgugaucauggcucauugcagccucaaacuauccuccagccucaugguuauuuuuuguuuuuugagauggagucucgcucugucacccaggcuggagugcaguggcaugaucuuggcucacugcaaccuccgccuucugguuucaagcgauucuucugccucagccucccaaguagcugggacuacaagcacgugccaccacacccagcuaauuuuuguauucuuaguagagacgggguuucaccauauuggccaggcucgucucgaacuccugaccucgugauccgccuccucagccucccaacgugcugggauuacuuacaggcaugagccacugcgccuggccugauuuuuuuguagaggugaggucucauauguugcccaggcuagucucgaauuccagggcucgagugauugcccaccucagccucccagagugcaaggguuacaggugugagccaccaugcccagccuccaucuacuuuucuuucauuacuuuucuuucuuucuuuuuugaaagcuuugaaaccaacaucuucuuaucuuugacagggagugugguggggagguugccuuuccaagcaguacaauaucgagacuuugaaauaauuuccugagacuuguauugggguguuggugugcggcuauguguaugugugugagugugugugagagagagagagagaaagagugugugugugagagaguguguguuugugugugugugugagagagugaguguguguguguguauacaacagaauggauuuuugcuugaagagacuggcuuagcaacuguaaauuaguuugccagauucuaaguggguggugaacuggaaugaaugaggcacacaauacaugguguaggcaaauagaaagggaaaucugaacagaaauggggucauacaaaaggcauagacaacaggcaggcaguugugaucuugaaucagacaagaucuacacacauggcuugacaccgugaagacagauguggcacuacuccagccaagugcuuagauugcuuggguaauaaaaaacuuucauuuuacuuggaaucauuauuugucauguagaaacacauacacaugcaggaauacacacauacaaucuaguccaucugauaaauaggaaagacuuaguauauccauaaagacaggcacaagauauacgacaggaagacagagaauaauguuccaaagaauucaucacagcacagaaaacaacagaaaaaacaagcagugucugcuaaaaaggaaaugauaauuagacagugugaauauaauacuaugcauucauugaaaaugaugcuguaaaacauauuugcugaugugggagauguucaugauguacuaauuuuuuuuuuuuuuuugagacggagucuugcucuguugcccaggcuggaguacaguggcgugaucucagcucacugcaaccuccgccccgcggguucaagcgauucuccugccucagccuccugaguagcugggacuacaggcacgugccaccacgccuggcuaauuguuuguauuuuuaguagagacggguuucaccauguuagccaggauggucucgaucuccugaccucgugauccgcccgccuugaccucccaaguaaaauaggugaggugugguagcucucgccuguaaggaugaaggaacuaaauuggcuaacugacauauccaaagccacauucuuggcuaauaauugaaggagauaaaguuagaauccauguuuacguugccuucuaaacauuuccauccuggaauuucaauagccauagaguuaacugccauggacucuuaguaacuggauaaugagaauucuuaaguagaccucuauuaauuucuuagcauguagaacuucuccugguuaacauaaaacaaauauccaaauaaauaaauaaaauguuugaguauuacauguuagauucuuggaugcuuuccuauuguaaaaugugaaugaggucuuuuaucuaggggaaagauaauagcaaaugaaauuucuguuuaugauauuauagguagccucaagugcaguggcucaugccuauaaugccagcauguuggcaggccgaggcagguggauugcuugagcucaggaguucaagaccagcuuggguaacaugacaaaacccuggcuguacaaagaauacaaaaauuagcugagcgugauggcaugugcuuguugucccagccacuuuggagacuuaggccagaggaucucuugagccuuguacauugaggcucagugagucgugaucaugcuauugcacuccagccugggugacagagcgagacccugucucaaaaaccaacaaacaaaaaacaaaaaaacaacaccagagagauagaaaaauaaguacugcuuauccccaaacaaaggguaauauuguuacuaugauuuaauucuaagcuuuacaaaggccaaaaagaagcuuacugguguguuauguaauucuccucaagauaggcaaauuauuuucagguacugaauucugaaaugauagcauuuugugugcuucucuaaacagcagucaguuuggacaagaccuuuuguuucccuugcaggaucacccaguauacuccauaccagccugaggugucucaggggaggcuggagaguuuacucaacuaccagaccauggugugugacaucacaggccuggacauggccaaugcaucccugcuggaugaggggacugcagccgcagaggcacugcagcugugcuacaggugagaggccucucaaagugcuggaauuccaguugugggccaccucgccuggccuuguuuucuuucuauaguauauugugaauauuacuuuagucagcuuucuagaguaugacuuuucagagaaacugaaaaacucaacagguucaaaaaccuagagguuggauauuuccucucaggguccuucuuggugucuccacccggauuuugguugggguuggggaagaucagacgggagggcugagguuggcaggcgagggguaaagacaucugcauauuuggugaggggacuauuuuugggaggaaggacagggagccggugccaggucccccacugggaagugcuggcuuggggaagcagccaagcgcaggccugggggcugcgagggugggccagcaggguuguucaggggacagggugaggucucucaaggcagggcagugaggcuaggguggaaaugugaccuuaaacagcugacucggcaccuagcuuugggagggcagagggcgggagcaggggagggggaagcucaauuaggaguggacuuuggauagauguggcugggggugggggugaggguguuucaagggcaggugugggucagacgugaggaucucccccauaacacacacacaugacugagugcccgggagccucuccguuguuccaaaccuuggcagcauagcugaguguaaaggcaugagggucucuguuuggugggguuguaagaggguagugacaaagguccuggcacuguggucaaggguggauucucaggcccauagaguaggacuucuauuaucuccauggcacuuacauggaagugccauaauuuauuuaaucucucgucuauuacacauauaguuuauuuccgucucuuacuguuauuaauaguacuucaugugcauccuuauaauaaaucuuugucaaaacuucugauuauuuccugaagagccauuucuggaaguggacuuacugaaucaggaugguucuccauuucuucugcuucccuuauuugccuugccaguacuuaggaguguaccuuccugguggaauucucauguagauggccaucugguugggaaagacgcacacaugcuggccgugucuuagguuuugugcuccuagcccugaaugcccauguaagccucuuuuuuggcuuaugcagaguugggguggggagugagcuccauacuuggucagcaaguuuagaggccucuggugcauuccagccauaggccuuucugauuccugagcagccguuggggguggguucagguucucccuucugucagggacacacagccacaaaagagugccauccacccaccucucugguuauuauucucagcuuuuugcuaauuuucaucuucccucuuuuuuuaaaaaauugcuuuuuaucuuauuucauuuauuuauuuauuauuuauuaauuuauuuauuuauuugagacggagucucgcucuuucgcccgggcuggaguacaguggcgugaucucugcucacugcaagcuccgccucccggguucacgccauucuccugccucagccuuccaaguagcugggacuacaggugccugccaccacgcccggcuaauuuuuuuuuuuuguauuuuuaguagagaugggguuucacccuguuagccaggagggucucgaucuccugaccucaugauccgcccgccucggccucccaaauugcugggauuauaggcgugagccacugagcccggccgaguuaauuuauuuguuuuaauuauuuuguuuuuuuugagacagagucucacucugucacucaggcuggagugcacuggcgcuaucucggcucacugcaagcuccgccuccuggguucacgucauucuccugccucagccucccacguagcugggacuacaggugcccgccaccacgcccggcuaaggguuuuuuuuuuuuguauuuuuaguagagaugggguuucacccuguuagccaggagggucucgaucuccugaccucgugaucugcccgccucggccucccaaagugcugggauuacaggcgugaaccaccccgcccggcccucaauuguuuuuuugaggcaggguuugacuuugucacccaggcuggggugcacgaucucagcucacugcagccuugacuuccccaguucaaguaauccucuugccucauccccccaagcagcugggacuauaggcccaugccaccaugcccagcuaauuuuuguauuuuuuguagagauaggguuuugccauguugcccaggcuggucuugaaccccugagcucgagcaauccacccaccucagccucccaaaguauaaggauuacaggcgugagccaccaugaccggccaauuuuauuuuuuuaauacaaaaauuggcugggcaugguggcacaugcccguagucccaacuauguaggggcggggugcugagguggaaggagcacuugaaccuuggaggucgagguugcagugagcugugauggcgcuacugcacuccagccugagcgauagaccgagacccuguucuccccccaccaaaaauaaaauaaaaauaaauaaauaaacuauuuuauuuauuaauuuauguauguauguauuuauuuauuuaagacagagucucgcucuguggccuaggcuggagugcagugaggcgaucuuggcucacugcaaccucugccucccggguucaagcaauucuccugccucauccucccgaguagugggauuacaggcgugcaccaccaugccuggcuacguuuuguaguuuuaguagagcugggguuuugcuauguuggucaggcuggucuugaacuccugaccucaggugauccacgcaccucggccucccguagugcugggauuacaggugugagccaccgcaccuguccaguuuacacuuguaucuaaucacuguccuuugcuuuauuuucuuuuuccucaugguauauuugaaacauuuugaaccauuuuuuaaaaauuguuauugaguaaacauagaaauugaaccaucuuaagacugacuuucuaaaugggguuagaaugggaauuggaucuaugaggaaugcuaaucaguaaaugccauuaguuacugaugacucaauuuuuuuuuaaauuuuuuuuuugagacagaguuuugcucgucuuacgcaggauggagugcagcagcggugcaaucuuggcucacugcaaccucggccucccugguucaagugauucucuggccucagccucccaaguagccgggauuacaggcaugcaccggcuaauuuuguauuuuuaguagagacgagguuuuaucacguuggccaggcuggucucgaacuccugaccucagguaaucugcccgccucggccucccaaagugcugggauuacaggcgugagccaccgcacccggccuacucaguauuuuuuauacugugcuuagacuuacccucgguacuauguuugcuuugcguucuuagaagauaguccuauuuauuuaauguucacguuggaaugugcuuuuucuuuucaacagacacaacaagaggaggaaauuucucguugauccccguugccacccacagacaauagcuguuguccagacucgagccaaguaauuaauuugauucguguuuuaaacucaguauaaugucauguucaucucugcuguuucuuucucuuucucacuuccaaacugauuggaggugaaucugaaacaggguuuuuugcuguuuaaauugggguugcugaguuuugccuuaccucucacuuucuucugggcaucucucugguaaguaaacugugucagaauugaguggggaaauacacaauugccauugcuuuauaguaaguuguguuuuguuuucuucuucuucuuuuuuuuuuuuuuuuuuuugagacggagucucgcucugucguccaggcuggagugcaguugagggaaccuaggcucacugcaagcuccgccucccaaguucacgccauuguccugccucagccucccgaguugcugggacuacaggugcccgccaccacgccuggcuaauuuuuuuucuauuuuuaguagagacggaguuucaccguguuagccaggauggucuugaucuccugaccucgugacccgcccaccuccgccucccaaaguccugggauuacaggcuugagccacugcgcccggcccguuuuguuuucuuuuuguagaaagaauaaaaauauuguuuugaucagguuuuggaacguuugaaaaacagagaaaaaugggacucacauacaacuguuaagauuuuguguguauuccuugcaaacguaguuuacagagggugugcagagucccuaggugagaugcuauguaguuuaaaguguaguacuuuucuuucgugcuguaaucagguaaaacaauccucgcaacaaccacuauugguagauauuugcuuucccuuuguaaaaguugagcauucuucccccuacccauaccaccaucccuucagaggggggguuucugacauauaauuggcauuauuaguucaggaaucuaaggaaguucuuccuccuugucuuacuuaugguuuuccauucacuuaagagugaugccagugaaagaggugauggcucuguuguuaacaaauauuggcucauuagcccuaggaagcaaugcucuugggccucucugaggaguagauugugacaggaaagggcaaaggggagucagaggauagaagagaggaacagaagcagagcuguuggaugcgcuugaguugcugugauguaguuaccacugaagugccugugggacgggaugugggcaggggugggaggccacugugggagggcacagaaaaugaaugcugucuuacuggaaaagaaacguuaauuaauuuucccuuauaaaccgaaagcacgauuguucuuuguugucugucuuuccagauauacuggaguccucacugagcugaaguuacccugugaaauggacuucaguggaaaagaugucaguggaguguuguuccaguacccagacacggaggggaagguggaagacuuuacggaacucguggagagagcucaucagagugggguagguauaccuuucuugugggggguccguggaggcguaucccaacuuguaucugucuaccuaucucucucucugucuuuucaugugccuuaauuucuuuaccauuaucacauggaaugguaaaacucuccuuccugacuccuugcugcuacuuuuuucuguucccggauuccuggcacauggugggcacucaguauguauuuacugaaugaaugaaugagcaauggaguucacaggaugugaacacacucugcccgucuuccuguaguuaagauaauuuccuacucucccacuacucucagggaaagguagcaaccuuguuccuuuucucucacuuccuuucuagagccuggccugcugugcuacugaccuuuuagcuuugugcaucuugaggccaccuggagaauuugggguagacaucgcccugggcagcucccagagauuuggagugccacugggcuaugggggaccccaugcagcauuuuuugcuguccgagaaagcuuggugagaaugaugccuggaagaaugguggggguaacaagguaaaggggcucauguuucucuacuuuuauugugauuaugauuucccugauuucuucugaucacaaauguugauuucuaucugaauucaacugggccauguugagucaguuaaggaaauguacaacauagauucagaagaacaauucuguuugggauaugagcuaguacuucucaaauacuauaaauuuguaaauuuuugaaaaauuuuguguauaauuuacaauguaucgaagucauguaacgcauuugcuuagauugauggacgccuugaaagacuaaauauuuuaggcauguuuugugucucgacaguuuucguucucaaaagcauuaugccacguggcucuguaaagacaaaugcacugagacugcaaaguacacacugaguuugcuccgcguuccuuccuagaggcuuccgccacguggccauuugaguaauuuccaaauuuccaaauguacuuuccugacugcuucucauuggugaaacuucucagauuaaaaacguagauguucagaaguagucuuuguuccuuaaaaaaaaaagaaaagaaaagaaaaaaagggcugggugcgguggcucacaccuguaaucccagcauucugggaggccgagucaggcagaucacaaggucaggagucccagacgagccuggccaauauggugaaacccugucuuuacuaaaaauacaaaaauuaggugggcgugguggugggcgccuguagucccagcuacuugggaggcagaggcaggagaaucacuugaaccacggagguggagguugcagugagccgagaucgcgcugccucacuccaguuugggugcagagcgagacuccaucucaaaaaaaaaaaagaaaaaaaaggaaaaaaaaggagcgggggaccuagaugcauuccaggauuauuacuggggaaauuuagaaaaaaaaauuauguuuuugaccuuugauaaaagcuggacuuuaacauaagugaguaagcugaauuagucaaugaugugaugauaaugugaaguguguuuuuuuaaaauuuuauuuauuuauuuauuuauuuauuuugagaccaagucucacuccaucacccaggcuggagugcagugguguaaacguggccacuguguccaacuaauuuuuuaaauuuuuuguaaaaacaggguuucaccauauugcucaggcuggucuuagggcucaagugaucugcccaccccagccucccaaaaugcucggauuaccagguguaagccaccaugccuggccucuguauacuuuaaaucaucuuauuaacaccuaauguuaugcaaugguuguuacacuguauuguuuuuaaaaauuugugugauuuguuuuuuuuuuuuuauuuuuugagacggagucucucucugucacccaggcuggagugcagugguacgaucuuggcucacugcaaccucugccucccagguucaagugauucuugagccucagccucccaaguaacugagauuacaggugccugucaccaugucuggcuaauuuuuguauuuuuaguagagaugggguuucaccauguuggccaggcuggucucaaacucuggaccucaggugauccgcccaccuuggccccccaaagugcugggauuauagacaugagccaccaugcgcggcucauaaaauuugugugauuuuuaauuguuguauuauuuuuuauuuuuuugaauguuuucaguccgugauugguggaaucugugguguagaauccacagagagccaagucuuuucaauuuugucguauauuuccacuuuuccugugucuccuaagaaguucagagugaaacuuaauccucccagucaccauuauuguauuugucugggaaauuccugcaaaauuuucuuucaaaauuccuagacuuauuguauauaucuuggugucucagaguacagucuaaaaaucaguaauccugcugggcacaguggcucaugccuguaaucccagcacuuugggaggccaaggcaggcggaucaccugaggccaggaguucaagaccagccuggccaacauggugaaaccccaucucuacuaaaaauacaaaaauuagcugggcguggugucaggaggcugaugcaguagaaucguuugaaaccagaaggcagagguugcagugagccgagaucacgccauugcacuccagccugggcgaaagagcgaaacuccgucucaaaaaaaaaaaaaaaaaucaguaaucauguuuagaugaggaacguuuagaaauuguuucuuuauaaauuugcacccaagugcauuugcugaauucacuucaagcugggaaggaaagaaguaauucuauuuauagcaucucccagugcugugauuaucugugcuaacuggaugccuuauucuugguguagagaugccacugggaaagaaguguaucgucuugcucuucaaaccagggagcaacacauucggagagacaaggcuaccagcaacaucuguacagcucagguaaaucacacgucugaccugacuacugaaugccuuacgauacacagaaaugagcuacucauucauucauucauuuguucauuuauucaccaccuccugagcagugagcacaccagaaauggcaagaucuuauugguguagaaggcucauugucuuaugagaaccaaaauacaguauuggcuggguacgguggcucaugccuguaaucccagcaccuugugaggccaaggcaggcagauugcuggagcccaggaguuggaaaccugccugggcgacauggcgaaacaccaucucuaugaaaaauaaaauaaaauaaauuagccgucaguggugguaugcuccuguagucccaggugcuagggaggcucaggugggaggaucaccagaaucugggagguugaggcugcagugagccaugauuaugccacugcacuccagccugagugacagagggagacucuguccccaacuccugcccccacaaaaaaaguuaaagaaaaagacacuguguuuuacugguguucuuuauauguacaccauuugccuaugcuuucucuucaccauacauguuuuaauacuaaaaaaaauaaaaagcauuauuuguuucauuuuacccauaaucacaucuucagauccugaacaggcaaagcguaagaaaggacaaaaaaggccagucuucacuuuuauauacagacuuaaaauauauguaaauagaaagauggauaucagggucucuaguauucuuggcguugggccagguuuguuauggguggcaguugagacacccucucuuaggacugagaaggagccucuccaggaauggguugaggaaggcaaagcaagggcauuugugaugacugugcuugaggggauggugguagucaugaggcacucuuacugggagauuaugacuggcauucuuuuuuuuguuuuuucgagacagaguuuuacucugucgcccaggcuggagugcaguggcgcaaucucagcucacugcaaccucugcugcccgguuucaagcaauucuccugccucagccuccugaguaacugggauuacaggcgccugccacagcgccaggcuaguuuuugcauuuuuaguagagacgggguuucaccaucuuggccagguuggucuugaacuccugaccucaugauccacccaccucggccucccaaaguguugggauuacaagcaugagccacugcaccuggccaugucuggcauucuuuaaaaggaugggauaaaacaggaagagcuuccuggguucugaccaggguucuggguucugcuccuugaaguugcuccagggcuuaggucgaaguguuugugaaacccagccaaacccuaggaucaguuggaggcccacuccugagcacaggauccauucuaagugcaucucuuuuuuuuuuucuucuucuuuuuuuuucuucuuugagauagaguccuguuccugcgucacccagguuggaaugggguggcgcaaucuuggcucacugcaaccucugccuccuggguucaagugauucuugugccucagccuccuaaagagcuggaauuacaggccaccacacccagauaauuuuuguauuuuuaguagaggcagguuucaucauguuggccaggcuggucucaaacgccugaccucaagugaugguccugccugggccucccaaaauuuugggauuguaggugugagccauggcaccuggcuucuuuuuuuuuuuuuuucuugagacagauucuugcucuguuguccauucuggagugcaguggcauggccauagcucacugcagccucaaccuucaaccuccagggcucaaauuauucuccggucucagccuccuaaguagcugggacuauggguacauuccaccacgcccagcuaauuuucaaaaaaauguuuuguagaggcgaggucucacuuuguugcucagguuggucucaaauuccugagcucaagugauccuaucuuggccucccauagugauaggauuauaggcaugagccaccgugccuggccacuguaauugcaucucuuccaugaagugucagagagagaugucacaggugcuucaaugggagguagagugcucuuucgucucagggcuuuggcgucuagaaccaccucugaaaagcuucuccaggaaggcagugggcaauaagaucuucuuauaguugguucugcagccacgggucuuuggagccauuuccucaguugguccuuuuguauuauguuuugccucaggaaggugccaccucuuuucaaauaugagcucuuccaguaugauaggaaggaaaggugguuggcacaggcuuuuccucuguugaacagcaagcugaucuuuauuuauuuauuuguuuuuuugguuguuuuuuuuuuuuuugagauggagucuugcucugucacccaggcuggcaugcagcggcccaaucucagcucacugcaaccucugccuuccaguuuccagcgauucucuugccucagccuccugaguagcugggauuacaggcgccugccaccaugcccaacuaauuuuucuauuuuuaguagagacaggguuucaccauguuggucaggcuggucucgaacuccugaucucaugaucugcccaccucggccucccaaagugcugggauuacaggcauaagccgccaugccuggccacauggugaucuuuauaugguggccucacuuucuguagcuuacccuccauuuguugaauucucugcuuacguuuucccuuucggugcagcugacugcuccugucuugcuguuucuccucagguuccuccagguuuccgucugaucauaaguccauuuagggccucaguuuucugccucuagguucauuuuccaggugaauuugggcugucugcagugaaccaguuauguuccuguuucuuucuuuuuuuuuuuuuugagacggagucuuucucuuguugcccaggcuggagugcaauggcgugaugucggcucacugcaaccuccgucuuccggguucaagcgauacuccugccucagccuccugaguagcugggauuacaggcacccacgaccaugccuggcuaauauuuuuuguauuuuuaguagagaugggguuucaccaugcuggccaggcuggucucgaacuccugaccucaggugauccgcccgccuuggccucccaaagugcugggauuacaggcaugagccauugugcccggccuuauguuccuguugcuuaauuucuuccaguucauguauagcugauaauuuauuauuuaacuuggguugaaaggucuguaucuuuuccagcaauuguuaaaauguuugcccuggagauggccauacuccagcuugucugauuuucauccucuuauucugaugaucuucuaacucuucacugucuauuucacugcauaugugccuuuucauaguugauugcauacaagaauuacucauaacuccaguuucacucuuugugagcaugcaagucucccuguuuuguuaggagaugacuggugucuuuugaguuguuccuuuugugcuguaggucuuugacccccgccuucuguuguagcagcuguuccacauucuucucacucuugcucuucucucuugucacuggggugggugggggaguccacucuuaguuucgcaucguggauggggcaugacucuuuuuuaaucucugaaaguguguuaaugauucuuuuuuaaauaaauuuuucuauagggagucucucugagccuauucuggcucagcaggccccauucuaaaacaaaacugaaaaaacagggugcgguggcucacaccuguaaucucaacacuuuaggaggccaaggcaggaggauuacuugaguucagcaguuuaaauccaucccaggcaacauagugagacuccugucuauauaaaaaaaguacaaaaauuagccagguguugugguacacaccaguaucccagcuacucaguagacugaggugguaggagugcuugagcuggggagguccaggcugcagugagcugcaaucacaccacugcacuccaaccugggugacagaaucagaccccaccucuacaaaacaaaaaggaaaagaaacaauuuuuucuauaaauuuguggcauuacuacagaugucugaauuuucauuauguucuguucuuuauauucucuuauuucuuuuuuuuuuggagacgagucucgcuccaucgcccaggcuggagugcaguagcgccaucucgcucacugaagcucugccucccggguucacgccauucuccugccucagccuccuguguagcugggacuacaggugucugcuaccaugccuggcuaauuuauuguauuuuuaguagauacaggguuucaccauguuagccaggauggucucgaucuccugaccucaugauccaccugccucagccucccaaagugcugggauuacaggcguuagccaccaugcccggccauauauucucuuauuucuuagcuucuaccacaaugagcagcucuuucauuggcuuuucuuauuuuuaauauaaaaaucuuuuuaaaauagagaugggagucuuacuuuguugcccaggcuaguauugaucuccaggccucaagcgauccuccugccucagccucccaaaguguugggaucacuggugugagccacugcauccagccuuguuggcuuuucuaaagucagguguaguaaagaauaauuuacacuuuauuagcuuuuuuuauugagauguaacucaccguaaguuucaccaauugcaaguauacagcucaaugguuuuuacucuauuuacaagguugugcaacuaucaccaguauuuaauuucagaauauuuuuauuaccccaaaaagaaauucuauuccuaugaaguagucacuccucaucccucuccccuuccuauagccccuggcaacuacuauucuacuuucugucucccuggauuugccuguucugaauauuucauauaaaugggaucauacaauguguggccuuuuguaccuggcuucuuugcauaagguuuucaagguucauccauauuguagcaugaauguguacuuaauucuuuucuauggcuggguaauaucccauuguuuggacaugcuacauuuuguuuauccauucaucaauugguaaacauuugggguguuucaaauaagccugcugugaacacuucuguguaaauuuuuguauggauguaauguuuucaguucuuuugguuauauuccuagcagugaaauugcugggucauauaacucuacauuuaacauuuugaggaacuuccagacauuuuucaaaguggcugcauuauuuuacuuuccuaccagcagcauaugaauauucuaauuucuccguauuuucaccaaugcuuguuacuuccuauccuuugguuauagccauccuauuggaugucaagugauaaucucacugugguuuuguuuuguauuucccuaauaacuaaugauuuugagcauucauuagcuuuugaggcuuuuaaguaccuuaauuguauuauuguuauuuuauuuauuuauuuuagagauggggucuuguuauguucuucuugcuggucuuuaacuccugggcuaaagcaauccucccaccuuagccucccaaagucuugggauuacaggcgugagccacugauucaagcccuuuguauuuuuaaguuuguucaauuugugaaagaaauugucauuuucuuggucucuauuuuaauuuuuuugguucuucuuuugauauucuagugcccuuugaaguuuuuaaaaagugguuuuauacuucucaucaauuuguuguucagccgugugauauagccuccugauuauggaaggaaucaucuguagauuaaaaagggacaugaaccaaccucuacaauauugugguggaggcugccagggcauucugugaaugucaggccuggguuucuguuuccagcaacacagccaugagcauuugggcacagugugucacagauucuuuaccucagccucgccuuuuccacagcuguaaagugcuguggaguuucuguguuuauuucugauuguuguaaggaguccauaagaguguuuacacuuugucuaggacuuuuaguacaagaaugccuacuuccauguuuucugaugucucuuucuccucauuuacuuccuuguuugcugacuucaccuuuggaaacuguuucuuauuuugcauuggcuccauagagacuuccucuaguagucuagcagaaaaaaagauguaccuaacaaaauggacccaguauugaacaucaacuguauuuugcagagacaggguuuuguauugucaaccgggcuggaguccaguggcgcaaucauaggucacuguaaccucgaaauccuggguucaagugauccaucucggcuucuggagucacugggacuacaguugcacaccaccccgcucccagcugaagugcgcauugccguuuuugccaguccuuugccacagauucuccauucaacucuugguuggcagaaguucagccucuaguguuuuauuuaaguucuuaggagaauuuuauuccugaaguucuugaauguuugaaaauugcuuguuucuuuuuauucuugaagaauugccugguugaguguaaaauucucagaucucacuuuuucucccugaggucuuuauugcuucacugucuuccaacauuaaacauugcuucucaaugucugaugguagugugaucuuugcccuuaagggugacaugauuuuguugcauggaagaagcccuucguaauggucaaaugugaagguuuaguauaguaacaacuccagggugucuuggaugaugguuccuuucagguagucaggcagguuauauauuaauuguccccaacuaucaaagaauguaggaaaucugaucauuuuguuuugucgcugucuucaguuuugacaucccaagucaaguaauuacacccucccacuaauuguccuccaucacgugauucuuuaaauguucuuaucuuuuaggcccucuuggcgaauauggcugccauguuugcaaucuaccaugguucccaugggcuggagcauauugcuaggaggguacauaaugccacuuugauuuugucagaaggugaguugguaaucugucuaaaacauuugggcauaauaaaauugauaaauuugaguaaaauugaaaauauugcauguccaauacuauaugcaaaauuaaaagucaagugagaaacgaggaaaaauacuuucaacauccaugauuauuuuguuguuuugcuuucuuucuuucucuuucuuuuucuuucuuucuuucuuucuuucuuucuuuuauuuccuuuuucuugcuuucuuucuuuuuuucuugcuugcuugcuuucuugcuugcuugcuuucuugcuuucuuguuugcuugcuugcuugcuugcuugcuuccuugcuuaauggagucuugcucugucucccaggcuggagugcaguggcacgaucucagcucacuguaaccuccacuucccggauucaugugauuguccugccucagccucucagguaacugggauuaagguacacgccaccaugucuggcuaauuuuuguauuuuugguagagacagggcuuugccauguuuuccaggcuggucucgaauuccugaccucaagaaauccguccacuuuggccucucaaagugcugggauuacaggcgugagccaccaugccuggcuuagacugaguguuaauauuuuuuucucuuuuacuccuggcaagcugugauauuuuuaauauguagaacucuuacuuuccuaccggccccaaacauaagaaggaugaacacccuaauagaaaaauaggcaaaagacauuaaauguaauuuuaaaagaaauaaguauacaaauaaauggccaguagacauagaauuuuagccucauuauuaaugaaagagauacaaaauaaagcaauaaacuaguauuuaucccauuacauuggcaaucagaagaaugcugcuauguagugagcuagacaugguuacucguguauguaaugucagcuacucuggaggcugagccaggaggauugcuugaggccaggaguucaagaccagcgugggcaagagcgagaccacaucucuauaaaaaaauagaaauaggccaggcacaguggcucaugccuguaauccuagcacuuugggaggcugaggcggguggaucacuugaggucaggaguucaagaccagccuggccaacauggugaaacccugucucuacuaaaaauacaaaaaucagcugggagugguggcauacuccuguagucccagcuacucgggaggcugaggcaggagaauugcuugaauuuaggaggcggagguugcagugugccaagauugcuccacuguacuccauccugggcaacagagugagacuccaucucucaaaaaaaaaaaaaaaaagugauuaaaucaugguucauccauauguuugacuauuguacagccauuaaauaugguuuaaaauagugaucuauaggaaagcauagaugagaccagguguggugguucacaccuauaaucccaucguuuugggaggcugaggugggagaauugcuugagucccagaguucaaggccagccugggcaacauggcaagaucacugucuucaaaaaauuuaaaaaauuauuagccaggugugauggcaugaguccuugaucccaguuacuugggaggcugaggcaaggggauugcaugagcuugagcccaggaguuugaggaugcaaucagcuaugaucaugccacugcauuccagccuggacaacagagugagacuguaucucucaaaaaaaaaaagguauaauuuuauauauauauauauauaucugauacuaccugcucccccauuucuugagaaauaauacaccaaaauacacgcaguaaugcaauuguauguugauuuuccuuacucuuuuauauguauuucauaauuuucuacagcaugauaauaaacauguuuaguuuuuuaaaaagcaaucaccaaagcacuccccaggaccaacaagagucuaguagaauuuaucucuuuauuauucugugacaugucaauggcugaggagcagguuucuauaugagaguuugggggaucuccuaucuuguguaggucucaagcgagcagggcaucaacuccagcaugaccuguucuuugauaccuugaagauucaguguggcugcucagugaaggaggucuugggcagggccgcucagcggcagaucaauuuucggcuuuuugaggauggcacaguaagucaaauuuucaguauuuuuaccaguuuuucaaauuuucacauuguuucucauuaaaagguuuucucuuuguuuuuaaaaaauaaaaaggaaaacuuuaggcacaguccuauuuuuucauaaacaaguguuauuuacauuaugcaacacuguggucuuuucaguaaaggaucauucacccuuugcuuucuuuuagacuuaguguuuucauaugugggacugaaaugcacauauuuuguucauaauacuccucucuucacaguaugacugacuuuaagauaaaggcucugauaacugauauacagguuaagggaagaaaaucuccucaauaucugauaaguggguuaagggaagaaaaagauaagcaugucuagcuucaaaaggaguguccugcagccauggaauguuagaguucagagguggcuggcaaaacucgaagccuugugaaaccugggacuggucuagccaccuuccucuaagccuuagcguggagauaauuguacccugauauuuuggaaugaugggauuuuguuuagcacugucuccccuuugaccucucuugggauuccuccagugauguggaguuuagaguugauguuuuccauuuuguuuguguuucuguagcuugguauuucucuugaugaaacagucaaugaaaaagaucuggacgauuuguuguggaucuuugguugugagucaucugcaguaaguaaaauaaaaacaugcguuccucaucauaacuauuggaggugguagcaaaaguagcuuauccccugagugugagggagaaggggcccaagugugacacugguagcuuguuguuaaaauuauuccacugacuaucccuugcuagucacugcugacagcuggaggucacugcuguagggcuccagccaguauuaugcacccaggcuaguuggaaagauuguuaaugguguuucauugaaagugccucuaggcuggggaugguggcucaugccuguaaucccagcacuuugggaggucaggggggcgggggggcagaucaccugaggucaggaguucaagaccagccugaccaacauggagaaaccccgucuccacuaaaaauacaaaauuagccaggcaugguggcacauaccuguaaucccaguuacucaggaggcugaggugggagaauugcuucaacccaggaggcggcgguugcagugagcugagauugcgccauugcacucuagccugggcagcaagagcaaaacuccaucucaaaaaaagaaaaaagaaagaaacugccucuacuacaaagaugcaagacauuuguaucuugguuaugucauucauuggaaaauuaugauauucauuuaauacauauuuauugaggacccaauaugugucaggugcuaugcuaggcccugaagacacaguggugaauuagacaugcuucuuguccuccuggugcuuacaguuuauuagggauucagauaaacaagcuuaagauuagaauccaggugacugaugugugaagauguucugggagcucacaggaugagcuccuuaccaagaagauaagcaggaguuaucuagaccaagauggcacaagagggaaaggaagauggguccgaguguucuagacacuggagaaagcagucacaaaggcugggagagggaguacaugaaagcuauaagcaguucaguguaaugaguugcuuucuaaaauaaugaaguagugggggaaagcaagagaaaaguuaccauuccaugggaugagagugaaagagagccgacaguagcuaccuagaccuguggcaagguguuaaucacaacagccuacacugccugguguguauuaaucacuaaguaaauauuuguuaaauggauagaugaaaggaaguagaaauaccuuccagagugcugaguggugcugucuugcuuaucugugcccucuuugagagaggacuucaaaggguuauaccagauaacauucauaaaugaucaaagaagcaucacaguguucucuuuuaaaccucaauuaaacaggacugaguuagcuccuucucuguagaacucugcacuaaauuuaaucacagauauuugguucaugcauuugagaaauguuucuggagcaucacuaaggggucaagagggccauuauuuuaguucauuugcauuggaguaccugaggcuaaauaauuuauaaauaaaauagcuuuauuuggcucauguuucugcaggcugugcugugcaagaagcguuugcuucuggugaggguuucaggaaacuuccucucaugaaggaaggggaagaggagcaggcaucacauggcaaaagaaaaaggaagagagagagaggagggaggugccaggcucuuuuuaacaaucacuucucaucaguucucaugggaacuaguagagugagaacucacucauuacugugaagacagcgccaagcccaucuucaacacuggggaucacauuucacccugagaucuggaggggacaaguauuaaaucuguauuagucauauuauuagccuggcaaggaaugaggaucaagccauguauugauuauauauucuggauauuaaauccuuaucagauauaugacuuacauauauuuucuuccauucuguggguagucagucucuuaacuuucuugauaauguucuuugaugcacacacauuucaaauuuuauagaaauuuaauuuaucuaauuuuuauauauguuuauuguuuauuccuuuggugucacauuuaagaaaccauugccagauccaagguuaugcagauuagccccuauauuuucuuuuuuuuuuuuaagauggagucuugcucugucgcccaggguggcgugcaguggcaugaucucagcucacugcaaacuccaccucccagguucacgccauucuccugccucagccucccgaguagcugcgacuacaggcacccgccaacacgaccggcuaauuuuguauuuuuuaguagagacgggguuucaccaugugagccaggauggccucgaucuccugaccuugugauccacccaccucggccucccaaagugcugggauuacaggugugagccaccgcgccuggccuauuuucuucuaaguuuuaguaguuuuagcuuuuaaauuuacaucuuuggccaggcucaguggcccaugacuguaaucccagcacuuugggaagccaaggcaggcagauugcuugagcccaggaguuugugaccagccugggcggcauggugaaacaucgucucuagaaaaauacaaaaaucagccaggugugguggcaugcaccuguagccccagcuacucaggagacugagguaggaggauugagcccaguagggccaaggcuacagugaguugagaucgugccacugcacucuagccugggugcuagagaaagacccugccuccaaaaauauuaaauaaauaaauaaauaaauaaauaaguaaaauuauauauuugauccauuuugagugcuuuguggcccagccacccagaagccuggauguccacauguggcuccaggcacaguucuggcccuaucaucucuguguuucuccuucaggaacugguugcugaaagcaugggagaggagugcagagguauuccagggucuguguucaagaggaccagcccguuccucacccaucaaguguucaacagguuugugugucuugugugacuucugcguuuugugcuuugguaaucagcuagggaguuaggcagagugcugcugcugauuucgccugcuguggccugguuauucuggcucagccguggcucccaaguauuucauccucauaacgaucccguuccugacuugggaaaagcacacuuuguuuccugguggcucugcucccuuggcagucaggaagcagggaugaauaauugccaggcugaaguucacucccaagagcccuauauccucuucuucccaaccuucaacucauacccacagucagcuucuuguccaagacauccucugagguuugugggggucugugcccuucucucugaguguaguugacauauuguccguggccaaaauugaucugcauuuugaaaguagauuucggugugucuuauaugucaggaggaugugcauggacucauaucuacuuuuggggccccuaauucuguguuuuguguucacagcuaccacucugaaacaaacauuguccgguacaugaagaaacuggaaaauaaagacauuucccuuguucacagcaugauuccacugguaguuauuuguggccuuuuuucucauuuccaagcuaccccaaucccacgucucuugguccuaccuaauaugcuccaagagcaacaaagggguggccaugcugggagaauggaggguugauugauggacuauagaaaaucacuaaugugauacauuuuggauguucuucuuaaagggauccugcaccaugaaacugaacaguucgucugaacucgcaguaaguagcucacuucuguaaguggauacucagcaaggggcaguguucuagcuuccaccuaagcccagaacuagugaaaucuacugggacugugauucugugauugaagaacuauuuuaauaauucuuuaccuugcuauucaccaaucuugggaguaacccuguauuucucacgacuucaucauuuaaauguauggguaaacuuauuauuuuuuaauaaaauuaauuaaauguauaugguauuuaugccuuucuauccuaucccucccccacccccacccccuuuuaaaccugucauauuaaaagcuuuuuuaaaaaaaauuguuuauaguucuaaaucucagguagaauuacgaaccuuaagccgucuuucuagaaaucauuccuguaucagaaagauagggauucaagucaacagaagauuugugcaacucgcuguugugguuggcaaguaucucuacuaggccaggauccauuuuagcgaagcuuuuuuuuucuuucuuucauuucuuacguuuauucugaagugacauaucauaucagacgaaagaaaucauuuuauaucaugauaagaauauuucccucucuauuuuuuuaaaaaauagagucaaggucuugcuguguuugccagucugaucucagacuccuggccucaagcaguccucccaccucagccucccagaguucuggaauuauaggugugaaccacuguaccuggccuucccauuuacuuuuguguuuguuucuuguuccacuuagugaagaaagagaacaaucuauugcuauauaagaguuuaugccaaccauaccugaagcaacucauuguguuucauggaaagaaaucuguuuugggggcuuuucuucccugaaaaguuagcaaaacauuguauuuuuguguaaguucccuuuuuggacaacuaugucccacuuuuaaaugaagacaguaacgguacuuaccuuauaagguugugguggaacuuaaauaaauuaacauauguauagcgcuuagaacagugccuggcacauagcuuuucucaucaucgucauuauuauuaaaguuauuauugcuauugcuauuauaauauguauauaugcauuuuuguuuucuuucuuuucagccuaucacauggaaagaauuugcaaacauccaccccuuugugccucuggaucaagcucaaggauaucagcagcuuuuccgagagcuugagaaggauuugugugaacucacagguuaugaccaggucuguuuccagccaaacagguaagggcauuucuuuucuuauuguuucagcaaucuauucuuguauagcauacaccacaaaacuuaaaggcuuagaacaacaacuuuuuuguguuauucugugacuugcuagacaguuccacuccacuggggagagcauggcuagaaggugcaucguguucucccucacauagcuggugaggagcugugggcugggagugcauuugaggauguucacuagggccauaguuuuucuccauauggggcuuuccuuguaguuccuugagcuuccuuguuccuuacagcacaaugucgggguucagaaugcguguucccagaugaagcauggagaagcugcaaaucucuaauggccgaaccuccuaaguuacacugcaucccuuccagauuagucuaucuauuaaagcaagucacgaggcgagcccagauugaaucggggaggggacaacaccugggugugaauuuugguagaugucguucauugcggacugucuuuggaagcuagcuuacuacaccugucagugacacagcauaagaagaaggaucaagcacacaugcugaauuccaacaagugucucaguuuagcagggccaggagaaccuggauccugcuuugguaaugucacuaacuuugaaaggucccuucuccucuuccagccucaauuucuuuguaaaggaaagacuuugaagaagaacagugauuuucaaaagcaacagccuccagcaaaaucuccugagcacuuguuaaaaauacaaacuccgggccccgcuccagacgcacugaucauaaccuccagggggugagacuaagacucuuuauuuuuauuuuuauuuauuuauuuguuuuuuuagauggaguuuugcucuuguugcccaggcuggagugcaauggcgugaucucggcucaccgcaaccucugccuccugcauucaagagauucuccugccucagccucccgaguagcugggauuacaggcaugugcuaccacaccuggcuaauuuuguauuuuuaguagagaugggguuucuccauguuggucaggcuggucucuaacuccugaccucaggugauccgccuggcucggccucccaaaguguugggauuacaggugugagccaccacgccuggccuagaaucuuuauuuuuaagacaagaccaagugauucuaauacacagucaauuuggaauccccuggauuuguggucucucugccuucaugaugauagaugacagauggaccgauggacagaugauagauagauagauagauagauacauacauacauacauacauacauacauacauacauagaugaaugauagaugggcaggaaucauguuaucgguaugugaguuuacauuuuagaauaucuuuagaaaaugaguuaugguaucugccccuagguucuucaccuccugcugcucaaaguauaguucucuaccagcagccucagaguugaccccucugggagcugguuaguaaugcaaaauuucuguuucaagaugcccuaccuucuguuuuguaacauagacuacacagcaaagccauuuacuuuguaaaaacaauacacccuauaaaauacaaacccuuugggaagaggguauguggcaaugaaaggauacagugcucucaauugcgucuuaaagucucacuucauaaauagguaggagcugauagcaugaaagucaagcuuuaguauaccuucuuuagaacuucauuacuuauuuuuguuuuguuuuaagagacaaaccucagugaauucugaaccuugagucuaugauaguuauuaaauguugaaaauuaagaaauuucgcccucuagugacggaauauaaucacauuuucacugucauauuggagagugauuuuucaagacuauuuuaauucugguuauuagcucuugcaguaaauugugaucccagccaggaucccagaagacugaccuaagaaucaggaaauuugucuucuuaaagcagugguuuacagccuuggcuaggaauuagaucccauggugacuuuauaacaucccugaugcccacaucacaaucccagauugaaucauaaucucaauggagaaugacuggggugagggaagggacccaggcgugaguauuucuuuaaaguucccuacaugauuccaacugcagccaagguugagaaccagugucuuagacauuucuccgcuguuuuucccuacauaccugguguucuuucuuuguccuaauuuuucucauucauaugauggacagugagacuccacacccuaucccaaucuugcagaggguaagagaucuucaucaugaugucguuccuggcaaugaugucuucuccaguuccugagauucccagcuauaccauccauuuccaagagcugauuugagcauggcaggggcuuugcacaauguuuaggcuuagauaaaggaaugaaggauguuucuggucaugagcagaagcugcugugacagaugagaaaaugccuuauucuuuguugagaaaguacaagggccaugcuucuggugaguaaagcaauuugaugucuuaauucgcagaaaaaaggaagggauacaccacauauuccauauauaagugauuuuuuuaaccuuguuucaauccuauuuuggcuuauuugugcuaaucucugcacaagugggugacacauuucuugucuuauaauuauucugugucuacaacagggcuuacauauuggcuaauuugucaugauuuacugcuggcuagaguccagugaaaucuaggggaccuauaugcacgucacauuuuuuguaagaagaaacacagguuucuugacaacucugcacagagggagaauuucgaauaccaugucagccacugauguuauacucaaaauagcaggugcagucacaggugucaucaaggaaccauuuccugguaauuucauuuauaccugacuaauuagagucagucaaugugucuguagaguucuguagucacaaaaaguuuugaaucugaauguuuccuuucccuuucauuauuguaugauauuucagauauaaccauagcauaauuuuuaggaaguagccuuaguaguauuucacaacucuaaaguauuuuuuauugugguaaaauauacauaacacaaaauuuacugcuuuacguauuuuuaaguguacaguucagaggcauuaaguauauucacacuguuguacagccaucaccauuauccgucugagagcuuuuugauuuucucaaauucaagcucaggaccuguuaaacaguaacucuucgguuccucuuucccuuuuucccuggccccuggcggccuccauucuacuuucuggcuccaugaauuugacuacuuuaggaaccucguauaaguggaucauacaauauuuguccuuuugugucuggcuuauuucacuuagcauaaugucuucaagguucaucaauguuguggcaugugucagaauuuacuuccuuuuuucuuuuuuucagacagggucucauucuuuugcucaggcuggagugcaguagcaggaucuuggcucacugcaaccuuggccucccaggcucaagugaucuuccugcuucagccucccgcuuagcugggacuacuggcacgcaucacuaugccuggcgauuuuuaaaaguuuuuguagagacaggagucucacuacauugcccaggcuggucuggaacuccugaccugaagugauccuccugccuuggccucccaaaguccugggauuacaagcaugaucuccugcgccuggccuacuuccuuuuaagguggaauauuucauugcauauauauagcacauuuuguuuaucccuucaucaauugagggacacuugaguuguuccauccuuucggcuauagugaauaaugccacuuuacauugauguacaaguaucuaguugagucccugcuuucaguuuuuauuuugguauauauucagaaguggaguuuuuggauauaggguaauuuuauguuuaauuuuuugaggaaucgccguacugucuucugcagggguugcaccauuuaacauucccaccagcagugcacaaggguucugauuucuccacgucccccaccaacauuuguuauuuucuguuuccucaaguaauagcaauucugguaggugugaagugguaucucacugugguuuugauggacauuuccccaaugauuagcaauguugagcaucuuuucauaugcuuaccaugcauuuguacaucuucuuuggagaaacguguauucaaguccuuugcccauuuuuuaauuggguuucuugggagauuuguuguugaguuauagcaguucuuuuuuuuuuuuuuugagacgaggucucgcucugucgcccagacuggagugcaguggcgcgauaucggcucacugcaacgaucgccucccggguucacgccauucuccugccucacccucccgaguagcugggacuacaggcgcaugccaccacacccggcuaauuuuuuguauuuuuaguagagacaggguuucaccguguuagccaggauggucucgaucuccugaccucgugauccacccgccucggccucucaaagugcugggauuacaggcgugagccaccgcgcccggcccagcaguucuuuauaucuuuuuuuuuugagauggagcccugcucuguuguccagccuggagcgcaguggcgccaucucggcucacugcagccuccaccucccagguucaaguaauucucaugccucagccucccgaguagcugggauuacaggugccugcccccguggccggcaaauuuuuuuguauuuuuaguagagacaggguuucgccguguuggccaagcuggucucaaacuccugaccucaggugaucugcccaccucggccucccaaagugcugggguuacaggcgugagacaccaugcccggcuuuuuuuuuuuuuuuuuuuuuuugagacgaagucuugcucugucgcccaaguuggagugcaguggagcaaucuuggcucacugcaaccuccgccucucagguugaagcaauuauccugccuuggccucccaaguagcugggauuacaggugcccgcuaccacaccugacuaguuuuuguauuuuuaguggagaucggguuucacuauguuggccaggcuggucucaaacuccugaucucaggugauccuccugccucagccucccaaggugcugggguuacaggcgggaacaccacgcccagccuauauguucuaauuccuuaucagauauaugauuugcaaacauuaccuaucauuccaugaauuuccuuuucacuguuuacaguguuuuuugaugcacaaaggcaacucuaaauauacaauaaauauaaaggauuugcaccuuaucuagcauaaugucuguggccuucucugguaaauauuagcuuuuggucaaccuggauagucuaaccuuuauccacucuuaguccauuuuuauuuacauuaacuuuuucauuccuacuauucaugaucuaccauggugcaauuuagauuuauauucuguauuaucugccuugaccugacccaugagagcgacauagacccugacuggagaggaggccuuugcacuggaaaugcuauguuauugacccagauaccaguuggcccugaaugcugguaacugucugucagagacgccacuaugccucugguaugcuugugucuuauuugggguuucccaaaaucagacccugaaacaggaacuucaguacaagaaguuuaugugguugcugaucccggaaagcacaguggagaaguacagaggugagacagggaagugaggaaagcuggaaaagguuguauuagugaccagguuaucaccaucacuguaugggauccuagagaucagucccauugggggcacugagggagacuggauggaacaugccuccgauuugucccagugaagagcugaggaagccagaguauuuaccaacugcuccuucguugcccgggaaggacugagaagcuggaguuagcaacacuuguucuucauuuguugaaggcuucaccccgggggccuuaaccccucaauacuugaggcuugauaguuaugggcugucuuucaaccaagaacgugccuggcagagaacacccucagguggagaggcagagaugcuugaguucauauacggucauuuuaugucggagcuguccacagaagcuggaaguaagcuucaggaugaaacaaagaccugugagcagcacaaugauccugucugcuacagguugccuauaguaggcauggccuuuggcaaauggauaauaaguauuauauaacuagauuaaggaagaagagaugccagugccuuucaggggaagauggcagccugaguggguccugaauggagaaggggacugauaggcagguaggaucaggaaguguuauggagcagaugggcuugcugccugaugugcacagaagccaauaacuauggcaccagcuuuugagaaaagaagggcuuuauuuauugcaaaaccagcccgcaaggagacaagagucagcugaaauuucucuccucuauuugggaucuggggcaaguuuuaagggaucagaaggcaggggaagggauuugggaaugcuggcuuggcaaggucuaauuagagggcuucagauuugacagcuuacgguaagguaugcugagcccuacaucuuccggaucaguagaccccucacuucugaagaaguucuggcaugcagggucugguucucuuccagccuuguugguuccgaggggcggaaucccugguucugggugucguuagaagucaaagcuuuuucuauugcacauucccagacuacaugacuugcaacuguggacucuguuauaagguaacucaacauuuuguuaucaacagaacaggcccagugugggcugguccugcaauuauagaagcagagagccugcaagagucaaggagcccuagggugaggguaagaguucuuuggggccugaagagaacuuggcuuauggagauccacaaacccugagacgaaaggcaguugucugaaggaauguuccugggucgaaggucucucuggccuucagggugcuucaggggaaaugaagaguggggccaggucuuccguaguucugagacuguguggauucuagccuuuguagaugaggagauucucccagugaugcucccacugcccccaacagaggacugacagcuugcagacugguucugcugcugaagauguugcagcaaccugaacucagcccuaagggugaauggagccguagccagcaaagggaaaauuuuaguugcacacuucacuggacccagcaacagagaggaagcacagggagagugcucagaacagguugcccgggcagccagcguuauaggcacuggcgugaggcaaagucagcuaguuauagcaauacaacuucgaucucagagcuggcugacauucaguauuaaguaaaaaggacauucugcaacuaaaaccaugaguuucaauuuuaaacaaucaggacugggcacgguggcucacagucccagcacuuugggaggcugagauaggaggaucacguaaggccaggaguuugagaacagccugggugacauaguaagaccccaucuacaaaaaaaauaauaaaauuaucaaauaaauaaucaggaugggauacucuugaaaacaaaauuagugacuuggaaagguacuuggaggaaauauuccaaaacaaaaacccaaaauauacagauuaaggcugugagggaaaaguuaaggaacucagaagacagauucagaagauucagcauuuggggaugagaacauggaagaguuaauuaauauucaucugaggaagugaaaaaaaauuguauaaccaaaaugaugguaaaaaaugaaaugauuaaagauaaaagcuagaaugaaugaccuagaagauaaaauagucacaaggauuaauaaauacaaaaacugauuauuugaaagauccagugaaaucaguuaacucuuuucuugccuaaggaaaaaauauauauauacaaauaagaaaugagaaagaacauacccagauauagauaagauccaaagaauuauaaaggaauaguauaugcuacccugugucaacaaauuuaaaaacauagagaaauaaaugauuucuuaacaaacauuuaggaacauaagggcauguugaaaacagauuaacagaggcugaucacauggagugaaacuagaaauaacagaaagaugagcaaaauucacaaauauguggaaauuaaauaacacccuuauaaauaaccaguggaacaaagaggaaucacaaggagaacuggaaaguacuuugaagccaggugcaguagcucaugcuuguaauugcaguacuuugggaggcugaggcaggaggaucacuugaucccaggaguucaagacuagccugggcaacauagcaagaccucaucucuccaaaaaaauuagccuagcaugguggcaagcaccuguggucccagcuacuuugggggcugaggugggaggaucacuugaguccaggagguugaggcugcagugagccaugaucacgccacugcacuccagccuagacaacagagugagacucuguuucuaagagaagaaaaaaagagaggaaguacuuuccaacuaauuaaaaugaagauaccgcauaucaaacaucacgggcuguagcuaaaacagugcuaacaggaaaguuuauagcuguaaauaacuacauuaaaaaagaagaaagagcugggugccaugauucaugcuuguaaucccaacacuuugggagucugaggugggaggaucacuugagcucaggaguucaagaccagccucggcaacauagugggacccucuuuguacaaauuaaaaaauuagccaggugugguggcaugcaucuguggucccagcugcuugggaggcugaagugggaggaucacuuacacccagaggucuaggcugcagugagccauguucacaccauugcaccccagccugugacagagcaagauccugucucgaaaaaaaaagaagccuggaccagauagugagacuuagucucuacaaaaaauuaaaaaaguagcugggcacaguggcguguuucuguagucccagcuacucgagaggccgaggccagaggauugcuugagcccaggagguugaggcugcagugaacugugauggugccgcugcacuccagccugguugacccuguuuuaaaaaagaaaaaagaagaaagaucuuaaaccaacuuaaucuuccacccuaaaacaacagagaaagaaguacauuaagcucaaagcaagcagaaggaaggaaagaaucaggauucgagcaaaaaaaaaucaauaacguagagauggggagcaggagaggaggggaauuauaagaaaauaaaauauagugaaauaaaauuuaguacaacagauguuagcugcguaaaacugcgugugugugugugcacaggggcauagguggaaagauguaugaaaggaugggacucaaacaguugucucuaggugguagaauaucaggugauuuuacuuuuuguccuuauguuuuuagauuauuuaaaauuuuuaaagccuugaucauauguuauuuagucaauucaaaaaagauauuuuuaugguggagaacaugcguauugugaaacaacuaaaugcauaguaaguugguuauaggcucauuugcaccugguucuccugaucucagaggguuccuccaucagcugauggauaugggauaagguuggcuuugaagcuugcccuggggcuggaggcaaaacauaaccaccuccaucugcccuagcggcaccucuauccuaauaaauacagugagguagucucccagggcacccaguucaaacucugcagaauaggauaauauuuaacaucaaguggacucagaauacaacucucugguucucaaaugaccaaguagcagaaugaaauguaacuuucaggccugcaucuggauuucucugcguguggcgcugcuggcucugccucauccuugcugcugugccuuuccgcgcugucuucucauccagggcauuucuguguuaugcgcacagaaggcuuuuguucuuucugcagucauucccugcccacauauaugcugcagcagggaccuuucucuuuggugaauuuucuuucuaagagagaauucaucagcucaagggaaagguuaggaucuagaaaaugugagguuuuuaaggcucuguuauguggcuuccuaccaagucauguuguagguuucucuagcaacagaaaagugaaugagauuuaauucaggaauagacagucaauauggaucauaaaaagguuuuauaagugcuauagauugaauguuugcauuccuucaaaauucaccuguugaaauccuaacuccaggccagacgcggugguucacgccuguaaucccagcacuuugggaggccgaggcaggcggaucaccugagaucaggaguuugagaccagccuggccaacguagugaaacuccaucucugcugcaaauacaaaaauuagccaggugugguggcaggggccuguaaucccagcuacucgggaggcugaggcaggacaauugcuugaaccugggaggcagagguugcagugagccaagaucgcaccacugcaccccagccugggcgacaagagugaaaccccaucucaaaaaaaauaagaagaagaaaaaaauaaauuauaacuccaaggugacggcauuaggaggugggagcuuuggcagguaauuaggucaugaggguuguacaauccugaaugggauuagugccauuauuuuaagaaagaccccagagagcucuuuaccccuuccaccaugugaggacacagcaagaccacagcuaucuaugaaccaggaagugcgcccucacuagacacuaagucugcuggcuucuaggaucuuggacaucucagccucuagaacaaugggaaauagcuuucuguuguuuauaagccacccaguuuuuggcauuuuguuauagcaccuggauggauuaagacaauaaccauaaauuuugucaagauaacuuugcuugauguagccaagccuucacuggucugccuaguuccuuaggacauuuugaucccaaggguguuugaagggccugaaagaaaaaaugucaagaagcuuaucccuauuuucuccuauuuauuuguucuacccauaaaccccggggaggguuuccagcuugguguagaaaacagccaaauaauauuuaauuaccuuuucauuucccacugagcccagcggggcuugcuucagcuuuuucuccauaacacuuugccacucuucaaaucauucagcagcucauaaguacauucuaggaauugcuaguuuagaauuaugaugugauguuuaaggcagacagaaagaguaauuaacaccucccauggauauguaaagugaaagacaaguuggaauuauuauuagcucacuuggcuuaaaaaauugaggaaguuguuuuuguccuuaaaaacugcaaacugugauuguuaauguagacggagguggccauugcuuuucccagaaucuccuucaugggaagauucuuaaauuguggugugaacagggcucucaauggcugucagaauuaauugugcaugagaaucaccuggagggcuugugcaauuacugagccucacccuacagaguuucugauucaguaagucuggaguagggccccagaauuugcauuuuuaacaaauccccaggugaugcugaggcagcucguuuggccaccagccugugaaaaccacuagguuuaccagagguucuuggaccuggcugcauguuagaauuaccuggggagacuuuugaagaacacagaugcccuaccuacugcacaaaccaguuacaucagaaucuucgcuggggauggagcccauaugggagaguuuugggguuuguuuuuuuuuuuuuugcuucuuuugagauggagucucacucugucgcccaggcuggagugcaguggcaugaucucagcucacugcaaucucugacucccgaauucaagcgauuuuccugccucagccucccaaguaguuaaccgaugcuacaggugcccgccaccacaccuggcuaagaagugggagaguuuuuaagcaaaaaacucucuaauucuaaugugcaucacuggguuggagagcaauuuggccuggaggaacaccaaagagaaagguuuagcaagauggauguggcuaucauaugcauaucacaaauaauuuagugcagggagggucaaaagcccacuauuugccgucucccuccccucccuuccugagcucaugguugacaucacugaucauuucugguaaguuuuccaccgagccuagugcagcuucagaaacagaguacucugggggccaaauaugagagaccuguaagcccucucugauuucccaaagaaacagucagaaugccaggaaaaaagcagggugagggaugaggagagccgucuuucgggaaauguaaagcagugagaaggaacuccucuuucccaauuuccuuaacucucaagaguauauuuugauuuuugaaguuuguuagacuuuagggcagugguucuaacauuggacugcaccccagaauuucugauucaguauucguggaguggagccuaugaauuugcauuucuuuucuuuuuuuuucuuuucuuuguuuuuuuuuuugagacggagucuugcugugucgcccaggcuggagugcaguggcauaaucucagcucacugcaaccuccaccucccagguucaagccauccuucugucucggccucccaaguagcuggaauuacaggcacccgccaccacgcccagcuaauuuuugauuuuuaguagagaugggguuucacuguguuggccaggcuggucuugaacuccugaccucaggugaucugccucccgaaguucuggccugaauuugcauuucuaacaaguucccaggugauguugaugcuuucuauugucugggaacuagacugagcgugagaaccacugcucugaggcgcucuucugauaccagcugauuuaucuacguuuuuugacuagauagcaaagguuaauuauggaacuaaacuuaugucaaauugauacagauugguaagaacauuacagaguguuguguugagggguuuugauuuuaaauccauagagauagagaccuggcuaacguuaggguacuugagacaugcaguacauggaguuucacugguuaaaaucauaccguuugcaagguauuuguacuguuaaauuguuagucaccuguuuuuuccaccugguagauaggaaucugcacccauuuuucccuuauuuucuugagagugguccucugaaggugccaugaacugaagugggucauuucgacagugguuguuaggaucacuuuacugccaucauuuuuaccguaucgguuucuuagcugauguuucacuugcaucguuuuuguuucucaacguaaaggagaguuuggaugaggggagucugacaucaaagauguccaacaccaaacccuuacguaucacaagcaacugugaaguauuuccuucuggggggugacacuggguaggauggaugggggucgcuuuuuucuucuucuuuugcuuuauaacccuucugcacugaugauggauuuuuuuuuaaaaaaucacauaaauguauucuuuuauuuauuuauuuuuuaagauagagucuugcucuguugcccaggcuggaguacaguggcacgaucucagcucacugcaacgucugccugccgggcucaagcgauucuugugucucagcuucccaaguagcugggauuacaggugugugccaccacaccuggcuaauuuuuguauuuuuauuagagacaggguuucuccauguuggccaggcugaucuugaacuccugaccucaggugauccaccugccuccaccugccucagccucccaaagugcugggauuacagcgauucuugugucucagccucccuaguagcugggauuacaggcgugagccaccaugccuggcccacauaaauguauucuaucauaaaaauuuuaaguucaccugugaaauagauagcauuauguccacgugacagaugggauccagaggaauaauuugcuuggagccagacagcuuugaaaagggcagcaaauaaaaaacaacuuugauauuagaggugagagaaacucccggguggcugcaggaaauaccuguuugugagaucugccugggaaugagugacuuuaacaugaucuuguuguaggaaacauuuaacaguaugugccaccuaagggcuccuguuugcaaacaacagaaaauggcuugcauuaacuucagcagaaaaauaauuuacagggaaguuauugggcaguucacagaguugauggaaaagcuggagaauuagacuucagcagugaguaagacccaagaaaggcuggcagcagagaagaaaauggagucucaccaugcgaagagucaccaucuucacugugggaaauauggaacugucccauuccuuuggucuguccauccagauucauaauguccuggcuggaguauugcacaggauguuucacaccuccaugucuuauuaguguuuagugacugggaaugucuaauccuuuuugcuuucauaggggaguguaggaccgugucucucccauagacucacacaaaagagggaauucccccagauaauaaagccacugaaaggcucugcauucccacacacaccucuaaacucagcaccaaugaaaacccaguugauuuucaacauccuaauguaacccuccuucguacuuuuaagcacauugacagcauguccacaugucauuuucccagcaucauuuucugaauugcauuuguacuuacugcucguuggcuaugguaguuugcagauacuuucucccguucuguagcuuguccuuguaacccuaaugggagcaaaaaguuuuuaauuaugauggaguucaauuuaucaauuuuuuucuuuuaugaauugugcuuuggguuucaaaucuacccuagaucccaacaauuuuuauucuguuuuuuguuuuucccagaaauuucauaguuuuauguuuuacauuuaaguccaugauccauuuacaggugauuuuuauauaagcugugagacuuagauugugccuauggaugucuaaguguuucaguuccauuuauugaaaaggcgaucuuuccuccauugaauuacuuuugcaacuuugucaaaaauaguuggguauauuuguuuggaucuauuucuggauucuauauucuauuccauugaucuaugugugaucucuguguacauaggcuugauuauuguagcuauauaugauaguccccacuuauuugcaguuucaguuacccauggucaacuggcucaaaaauauuaaauggaaaauuugagaaauaagcaauucauccuaaguuuuaaauuguacaccauucuaaauagugugaugaaacccugcagcaucuuguuccaucccaccugggauguaaaucagcccuuuguccagcauauccacuguguauaugcuacccacccaucagucacuuaguagcugccuugguuaccagaucaacugcuauguuaucacagcgcuuucaaggaacagugaaaucguacaguggcacgaucucacugcaaugucucauugcaaggaacccuuauuuuauuuaguaguguacccaaagcacaagaguagugauacugguauggugguguaauuguucuauuuauucuuaguuauuguuguuaaucuguaacugugccuaauuuauaaguuagauuuuaucauagguauguauguauaggaaaaaucguaguacaccuggguuugggugccauccaugguuucaggcacccacugggugucccggaagauauuuccugcagauaagagggggcuacuguuaauaagccuugccaucagaugaacugauuugugccaguuucuuucuuuuuuuuuuaaaaaaaguagcuauuccaguuacuuugccuuuacauaugcauuuuagaauaaucuugcuugugucuauaagaaaaucauuauuuugggggaggaugauguauauuuuagcuucuaaauguuacauuuuguacaaagggcuguaugcuggaugcuauagauauuauagguaguugaagggaacaaauucaccucauauuuaaacuuauaauuuaucacucauaaaauaaauauuuuucaugaaaagguaucauuuuaaauguaauaaaauauuuuuuuuaaaaacauaccccgagaaacuuuuuuuuuuuuuuuuuuugagacagaguuuugcucuuguugcgcaggcuggagugcaguggugcgaucucagcucacuggaaccuccaccugcuggguucaagugauucucuugucucacccuccugaguagcuaggauuacaggcaccugccacaacgcccagcuaauuuuuguauuuuuaguagagacgaaguuucgccauguuggccagguuggucucgaacuccugaccucaggugaucugcccgucucagccucccaaagugcugggauuacaggcaugagccaccaugccuggucaagaaacuucuuaagaaguucaaauauaagaaguaaaauagguccacugcuuauaaauaacuucaaugggaacuucacugaaaucacacacuaaagguggccauccgugcacaaacuaugaugguguguuaaaaacuauaaaaugauuuucagaauauuuagggaaaauuaaaacaaaaauagauauggucaaucuagauauuuaguaauucaaaaauauauaaaucuuaauuucuugguacuauaauuuuuaaaacuuuagaauccacagcguggucuuuucuuauggcacauuuuuaacaucuuuugacuuguauaaaaauacaacauucuauuugagaacacaaauacuguuuucuccauauaauuacaaugugauucagugggaguuuuggugacugcugguguucaccauaaauuauuacuuuagugcauucugcagucuugcaaaauggguuucauguuacuuuuugcauauauaaaaagcaugcagcuacagugacccauguccaaauauuccaaagcagucaccaucugagaaauugcuuauggugucuauaaaguuagccacgauguuuuuuaauccccccggccaugagccugagucucacucuguggcccaggcuggagugcaguggcgcgaucuuacaucacugcagccuccaccuccuugcuuuaagcgauucuccugccucagccucccaaguagcugggauuacagaugcacaccaccacaccuggcuaauuuuuguauuuuuaguagagacaggguuuugccauguucgccaggcuggucucgaucuucuaacugcagguaauccgcucgccucggccucccaacgugcugugauuacaggcaugcaggcaugaggcacugugccuggucugcaacauccauuucuuuuuguuuguuuguuuuugugauggagucucacucuguugcccaggcuagagugcaguggugcgaucucagcucgcugcaaccuccgccucccggguucaagcaauucucccgccucagcucccugaguaccugggacuaaaggugcccaccaccacacccagcuaauuuuuguacuuuuaguagagaugggguuucaccauauuauccaggcuggucucgaacuccugaccuugugauccacccaccucggccucccaaagugcugggauuacaggagugagccaccacgcccggcacaacauccauuucuaauucucaguauguuuggcuaggguucuuaguaaagggaaagauaaauuaauuuuuaaaaucuuuaaaauuuguuuuuucuuugaacucccguuccaaccuuggcaaaggaacuuuuagcucuucugaacuaucacccucacccuaucucugccaugucaucuacaaauucuuuuuuuuuuuaaguuuacauugaguauugcuccugaacuugcacaccugugaugauacacugauacugaaagggccuggguuauagucaucacaauacuguugaauuccaucaacuccagcuguuuucaccuugugggcucuuauaccuguuauucaguuguucuacuuuuucuggucuauugaauuucuuguggauucuuuguagaaugaaucugaguuuuggaagaaguugucugcucaauuuccccauucugcauuaagcagcagcuccuuaaucagccugaguaaaugccauacacuggagggucuuguuuuucuuuucuucuuuuuuuucuugagguggagucucacucuguggcccaggcugcagugcaguggugugaucucggaucacugcaaccuccaccucccagguucaagugauucucccacuucagccucccaaguagucuggauuacaggcaugcaccaccacgcccggcuaauuuuuuguauguuuaguagaaaugggguuucaccauguuggccaggcuggucucgaacuccugaucucaggugauccgcccaccuuggccucccaaaguguuaggauuacaggugugagccaccacgcccggcauggagggccuuguuuuucuaggacaguuuaagcugugcucacauaaacuugguguuucugaggcuccccguucacuggccagcccugcagcuccagaccauucacuacuucauuuuaaacagaugucagaaaagcacugaccuagccuguccuccauauauaauaguuuguugaugguugcuuagucuggguuauguagauaagcaauuauuuuucauaagacuuuucuaccaacagguggcacuaacaauuuguuuuacuaaugccccaguaguaauccuugugucacauuugaauauaucauuugcacuuuuuggguugaaacauagcugauuuuuauagauguuuaaggccagagagagagagagagagagaaauccagcauuucugaucaagucuuuagcauauagucuuucuccuacacuacuggcucauagccaguaaucugcuucuuccuucauuccuagucuacaccuugauuggccuuucaagaaagucagaugaauagaauucaugagaaaaacauagggguaaauauaaaauguuuuucuugagguuccuuacuguaggggaaaggaugacauucauauugauugccugugcuggaggaauucaauuuuuaaaauauuuacuaaauacuuauugcagaacuacuacaugcagaguacuguucuauauauucccuguugaagaauauacagaacucugagaauuagacccuacugucagagcuuaugcucuaauugagauaagacaggcauacaaaguaaaugugaaaucgguaauaauuuucuauguccaguacauguauaggauauuaaugucagauaagauuguagaguaaaaugcuaugauaauuuggaggagguagaggauuauuucuuuaaucaaucuaucaaauauuuuuuaugucaguguucuuggaauagagaauacaauugugaacaagguugacaaaauucuugccuucagggaaggccucucugaggaagugacagagcuggauugguggcuuuagggaaggcuuugcagagaguuguagccaguugaagaaugggcaggauuuggcugagaagcauuugaccuugaugaucucacuacacaucacaucugcccugugugauggguacuguuacuauccccauuuuacacaucucucaggcacauaggcacagggagaugaaguuacuugugaugugagugguuuccugaagcacggcauauucauuuucuuguccucaaaaugaaaaaaccucaaauaggcuaggacuuguuuuucagaagccaggaaaacagaagagcagucuuugccuuucuucuuggaagagagcggagauagcugcagcugacucagugcgggugacgaggaacggggugacucaggucuuguaagacaggcuuucuuucuucuuuucuuucuuuuuuuuuuuauuuuuuauuuuagcuaaaccccccaguucuaucaaucagacaagacuucugcuagaaagaaaaucagcauuugcucccacaacucuccguccuuggagagcacagugugcucagaagagcagcacugcuugcaaagggagcccguagcucugggaggcaggcugacuccacacccaagucuucaucugucacuguuggccauuuggcauguagcacucagaccucaguuucuuugugugcaaaaugggggugauggcauggagaacauacacauuuuuuaaaauucuuaccgauuuucuguggguaacauuaaaaaaaguuauuuuauuuuuaaauuuucauuuguuuaaaguuuaaauuuuuguaucuuuuuuuaguauuuaauuuuugccuucagcuucgcagacauacacauuuugaaugggacugauacaucuauuacucauuucccuucccuuccugcacaggguacugggaacaugaaauaacagucuacgauugagucagcauugcucaccggaauguuagucauggcauaugcccugaaaguggugccuuccaggaccguugagaugaggauggccagccccuaacagccaucugcauccggggccugggagagccgaaccugagacugccaggaauggugucacauuaaaagugccucauucuuuuggggcugaucaggcccuugacucgauauuugguaauacuaagaaauuauagagugaugauuuguuuucaccucauaggugugucuuccuuaaaccuuguuaagauguugacacauuacccauuuaaagggggaaagaaaagggaaaaaaaaaggaaaaaacugaaguucauuguucuaggugugacaauuguguuuguaguuauuuauuuauuuuuugagacgggaucucacucugucacccagguuggagugcaguggcaccaucucggcuuacugcagucuccgccucacagacuccagugauccuuccaugucagccugcccaguagcugguacuacagaugcaugcuaucacaccaggcuaauuuuuuguacuuuuaguggagacacuguuccgccaugcugcccaggcugaucuugaacuucugagcucgaaugcucugcccacaucggccccccaaagugcuaggauuacaggcaugagccauugcacccggccuguaguuauauuuuuaaaaacaauacuuaucuuugaaggcugcauauugacauuugaacugaugauaggauguuugaaguuugcuucaaaauauauaguucagcaugaaagugguuagugagaaauauaauaggaaacaagauugaccguaaaccaaauuguuacagcuggcugacacacacgucguaguuccuuuuguucuucacuguauuuugguauaguuuugaaauuuuucauaauaacaaaaggcuauuuucaaugcgugguccugagcaaggauauagaaagcuccaucuuuggguaggagugguugagcuguagugcacaaacuggaugcuguugcuuugauuguuuugauuguucaagaccuuuugacuccagcagagcuccuugaugagcuucucucagcgucuggacagugaccaugugucacgugcuggugaaccccuggccagggcccaauaaauauugaaugaguaaaugaaagccagaagaccuaaccgugaucccuuucuucuugucuuugcaagcggagcccagggagaauaugcuggacuggccacuauccgagccuacuuaaaccagaaaggagaggggcacagaacggugaguauggcaggagguggcgcuugcucaccauggggcacagagguccuggcucucagggucccuucugugggacacucccuccaagccuucuuggaagcagaugagggaacauauagucaagaaacaaauuucugugaacuagccauuaugauccuugcuuccaagacaucccacuugaccauuuugaggaaaaacauucagagauaaaagacuugcucaaacccagaaugcaaacgucagccaguuggcuguggaacugcucucuagggagcagagggaggaagagggcaggaauguugccauugcaagcauccucuccuuggcucagccccggcccugggccuggaugaagggcagagaccaugcuuuaauucuucaguaaccccuguugugcugaagcccgguucuggucauaguaugcucaaacaauauuuguugaauaaauaaauucuccauuagaugauucucaacuucaagcaccaaaaaaggcauaaagcagaguucacgguccugcuucaauguuugcuuuggauaugagaaccuggucuccaggaucccaaucgccucuuggggaccacuguggggaccagcagguacuaauggacaccacucgcuccccccaggggcagugccuguagcaguggccuaacucaggccucagcuugugccagaggaggccuguguuccugguuccuucauuuugauggccagugcuaugcuagaguuuguacugagcuguggggcggaaguccuuaauaggagcaucgccuaggagccgagagcagggcaaaagcaucugcugauacuagagaguugcagacaaaggggauaggguggugcuggcuggcuaaguaaguaggguggagugguaguggcccgaucuuaguccauuucugguuuuauuaccacuggaagguuacuuauggcuaguugccuggaauuugcaauaaagaaugcugaaaguguuucacuucccuuucauaacaggggaaacgaaggaacauuuuuuucccuccuucccuugcauaguucauccugauuccacaggugugucuuuccaggcuuucaucuugguuggggaauagaauuuuuuuuuuuuuuuugagauggagucucgcccuguuccccaggcuggagugcaauggcccaaucucggcucauugcaaccucugccuccuggguucaagcgauucuugugccucagccuccugaguagcugggauuacaggcaugcgccaccacgcccggcuaauuuuuguauuuuuaguagaaacagaguuucaccauguugaucaggcuagucucgaacuccugaccucaggugauccacccgccccuggaccucucaaagugcugggauuauaggugugagccacugcgccuggcccuuuuuuuuuucucuucauagcucacugcagccuugaacuccugggcucaaggaagccucccaaagugcuagggagaccaggauuacaggcaugacccucugcaccuggcccuagaauucaugucuaaagaucuuugaaaaacaggccauucgugaauugaauaaaugauuaaacccuggucaaggacugcuugccaguccagagagaagugaaguggucaaccagacagacacagacccugaaauucccccacaguuuguucauucgugguucugaauucucagcuuucuaaggaaugauuaguuuagaacuauaauugcucuugggaccugagagucucggcacuuucacagaaucagaaaggaaacuuuggagcuccagguguccagccaguaaaacaaugccagauucucuccugucuguuuuucccucauggcuuccauguucugaggucgucucuggaguuccucuucauuaguaucuuucaccacgaggugcccaggagccuggggaugcuggaaaggggcagccuguccugugugacaucuccacccgacuccuccacugcuuggcggagaggccgcagaaagcaguguuugcagaaagcaggugacuagcuaauggcaaagggccagcuaaaauccagauucuuuccacgcaguaaugcuucccaccccucgccauuucccaaauuucccaaucugacaccaggaaguagcugugaauguccagcagcuggggaccaaacuggaaaggccaaggagaaagaaugaaaggccuuuggguuuggccugggcgggguucuuccgugacuuguggauucuuucugguuccuguucccucucuuuguguuuuccuguccuccuucccuucuccacccacugugugugauguuucucuuggccccauugcccauccugccaucacugaagugucaugagaggccauuucacucugcaggagggagaggggcugggugcugugcuucagggagagggggaaagggagaggcagggaagcccuccagccacugagcugguagaaauacaaagcucauuagccuggaaauguuggcauccuucuggaucagaaauuuuaauuagcucgggcaugguggcucaugccuguaaucccagcacauugggaggcuaaggcaggcagaucaccuaaggucaggaguucaagaccagccuggccaacauagcaaaacccugucucuacuaaaaacacaaaaauuagccaggcaugguggugcacgccugugaucccagcuacugagggaggcugaggcaggagaaucacuugaauccaggaggcagagguugcagugagcugagaucgcaccacugcacuccagccugggcaacagagcaagacucccucucaaaaaaaaauuuuuuuuaauuaaagccaacuuucuuaguuagagaagaaaaugauuuaguauucacuaaucagggaagauuuuuucacaucacugaugucugaggcagcugcucccacacaauagauucuaauggaauccagcaaaauauaucauucuuuuuugaaagggaguguggggaagucaugugcagggaguguggggaaaucaugugcuacagaagugccugggcuccugaugggucuuuucuuucaagcugcuuuuugaaguuauuuucacauuuucucuuagguuaaauuucagagguuccuaaaauggaaugccuaacuucuugauuuaugaguuuacuuugggagaauacaaauuuauuuaacaaacacuuauauggcaauuaccauguaccaggcauggccuuuaacacuuuauaauuaauauuucaauuugucagucaaauccugacuuacucagcagaccuccagaucuuacgaaaaaauaaaaacucuaaagaaaaacaauuagguuugcuguucagagucugaguuuccuauacaaagggaaaacauugaccaaaggaaacaaauuauguuauauguaaaucaacaaagaaagcucaaaaccuguaugggaauauuuuuuucuucccaacugccugagacaaaguaguggccuuugguuguuagauuuuaccagugguaagacauuaguuucccuugcacaggagaucuccuuaacccuucacucauucaacaagucuaaagaugaccucaugcuauucuaugccacgcggcacccuggggaguugagaaaacauagcacccccuaaaugggcaucaaugcaccaaaugcuggauuugcuuuggauaaaccaaaacuucaaaucugggucguguuacuuccauaucccucacaacaauacaauuuuuuucccccaagagagacucucacucugucacccaggcuggagugcaauggcaugaucuuggcuuauggcaaccuccgccucccggguucaagugauucucaugccucagccucccaaguagcugggacuguaggcgugcaccaccaugccuggcuauuuuuuguauuuuuauuagagacaggguuucaccauguuggccaggcuggucuugaacuccuggccucaagugaaccgccugccucagccucccaaagugcugggauuacagacaugagcaaccucgcccggccaacacuacaauuuuaaacugaggaaaaacuuaacauuauaaagaauaauuaaaguccucuaaauccucauagaaaaccagaaaugucugacagcaacauauaaaugagugcuucacaaagccacugugacuucucuuuccaucgcuccuuguaccaggauguguauuaguuuccuauggcugcuaugauaaauuucuacaggcuuaguggcuuaaaacaacacacauuaauuuucuuauaguugcagaggccaggugucagaaauugguuucacugggcuaaagucaaaguguugguagagcugauuccuucugggggagacaggggagaaucuguuuccuuaccuuuccuggcaucugcaggccuccugcguuccuuggcucgagcuuccugcuucagucagcacaucucccgcucccucuguggucccaucucccucugcuucccucugaugaggacacuuaagaauauauuuagggcccagcccaaaauccagaagaauuuuuccaucucaagaucuuucuuuaccuuaaucccaucugcaagucccccuugccauauaaggaaacacccacagguuccgaggauuaggacagggaugucuuugggagcccguuauucaguguaccacagggugguugacguuuuuauauguuuguguuucaacagaacucaccugguaugaauucuucauuuuggcuuucuaugaauauuuuauauuuauuuuuaacauuccccuuucuccuucuuaucaauauucugcccugaagggauccuuucauccaacgauccuuuuguagacuagcaauaccugugagagaggacagugccuccagcuuggguccucagaaauuaaagaaaaaaauuaacuacaaaagggaagcauucaaacaagaaaacggauuugaggacaacgugacauaaccaguaugagaccaacagccguucuaaagggacacaaaccuucugacaguagaagagugcaaaguaguucauguuugccuuuggcuaauguuuucuuuuuguacacguuuauuuuucuuaaguagacuccuuugcuguuuuugaggaaagagcuguaagcuaagauuuaacuucauagccuauuuucaauaaugcccauccaucucucugugggauaaaaaauaggaggaugauuuucaggguaaucauggcuucuccuugaugcuuuuuguuggggaaaaccuucugacuuacuuucccacugggacacaucgucaguucuacaagagccuguguccacaugguuguuuggaggaaaugaaggaugauuugagucugagaauuuuagcauugcaccuacuguccagcuuccauaaaaauucagugcagcuguaagcucuaacuuaggcucagcucuugaggcacuuugccuugauuuccuuaaccugaagcuacauccccuuguccauguuucugcugcaucucuggacucuagacagucauucacaggccaccauuguuagugagugaguugugugaacccgggguagggguuggucauuuuuauuuuuagcuauuuuuuuuuuuugagacggagucuugcucuguugcccaggcuggagugcaauggcgcgaucucggcucgcugcaaccuccaccucccggauucaagcgaaucuucugucucagccuccugaguagcugggacuacaggcgugcgucaccacaccuggcuaauuuuuguauuuuuaauagagacagcauuucgccauguuggccaggcuggucuugaacuccugaccuccaccucccgaaguguugggauuacaggcgugagccaccaugcccggccagguugaucuuuuuuuuuuuuuuuuuuuuuuuuuaaauacggaguuucacucuugucgcccaggcuggagugcaauagcgcaaucucggcucaccgcaaccuacaccuccugguuuaaaccaauucuccugccucagccucucgaguaacugggauuacagacgccuaccaccacacccagcuauuuuuuguauuuuuacuagagacgggguuucaccauguuggccaggcuggucucuaacuccugaccucaggugauccacccgccucggccucccaaagugcugggauuacacgcgugagccacugcaccuggccggguugaucauuauuaaugcuuaguuuaugguucuuauagaaacuaauaauuuauuacagaguaaacauccgauaaauauugauauaauugguguauugguacugggaggccuuggaauuaacgucugucauuaucaucuguccuggauaagccaagcagagcacugaagcugugaugugggcccugaguccuugaguuuaacuuccagucucauguucuucuaaggugcuuucuguguauccuaacugagacaagguuagaauaaguccaggccuauuuuuauuguacugggauaaaggaagauuguauugauuuccugagcaucuucagggaacaauauuuagggauucauauggaaacuuuuuuuggacauugcuuugcaaugacaaauaauuaaauuguagcagauuuuaaagcacuaguguucagccuaaauaaaaacagguggugucuaauuugugcuacaagcauguuguaguacuuuucugucauuauucauagucugaugaugauuuugcucuuucuuugcuuccuuucuauucuguagguuugccucauuccgaaaucagcacaugggaccaacccagcaagugcccacauggcaggcaugaagauucagccuguggagguggauaaauaugggaauaucgaugcaguucaccucaaggccaugguacuugucuucuccuuagcagaugggagaggccgggauggggagugcugguggggaucagggacuugauggauuauguaaaugucuucucuugcauucuaaugaaaagucugcaguucuuccuuugaccagagucuacucuaccccucccaucaccaacagggagaaauccccguuuucuaauuccagcuuguguaaaaaacugaaugaauuauucauggugguaguaagaguacuccuugcagaaccugccugccucuuucugcccaaucuucccucuccuucucgccuuccccacuuaauaaucaaaauggcagucacacuuacacaucuucgugucaggaauuguaacacaaaugucagcuuugcaaauauccaugacugugccagccccaucaugcugaauuccuggcaucaugcagcuugguuuccaccaacccccacucucaaccucccaaccuccaggaagaaguugcuuagcaaccguaucugcuucccaccagcggacuggcagcugcaucuuaagcgggaaggaaaccaguggaauagcaaugugauuuugauggugguguuauuaggcauggagacugugaacucugugcaguugccuucuaaaggaagcugaaaauccacaaugcugcaccucucuucgauccaccucuacccuuccauugcuccacaaagcuuuuuuccaacaaguguuccaggccaguaguugaaauuauuaagucccuccauuauaguaauauaggacaugacuucccuggccacccccauguucucaaacaugccugcucugauaugcuggccaggaaaacaaacagggaugugacuuuuauauaugcuugccuucuguaaaaggaaagaauaaagaagacuuuuauuuacagaaacacuucuugugggaauucuuuuuuuuuuuuuuuuuccaauuccuguucuuuaucuuuuuguuuguuuguuuugagacggagucucacccugucgcccaggcuggagugcaguggcacgaucucggcucacugcaaccuccgccucccggguucaagcaauucuccugccucagccuccugauuagcugggacuacaggcgugugccaccaugcccagcuacuuuuuguauuuuuaguagagacaggguuuccccguauuggccaggauagucucgaucuccugaccucaugauccgcccgccucagccucccaaagugcugagauuacaggcgugagcuaccacgccuggccucuguucuuuaucuuuuuaaaugacaauaguuguacauagucaugggguauauagugauguuucuauacaucaaauguauagagaucagaucaggguaaucagcauauccaucaucucaagcauguaucauuucuuuguguugagggaacguucaauauccuccuucuaacuauucaaaauuauauauuguuaaauauagucauccugcagugguauagaacucuacaacuuacuccuccuaucuagcuguaauuugggaauuuuaacuucaacagaaggcaagggaaaggaauggauaugagaagaugagcagagagauuaacuaugagaauggacgcaccuagaaccacaaacgucugaaaucguuauugagaugacuugaaccaagggaaaaccaccuuagagaguugggcccaaaauauccaaaaaucuugugaauaguccuuuuggucuggaccauagagaccuagccugaaaggaucuuauuauuucuuuuuuucuuuuuucuuuuuuuuuuuugacguggagucucucucuguuguccaagcuggagugcaguggugugaucuuggcucacuacaaccuccaccucaccgguucaagcaauugucccugccucagccuccuaaguagcugggauuacaggcaccugccaccaugcucggcuaaucuuuguauuuuuaguagagacgggguuucaccauguuggccaggcuggucucgaauucuugaccuuaggugaucugcccgccucggccucccagagugccgggauuacgggcaugagccaccacacccagccaggaucuuauuauuucuuuggaaugauuugugaagggaguaauggcugugguuuuuuuuuauugcugucauuguacuuugagacaguuccaggaaaguaaagacugagacuucaucuuucuucauccuuuaaaaugaaaggcgaggauuuggccaagaaagaaacauauccucccuccauguccuucucuaccccuuuucuuucacagguggauaagcacaaggagaaccuagcagcuaucaugauuacauacccauccaccaaugggguguuugaagagaacaucagugacgugugugaccucauccaucaacauggaggacaggucuaccuagacggggcaaauaugaaugcucaggugggaacugaagaggcccgcccuuaguucccacugagaaaauggauauguggaaaaaaaaaaaaauucugacuucuugagaggcuuccugccugagggaacucagacccacgaccugaccacuggugguuguugaucucucauggccuuggaaagccacuuauccuggcaucagcuuuaucagcugugaaaugggggcucaaagggcccaauccugauuacuugggggacagaggaucuauguacugugaaccucugaagaaaugcuguugggagccccugcaggagaggagugacacaaucuuuuugagacucuuauugguguuugcuuuuuuccuuuuucuuucuuucuuucuuuuuuuagauggagucucacucugucgccaaggcuggagugcaguggugcgaugucugcucacugcaaccuccaccuccuggguucaagcaguucugcugccucagccucccgaguagcugggacuacaggugcaugcugccacacccagcuaauuuuuuuaaauuuuuuuauuuuuauuuuuguauuuuaguagagaugggguuucacuguguugcccaggcuggucuugaacuccugagcucaggcaauccaccugccucagcuucccaaagugcuaggauuacaggugugauccaccacgcccgaccucuuuuuuuuuuccuaccauuuuagagccuuucuuugguucucauucauuucacaaguguaauccagagauugucuauugguucuguagcauaaaugaauucuguaccuuuggucaccaucaaaauuaguccuaacacccaaguggugggaaggcuagugggauggcaugccugguaucugggucaucucgggaagacugcgagccuugccuucccucucucaguucagccuccucccuggugcccccgcagccccuuccaucacugugcccaacggggccguucgguaacgugcaucauacuaaagccgaccacgcaggggaagguagcgcugcucagggaagaguugccuauuucaacaacauggagguucugcccuuucuuguguuagagacacuucucucccuuugugguguguggauaauuaggaagagacuguguauucaaauccauauuuuuaaaucuaaauuggacuaaauggucaguugcuauuuccauagcaaccacaagcacucugccuaucggaugccaguuugugacuacggaacugggccaguauagaggacauuucugugaacaccauggauguggcucugccugcuuuuccucugaggggagaaggcagcaccggccagccauggccuucacacuggagggugcuuccaagcucuugacuuuugcuuuuggcccuugccuuugugguaggugggaaucugucgcccuggagacuucgggucugaugucucgcaccuaaaucuucacaagaccuucugcauuccccacggaggaggugguccuggcauggggcccaucggaguguaaguucugggcugcugguuucaggauggcuuuggagacagaaugaaggaguggcccuaaauagacuacucaucccaucaaagucuucauguguugaggauacccucaucgguguagugcacuuguaggggcugggggaggagcagcaaaaugggugcuuuuaggggauuuccaaagaaaagcguaauuagauuuuacuaaccauagcaucuggccucacugagcuuccaguugcacauagacagcagguuuauuaacagaauaaugaauagggaacuucaccugagcauacguauuguaacuggaauauuggcacuagaaagugccuuucggacuuuuggauuuccuagcauuuuuuuuuucuuuuuuaaaaucagcuaaugguuccauugaaagugaauuagauguaagguguugagauaaguaacacauaaguaaggaagaaacaaaccugguuacuagaaauaauuggaugaagccagaguaggacugaaggaauauuucuuagcuguggauaacuuuuuacacugaaaucaaaucaucuugggaaaaugaugaugagagcagcuguuuuccugagcugcuucagucucccaaaaauaugcuaaagaagucaguuuucagaguugcuggaagcuuggccuucuuacuuuuuucuucuuucuuguuuuuuuuuucuuggacuacgguuaaagugagauucauuuugaugaugauuauuucuaguaaaugugugagcuccagugcuucagcugucagggagguggggagaaugauguucaugucagcccauggggcaucuucucaucagccccuccuauguccaucuugggaaaguguauaggggugagggaauggggcugggagugggagggagggacauggaacuccacuguuuuauggcugccugccucuaucaagcccuccaccacauuucuugggugagcccugggacacugauggcugguggaccuccaccagaggaggaaggaaggaaggaucgcuuccugaacaucugccucccagcagguggagagucccuuccacugucagagcuccucugcuaagaacaaggcuuucugggagggcccagaaccuucccauuagauuaaacugaaucguuuacauuuucugaauuugcacuuaaaaaaaauacaggaagaaacaucucgccccguuuuugcccaaucaucccgucauuucacuaaagcggaaugaggaugccuguccugugggaaccgucagugcggccccauggggcuccaguuccaucuugcccauuuccugggcuuauaucaaggugaggccugggaguaugugcaggugugcaggugggugggggcgucaggcaugcauggggaccggauacugcagacuucuuggcuuaaaaacaaauaaauucaugaucugagaugugguucaaagaauauugcugauggccuggguggaagaaaccuuccugaagagaugagcuaaaaaucauuucaucucuccuucauuacacuacuucuuuuggguucucagaguggguuuaacaucagagaaacugaaacaucagauauauuuuuccagacacagcuaaguuccaugagucauauggauguucuggccgcauccuuugguuuccugcaggauuuauauagccccuuccgagugaaaagcagugcauguacuaauuauuccacuuugcugagauccugcuauauaucucacuuugcuauauauuucuuggggggggccagaggagaagaugaaaaauagcagaaauuugcuucucugguuuuuccccagagcucuuuggccuuuaggguuuguggugcugugcucucugcguaauuagucagaguacaggcuuccuuccuuugucuuauuccaaauaacaccagggccagaguugauuuucuacaguucuuguucacacugcccugcccaccuccuggacugacaagacugugaauaagaacacuuguuuggcugcucauuagagcagucuccccaaagcagugccccucuuuaaaggaaggcgggcucccacugaaacaaaacccccaaaacgcagcuaugccaaucauuccagaggacucuguggagcugacuguuuauuucuggaacagcauggcauuuaugauucuucacgaaaaguuucuuggaagccggaacaauucuguaccucagacacuaacacuugcuuuuaaaaaugauacucaaguuguuuugcaaacaacacaagcaaucagaauaaaggucugcuucuuuguaagcagaaucaaauuccacuucccuuuugaucucuggguucuguaaaucuggguuauuuguaugaacauauuuggguuggagaugacuucccacauauaggaaauaaaugccccaagguugguuuggcuacaugccuggaacaacagcuggugccucaguuuaaaaacuaaauaaauaaaguaggguuuaagcugcccccucuggccuugggccuucucuuauuucaggcuguuauuacuuauccccuggacucuagcuuuagcugcuucucucccugcugcaauuccacaggcgcaccuacaggacugcuagacucacccuaggcccccacguaucucucguggcuuccuguugcuuuaccugguucucacuagccugcacgaaauccuuaggggauucuuucagaaugcacaugccuaggccccauuccaaggagaaccaaacugagcacauguaggguuggacuuaagccgucugcauuuuuaaaaaauccccccaugagacauagguugagagccagugguuggcuggacaaagucgaaguccuuccuagagaaguuuugggcuuaaaaauggagucacaacucaccuugcccuacauccacucccagaugacagucaugugcccuccccuuccacgccuucauuucugccauucuucucaccugguauaccuucuccuuucucuuucccuauccgaauucuacuuauuucuaaguuucuagccaaguucuggcucuuaaucuaggaacccuucuuugaccagccuggagcaauguggccccuuuuuacuuuggacccccuuaaugauaccaaaguacuacuguuguuuuauuuggugcucucucauucucuuuacauuaguuauguauuuaauauauaugccaacuccaucacaugugagguacucugggaagaaaguaggccauaagaauuggugcagucuugauuugaagcucuuugcagugaugauguguaucccuuaugaucacagggacucuuaacuaccaggacaagauugagcaguuuuuaaacauaagcagccucuacuagggacaaugggaaaauaaaccagacaaaauugcuuccguggagauauuggcccagaucccaucggauuccuggcaauuaucaagaccucucaaauucauaguaaacaaacaaaaaaaucacaaaacacauguaauuuaagaacaauucuuuucucucuuuagauaacacaguagucaguagucagcuugcccuguuguaggcuuugcuacuacaauaaagaacguaaaacuacuauuaaaagaagaaaacaaaaauguauuacaggcuuacagggaucugacagauauccuuguuggaauuuuccacucaucuuuacuccagagucauggugggcugccuuccuuuguggguggaguuuaucugggggugucuuuugguugguuucuucacauucguguuugccuguucaauggcuaauggcucuuuuucccuuuguugcagaugaugggaggcaagggucuuaaacaagccacggaaacugcgauauuaaaugccaacuacauggccaagcgauuagaaacacacuacagaauucuuuucaggggugcaagaggcaaguaucaacuuuaaucuaucauuacuuugguuuuuuucuuggccaaacuaaguuugaccuagaugcgcuuuucugacaugggcaagagacuucuauuucuuagcacauaucagaaaauaguguagaguucuuggaaauaacucggguuuauuuuauuuuaucuuguuauuuuugagauagagucuugcucugucacccaggcuggaguccaguggcaggaucuugucucacugcaauuucugccucccggguucaagcgauucuuuugccucagccucccgaguagcugggacuacacgugugcaccaccaugcccggcuaauuuuuauauuuuuaguagagacaggguuucaccauauuggccaggcuggucucgaacuccugaccucaggugauccaccugucucagccucccaaagugcugggauuacaggcaugagccaccacgcccagccauaacaccacuuuaguuaacuguuuaggggcauuacuauaugcagguuucuccuaggcuccuagucuacacagcagcccaggucaauaaagauuccacaacacugaaauguguacauaaauaccauaagcuaauuauuuacaaagugcuaugauaugccuugaaagaguagaguaacucagacuggguagaggcaggauagaaugguugacagcgccuucuugcuggagccauuugagaugggccuggaagccagcguagccgaugagagccugaguaagcagagacacaggagcaaaccagagaaaagaaagcucucuggucuggagugaaggaugggauaggggagagggagcaaaugacaaugaggcuggaaauguagcguggggccuugaaggccuuggaaggcucuggacuucacccuugagcuggacaauagccauuaaagguuuuugagcaggggaggguagggauucaugaagagaccguuacaaucauuaagacggcggcaagggggaaacaugccuuagagguagcaaggggcuggggugguggcucacaccugcaauccuguaaucacaccugugauugaagguuagcuagccucuagggcuuacaguagagggaauaauaggcaggggaacaaagucacccuggaagugaugggagggaacuaaaaaccaggcauccuuuuacacauugggcugugggcucaggaccuaauagcugagucuuggaaguggugaggccccaggaaagaauauugaaggugagaagccagaacaaaacgccucaaguagauggcuacauuaagagggagggagaaguugggugccuggugaggggcacuccacaccugaggcagcuuuagaacccuggcagugcuuggcacagugccucucccucaacaccccugccuggcccuccugcugccguguggcuccaccuccucccugcagccuccacucccuccucuugcccacccccgaccccaccccggagcagcugcucucccacuugguauugucuggcucuguccaucugacuccaggguccaggagagaguggaggcugcgccugcuuuguuucucuggcagucaacagacaaaugcacgugaugacgcauaauaaggagagacacuguaaagagcggguggcugauuuaaucuuacuuaaguuuauuuagauuuuuucugcuuuuacugagguaugauugacaucugauuuuaaauuaugagucuuaaaaggaaccuuugucuauaacaauuaggaagccuuugguagccuuugaaaguaguuugggcacaauggugaggcagacgcuggguguuuaaaaugggcugagauguggauggaggucgggaaggagaggggaaaaggauuccauguuugcagguagugaaggaggagggggcugcuucaguaggauguaguuauauuuucuuuuuaacuaugaaaacaacaugauuuuaagcugugagaagggagagcaaagauaccuuugagagaaaaacagaugggggaacaaagucacccuggaagggaaaggcuggaacugagaaccagguacaaguccuugcuaugggcccagaguaagagcaggacagagaccaggaccuggagcuuagaucagagagacagacgucaggaaccagcccacccgccugcaccugggcaacagcaacaaagcgcuuaugggaucuugguuucucugguccagguggaauguagcucuauagcugugaucuuuaauuuaauggcuggucuuaccuuauaaaucaguauccaaaggggugguuccacaguuugaaaaagaauaggaccaaauaaccagaagugcugguuaaaaugcuccccagagagcagaaaacacaguugugggcaacaugucucuaagcagcacaauaaaaugcuucugugaaguggguacuaaagaagugacaagagcuucugauuaauucaaaucuagcuuagcuccugcucugugaaauguauccugcuuguguauuggcuuuaaggaauagcuucaauauuuauuucaucagauuacauaaauaauguauauaugcucaacacggacauuuuggaaaauaauaaagcaugacaaagaaaauguaaaugguccaugguuccaucaaucaguuauagccauuacuaauauuuucuguauuucuucuccucuuuguuuguacaauugaucauacuacagauaguuuuauuaguuuguuguccaggcugaagugcaguggugccauggcagcucauugcaaucuucagcuccugggcucaagucauccuccuaacucauccucccaaguagcugggaacacaggcauacacccgccacaccuggcuaauuuauuuauauauauauuuuuuguagagacggggucuugcucuguugcccagguuggucuugaacuccucugcucuagugauccucccaccucggccucccaaaaugcugggguuaugggugugagccacugcaccuggccuacaaauacaguuuuuagccuauuuuuuaaauguauauuaugagcauuuuccccugucacuaaauauucuuugaaaguggcacugucaauuccauuguguagaugugccaugauuuaaccaauuguauaguuuuucuucccuuuguuugcauuuauuacaauguggccgugaguauccuuugcuugaaauuuuaaagaauuuugccugauaauuuccuuaggagagagucauagaaaaaauuauuaucucagaggauauaaaugcacugaagcuuuugacauguauggcuucaauuuuuuucccagagacuuugugccaauuuaucucacagugauaacauaugagaguggccaucacacaggggccuagugaggacugagaacuagacagaagaacaaguaaacaauauaucauggccaauuugauaggugaaaaugaccuuauuguuuuaguauauguagccaaugcgcucaauguuucccuaguucuuagugccagccuuguccauccaggguaacuguguucccccaucuguucugucuacuuccuucuccuucacagcugacucucugauuucacagcuuaaaaucauguuguuuccauaucuuaaaaagacauauaacugcauccuauugguuuuuucccuaauugcuuauuuguucauauuuuaaacuuccucacguuuaauuuuauuuaguagcagccggguguguugguucacaccuguaauccaagcacuuuggaaggcugaggcggguugucuaaaaguaugacacuuacauuuaauauauaguaccuaauaauaaugauaaagacuaugcugcugguuuauguauucacuacauaaugcuucuuaucauuauuauuauuauuauuauuauuuuugagacagagucucgcuuggucacccaggugggagugcaguggugugauguuggcucacugcaaccuccgccucccagguucaagcgauucuccugccucagcuuccccaguagcugggacuacagguguucaucaccacgcuuggcugauuuuuguauuuuuaguagagacaggguuucauccuguugcccgggcuggucucaaacuccugaccucaggugauccucccaccuuggccuccccaaaugcugggauuacaggcgugagccacugcgucuggcccccaucauuauuuuagaguguauuccuucuacuguaaaaaaaaaauguuaacuguaaaacagcuucagggcgguccuucaggagguauuccagaagaaggcauugucaucacaggagauagcagcuccguguguguuacugucccugaacaccuuccagaggacaagaugucggagguggggcuaggugcuguggcucaugccugcaaucccagcaguuugggaggccaagccgggaggguugcuugagcccaggagucugagaccagccugggaaauaucaugagaccugucucuuccaaaaaaaaaaaaaaagaaaaaauuaaccaccaugguggugcacaccuguagucccagcuacuuggaagguugaggcaggaggauugcuugagccugggaaguugaggcugcagugaguuguaauggugccacugcacuccagccugggugacagagugagacacugucucaaaaaaaaaagaugaggagguggaagacaaugauauugagcauccugaaucuguaggccuagacaaagguguguguuugugucuuaguuuuuaacaaaaaaguuuaaaaaguaaaaagaaauuaaauauagaagaaagcauauagaauaaggacauugaaaaagaaaauauuuuuguacagcuguacaauguauuuguguuuaaaguguuauuacaaaagagucagaaagguuuaaaaaauuuaguuuauaaaguaaaaaaguuacaguacgcugggcaugguggcucacgccuauaaucccagcacuuuggaaggcugaggcgggcagaucacuugaacucaggaguucgagaccagccaggccaacauggugaaaccccgucucuacuaaaaauacaaaaauuagccaggcauggugguggacaucuguaaucccagcuacucgggaggcugaggcauaauaaucgcuugaacccaggaauaggaggcugcagugagccgagauugcgccacugcacuccagccugggcaacagauugagacucugucucaaaaauaaaaaaaguuacaguaagcuaagguuaauuuauuauugaagaaaaaaguuuuuuuaaauaaauuaauauagccuaaguguacagcguucacaaagucuaugguaguauacaggaauguccuagaccuucccguucacucaccacucacucacugacucauccagagcaacuucagcccugcaagcuccauucaugguaagugcccuacacagauguaccauuuuuuauguuuuaugucguauuuuugcucugucuuuucuauguugagauauguuaagauacacagauucggaccauuguguuacaauugccuacaguauucaguacaguaggagcaagaggcuguaccauguagccuagguauauauaguagacuuuaccaacuaguuuauguaaguacaccaugcuguuugcacaaugacaaagucaucucacaaugcacuucucagaacguauucccuucauuaagugaugcaugacuguauucugcuagaaugaggaaagaaaggaauuaccucagguaagaugauacuuuuuuuuuuuucuuuuuuuugagacagaguuucgcucuuguuacccagacuggauugcaauggcgcaaucucagcucaccucaaccucugccucccggguucaagcgauucucccaccucagccuccugaguagcugggauuacaggcaugcaccaccaugccuggcuaacuuuguauuuuuaguagagacaguguuucuccuuguuggucaggcuggucucaaacuaccgaccucaggugauccacccaccuuggccucccaaagugcugggauuacaggugugagccauugccccggcaaguugauacauuuuaaaggaagaauugcaaaaauccacagcugucuacuuuuauaggaggcaaagguuugaucugaauggaguucccauuaguaggaggagaugacuuuguuaguaucccaacguuuucuuuauguuuuaauuucuuauaugccuauccauuuuuuuuuuuuuuuuuuuugagacagagucuugcucugucacccaggcuagaguccaguggugcaaucucggcucacugcaacccccgccuccccggcucaagcaauucuccugccucagccucccacuaugauuacaggugcccgccacugcacucggcugauuuuuguauuuucaguauagacgagguuucgccauguuggcuaggcuuaucuugaaaucuugaccucaggucuucugccuuuuuuuuuguuuuuccaucagacaaacagcgacuuugccugcaaauaccugucccugcggagguuuccagguggcccuugcuguaugggugggcaggggccucaggggcugggcccucacauccuuggcucacaagugacccugcucagucccgcuuaccugaccucauucucggggaaaccucauucucgcuugaacuacagggaaacagccgggagguuugauucuguuagucauguucuguggauuucagcuaaaaggcuugaccaagcauugauugcccagcagagcuuuccagaguaguuacccagugaguucauuuauuccucagcagccgccuugaggaugggggauaaguaaggucuggucccuucucucaaggaggguuuugagcagcccuauuuuuucacagcacacucccauauuguucuuacccucagaagacaaucaacauaugggggcggugguucccacuuagauagccacccaacguuuaccuugcuuuuccuucaucccccccccuccuguccuccuugccccuuucacgugguaccuucucagcuguagucacuguuagguccagcagaaacaccuacucuguuaacacgaaaaguuggugcugagugguuuauucaguuuccacuugauaucgccccaacauugcccuauagcagguuuguguguccuaaaagcugcaaagaacaucuuaggaucuggcuucugacagccaccaaguugaaauuucaucccuuucagggcucacauagagauggagagagaugcuggaauuccaccgcaguuucuauuugaacgcaauagaguauggauuuagaaaauaacaucugaaccucauuuagaaaauggagcucuuccuaaaccucuuggcuaugguggggaccucuucagauggcacuguaguauuagcagugcuguguugggcuuggcuugacggugccuuucagcuauuacugaaccucugcuuggaagacucuccucuugcgcugccagcaagagugccuccucccccacugugucucuccccuccuccccucccugcugucuggugucauuccgagcagugagcuuccauuagccuucguccuccaaucauugucacaaucagggcauuuuguuuuguuuaagagacggucuugcuuuauuacccaggcuggaguacagucacauuaucauagcucauugcagccucaaccuccugggaucaagcgauucucccaccucagccucccaaguagcuggaacuacagaugucugccacacaccuggcuaauuuuuaaauauuuuguaggauagggucuugcuuuguugcccaggcuggucuccaacucccaagcucaagcaauccucagcugagcauuuaagaguccugguauuaauaguugauaaaaacuuagucuaaugauuuuccccuugaacauuccacuuacuauucuguuucagcauuuuuucccuauguuuaccuacccaugaauaggauuuucuaccucuuuuuuuuuuuuuuuuuuuuuuuugagaaaaggucucacuccgucacccaggcuggaaugcagugaugugaucucggcucacugcagccuugaccuccugggcucaaaugauucucccaccucagccuuacacguagcugguacuacaggcaggcacaacugcaccuagcuaauuuuuuguuuuuuuguagaaacaagcucucacuaugcugcccaggcuggucucaaacuccugggcucaagcgaucuuccugccucggucuccugaaaugcugggauuacaagugugagcuaccaugcccggcugaauuuucugcuuuugaaucauacuccuuacaguuuauuccccaucauuguuagaaagcauguuuugccugggcgcaguggcucacggccuguaaucccagcacuuugggaggcugagguggggggaucacuugagcccaggaguuugagaccagccuagccauagugagaccccaucucuacaaaaaauacaaaaauuagcugggcauguggugcacaccuguagucccagcuacucucaggaggcugaacugagaggauugcuugggcccaggaggucaaggcugcagugagcuguuauggcacuacugcacuccagccugagugacggagcgcucaacugugucucaauuucuuuuuuccuugagacagagucuugcucugucaccaggcuggagugcaguggcaugaucuucgcucacugcaaccuccgacucccggguucaagcaauucuccugucuaagccucccaaguagcugggacuacaggcaugcgccaccacgcccagcuaauuuuuguauuuuuaguagagaugggguuucaccacguuggccaggauggucuugaucucuggaccucgugauccgcccgccucggccucgcaaagugcugggauuacaggcuugagccaccgcgccuggccccuauuucaauguuuuugaaguuuuuuuuuuuuuucuucaagcgugguuuaaaaauaugcaguuucaguauauucagagucuuacgcucuuuauaguuuuauuuucaaacaaaaccacuucuuuuuuuuuuuugagaugaagucucgcuuugucucccaggcugcagugcaguggugccaucucggcucacugcaaccaccaccuuccagguucaagcaauucucucacucagucucccgaguagcuggaacuacaggcacccgccccuacaccuggcuaauuuuuguaauuuuuuuuucguagagacaggguuucaccaugucggccaggcugguuuugaacuccugaccucaagugauuugccugccucagccucccaacgugcugggauuacaggugugagccaaugagcccagcuccaccucuuucauguuuauucauucuauaagaagcagagcaguucguagacugucuucaggggcuauuaauuacuggagcuauucuucacaggcuugagaaguuaugcuugcucugagucucuauaaguggauucauuuuugcugagagugaggaaaguggguuaagaagaaggaguacaucauuaucucaugaguagauacuuuccuggaaggaaauucaucaguugguggaccguggaauuugggaagccccggaggaauauuggucuauuuauuaaaacgcugacuuaaugguuuauuccugaugaugguuguguggucaguagcucauucuggggagcuacuggcagccuggaccuagagaagaagccuguuuaugaacuacaggucgaauaucccuaaucugaaaaucuaaaacuuuuucuaaaaauuuauauuuauuuuuuugagacagggucuugccccuauuacccaggcuggagugcaguugugugaucgcggcucacugcagccucgacuucccaggcucaggugauucuauuuuuaguagggcuaggguuuggccauguugcccuggcuggucuggaacuccugaucuaaaacgaucugcccaccucagccucccaaagugcugggauuaccagcaugagucacugugccuggccugaaaauccaaaacuuuugggugcccacaugaggcucaaauaaagaucuguaauuucaaauaagggauaugucauugguagaacaaagugaacugggucgcacagacuuuggccucauuaacuccuuguuacuuacgguauacuguuugacgucgcguauuucuaauucuuuguuugcagccugaaaccaaaacaucaaaagguccuucaaagaaacauaaaauucuguaugugucuuauggauauauguuuaauauauccauaccuauauauacgcaaaaguaauuauuugauguugaggguaaaguugcugaaaagugucaauggcucuagaaauauuuuguauaaaaggaucaggacuauacaacacauuuaacuguugcaaguagauuuuauguccgcagaauagaaauaaucucauccccagacaccuccggucauauguucaguaaugccccccaccugccauuagccauaaucagguucacagguguguagugagcugaagauaagacacaucggcacagugugcuaaacauuuuuauuuguaauaagacuaaaugaaaccuuuauugccaauaauaaacuuacccggugcccauggcuucuugguccucgcugauacacauaaaaagcugaugcacuuauuuauuaaauuacuuauucauuuguuuggguaaaacaauaagcugaugcuaaucuugggcugaaacaacuuuccugaacagguuaugugggucaugaauuuauuuuggacacgagacccuucaaaaagucugcaaauauugaggcuguggauguggccaagagacuccaggauuaugguaaguggcuuuugacauucaugccgccgcccaugcuggcuguggaccacuuccuaaagcacaaauggaaaaugcaggcaccacaguaaacugaucugggggauaaauggggagcucaggguucuuggcaaccuccaaaauaauagagaaaaaaguuugcuuaugacugcacugguccugcccuucagaagauauuaaaauaugcaucuugaauccauuaacagccaagaaaaguguuuaagauuaaaauuaaaaccccuuugaguugcagugaguguagugguaaaggagacagagcaaguaacccaucgaagugguagagacaaauggcauuggaguuuuauagccaccucugucauggcguagcuguuucagcugcuucuagagaugaagaaauaaguguaguaguuuucacaaagaaaaugcaacuuucuuugaagcauuuugaaagacacggacacuuuaccugugcauuaguggguguucauucagcucagcucacuacauuuuccuagugaacaauguuauuaauauuaaaauauuaagaccauauuacuuuuuuggggguuggggagacagagucucacuuugucgcccaggcuggagugcagugaugugaucucagcucacugcaaccuccaccuccuggguucaagugauucucaugccucagccucccacguagcugggacuacaggugcacaccaccauacccagcuauuuuuuuauauuuuuaguagagaugggguuucaccauguuggccaggcuggucucagucuccugagcucaggcaauccacccaccucggccuccgaaagugcugggauuacaggugugagccagcacgcccagccaauauuacuauuauaauaauaugaaaaugauaauaauaucaaggaucuuucaauucucagaaaggcuaaguuggggagaacauugccauucaauggauauggaguccucucugaguuuuaaugacuuguuuuuggaaaaaaagaaaaaaaucuuuuaaauuuaauaguuucacuacugcaucauaaugggaaucccaugugugugacucacuccucucuugaaugaaugaucuuauuaugcaguuacacugauaauagaugggaaagccagagaaaggcuucauuaaugaaauuaccaaucccauccucaagaucucugcuuggcaacucuuguaaccugacaguagaacuccuuuccccugacagccucccggcuagcgauuggguaauggccgacucaggaaaacacacucacuuuguggaugccuugccuacuucacacaucuaacugcaacagcauuugcaaggagagagaggaggggcucacagggaggugguaacugaagucaccacccaguguuucugaaucauguugucuccugaccucaauguuguuuugaagauugauagaaccguuuccacacuuguccaaaagcccagaauuguccaggugccuggcacauaguaggcacucaacacauaguguuaauaaaugagagaccaaaugaauagcuaagucgaaaaacaaugaacaugacaacacaguuuccaggucuuaaagcauaaccgcugaaugugaauuuuuaaggaagagagcugauaaucuguauauuuaacacgcagcuucugugugagucuuuucaggcaauuuuggggcauacugccuuacccagcaguuccaggcuaauuaucagaccaauuaucagaaucaccuggcauguuuuaugacucauagauuuuuggacccuaccuuggacuuccugaaucagggcccagaugcaggaauuucuuuugcaagaacuucucaggugguucaaaauauggggaccacuacagcaggauauguuggacugaauuugcucacacauggaauuaagggcagacgugauagguaaucagcuuguucucuuaaaaaaaaaaaaaaucccugucugguuugagugacaaagguguaugcauuuaccaaaacucauuaaaugguacaguuaggauuugugcauuucacuguaaguuuuaucacaaaaauaugugaacagauacugaauucuagucaugauauauaugcugaaggguuuaagagugaaguguacuaaugacugcaguguacuuugaaaugcgucagaaaguaagacggauggcuggaugaguagaugugauaaagcaaacaacagcauuguagaaucuaggugguggguauaugggugcucaccuacaguccuuucaacucaucuggauguuaguguuuuuuuuuuaauagagacaaggucuuacucugucacccaggcuggagugcaguguugugaucuugacuuacugcaggcucaccuccuggauucaagugauccucccaccucagcuuucuaaguagcugggauuacaggcacauaccaccacacccagcuaauuuuuguauuuuuuguagagacgggguuuugccauguugcccaggcaggucucaaacuccugggcuuaagcaauccgcuggccuuggccucccaaagugcugggauuauaggugugugagccacagcacuuggccugaacauuuuuaaauaaaauguugguagagaauguuugaaaucaugcagauguuacuuuaaaguacuccauguaauaaugaugcucaccagaauuugagaaccacugcacauuggggcaagauuaguucagagguguaucaaccugggaguuguucuucagcuuuuaaaaguuucauaggccuggugugguggcucaugccuguuaucucugcauauugggaggcagagacaggcagaucgcuugagcucgguagcccggacaacauggugaaacucugucuaugcaacaacaacaaaauuagcugggcaugguggcgugcaccuguagucucagcuacuuggaaggcuuaggugggaggaucacuugagcccaggagguugaggcugcagugagccgugagugugccagugcacucuaaccugagcgauacagcaagacccugucuccaaaaaaaaaaaaaaaaaugcuuuacagaaaaauuauaagaaaugaaaauguuguuuuugauuuuuguccuggaaaucugucucuugacuacauaccuuguugcacuaccuuacaugugaaaaccuuuggaaacagaaacacacugagccuguguucaauguaaaggcaaaggcuuuccacauacuggccaaacuucaguuuccuuaucauacaaaauggggacaauaagauuugcuccagagucuuuaacacuuguuaucucauuauuuaacuuuugauaagcuauaauauuuuuauuucucuuaauugcacauaauacaugauaauuacugaaagacucuaaaauacaaucgaagugaaagaaaaaucccagucucauuuuccggccauauuuagaguuaacauuuuauguuuucuucaaggcaucuucccucauaaaauacacauauaaguacuuuguccuuuuauuuauauauagaaaugggauaucauuauguggcuugcuuuuuucacuuaauauuuuugaauguuuagccaguuuaacacauuuauguacuuuugaaugguugucuauuuaccauauaggugcucuguaaaauuugcuuaucugaucccccauuguuggauauuagguuguuuccuaaauuuuucuucuaugaacagcacugagaugaguccccacauacauacauuugcaaauguaucugaugauuuucuuaggauaaaauauaagaagggauacgaacuuuucuuccaaacuggguaggccacugaccuucagugaggcaaguucuccugucucccuuugcaggauuucacgccccuaccauguccuggccuguggcagggacccucaugguggagcccacugagucggaggacaaggcagagcuggacagauucugugaugccaugaucagcauucggcaggaaauugcugacauugaggagggccgcaucgaccccagggucaauccgcugaaggugcguaggcccuggaacauugcuugaaauguuccuuaaacuagaaaaugaugucuggacaguguaccagcaacucccgaacucucaacugaggaugauacucuucccuagaauaagguaauucuucugagaagaugcaguuguuacuuugaaguuuccaucgucuugaacagcauagcaguuacucaaggaugaugugguuguggaagcuguccacagcugucuaguuggagaauuuguaacauucugcaucucuguuugauguacuguagugagauuauggcauaaauaaaauuuacauauucacaucacaaacucuguacaagcacacauucuuauauuagagcaguuaucucugagaaaacuggauugacauuuggacuggauguuacaauguuuaugccccauguuggggaaaaguugguugggcauuacucugccgcuuccaaaacauguuaauuuuacaucuggucagaguccuaaguuucuuguuaguccagauauuaagcuggaagaucaggaguggagaauaccaugaaggcugugguugugucuucauggcuguaagccagagaacaagucugauaugacugcagcagcuggggcagguuuccaaacugccuaccuguaggagagggcagggaccagugacuugcagaaggcaggcaccucucuagaggugaguucacagagucauggaggcauacaagaugauuaugcuuaccaccguuuauuacucuuuucucucugaagacaccugcuucuuucaggauuuaggcuauuuuuuuaaauggcaauaaacauuucaaagagcauaauagugaguuauaauacaaguggauaauaccacucauaugaugauaucagauuuuaaaaugagccaaauuaugcuauaugcaguuuauuaacauaugcaguaauaguauaaaagcaugaugagaaugguaaacaccgaauucagaagagugguuagcacugggauggggauauacaggcagcaccaaacguguagguaauuuuuucuaaaagaugaagcaaauaugacagaaugcucauuagacuuuacugggugguggaugugaugauuauuaccauaacguucugauauuuaaaauauuucacaauuauaaaucacauuguaccccccuaaauugaaagaaaacaacagcuuucucugccugggcuccugucagaagauugacgguugaggugcaggguaggaggagaagagaguguauugcucugaccccuccucuguccgugucucugucucagaugucuccacacucccugaccugcguuacaucuucccacugggaccggccuuauuccagagagguggcagcauucccacucguaaguucucugaaucugaaugugccagcugggaaggcaugggccagcuccuauccugacggguguacgcucuuagccucaugauuacagaaaccauauguggggcaccuugugaaauaagggucuugaagaggaaugaggagcaaagaaauuggcuuucagaggcgaggucacacaguaucaaccacagaucugggaacccauagggaacagagugggggaaaacugaauacgaguccugcccaguggaccaauguguuucccuccacugugggacagggagauggcgcccagugcaaccuuccuuuccuuucugauucuuauauggaggagaagguucuguguagucuguuugagugagguagggagaaggcuaaaaaugugccaaauuaugcuaugugcuguuuauggaucuaugcaguaauaguauaaaaacauaaugagaaugguaaauccuguauucauuggagaggagaggaaacaaaaugaugcuuuuuuuuucuuucuuuuuuuuuuuuuuuuuuugagacggagucucgcucuguugcccaggcuggagugcaguggcaugauccuggguucacgccauucuccuaccucagccucccgcugggacuacaggcgccugccaccaugcccggguaauuuuuuguauuuuuaguagagacgggguuucacuguguuagccaggaaggucuugaucuccugaacucgugauccgcccaccccggccucccaaagugcugggauuacaggcgugagccaucacgcccagcugaugcuuuuuuuuuaaucguucaaauuuuuauuuuaauacacaguaugagaaauuaacuuuuuuuuuuuuuugagauagaguuuuacucuuguuguccaggcuggagugcaauggcaccaucucggcucaccacaaccucugccucccagguuaaagcgauucuccuaccuuagccucccaaguaacugggauuacaggcaugugccaccaugccuggcuaauuuugcauuuuuaguagagaugggguuucuccaugucgaucaggcuggucucgaaccucugaccucagcugaucugccugccuuggccucccaaaguucugggauuaaaggcacgagccacugcgcccagccgagaaauuaacuuuuaaaucaacugaauuguauggaaaaugacauagcaaauaaauuagaccuauguuaaaagagaaggucagcuaaauauccaaacuuaaggauauaaugggcagauaaacauagauuccaaagucuucuuuaagcaguugaagucuuucaaacacaacuuugcuauaaacugguccagauaucaacagcacauagggaugcuuaacagggguggugaucagggacacgccuccugggaaaugccucuuuuuuuuaaaugguaauguaggguuggauuuuagguucucagaauauuugcugggcugauggugucuuagguugugggacuagcauugccaccuccuuugcccuaagagaaaccucccagaacaucucacagcauuuccaucuuuuguccuuugcagcccuucgugaaaccagagaacaaauucuggccaacgauugcccggauugaugacauauauggagaucagcaccugguuuguaccugcccacccauggaaguuuaugagucuccauuuucugaacaaaagagggcgucuucuuaguccucugucccuaaguuuaaaggacugauuugaugccucuccccagagcauuugauaagcaagaaagauuucaucucccaccccagccucaaguaggaguuuuauauacuguguauaucucuguaaucucugucaagguaaauguaaauacaguagcuggagggagucgaagcugaugguuggaagacggauuugcuuugguauucugcuuccacaugugccaguugccuggauugggagccauuuuguguuuugcguagaaaguuuuaggaacuuuaacuuuuaauguggcaaguuugcagaugucauagaggcuauccuggagacuuaauagacauuuuuuuguuccaaaagaguccauguggacugugccaucugugggaaaucccagggcaaauguuuacauuuuguauacccugaagaacucuuuuuccucuaauaugccuaaucuguaaucacauuucugaguguucuccucuuuuucugugugagguuuuuuuuuuuuuaaucugcauuuauuaguauucuaauaaaagcaucuugaucggaagaa

SEQ ID NO: 192788 - RNA, 48996 nt, Homo sapiens
gauguaagagucaucuguaaaagcugugcuguuuuggcagccugggaggcuaagguuuagucuaggcgacuaagguuuaguccgggcuguauucacacccaaaacaacuaaaaaagcggaggagucuuugagucaaucccugaagcuccggcuaagaggaaacucgcccacgcuccagggcagcgacgccggcuccaccucagccacggcugucucaagcuucucgggguuuuccgccggcuccacccgagccacaagucuacaggacuccucggagcuuuccgccgggacgcaagacccaccgccagagguugguaccuccuagagaacagcgaagcgcaucccgagggccgccggccggaagcgcccuccagacccgcccccugcccuccggagccggaagcugggcaucugcagcuggcucggcgcacuccacugaccgucccgacgaugcuacgcgcgcccggcugccuccuccggaccuccguagcgccugccgcggcccuggcugcggcgcugcucucgucgcuugcgcgcugcucucuucuagagccgagggacccgguggccucgucgcucagccccuauuucggcaccaagacucgcuacgaggaugucaaccccgugcuauugucgggccccgaggcuccguggcgggacccugagcugcuggaggggaccugcaccccggugcagcuggucgcccucauucgccacggcacccgcuaccccacggucaaacagauccgcaagcugaggcagcugcacggguugcugcaggcccgcggguccagggauggcggggcuaguaguaccggcagccgcgaccugggugcagcgcuggccgacuggccuuugugguacgcggacuggauggacgggcagcuaguagagaagggacggcaggauaugcgacagcuggcgcugcgucuggccucgcucuucccggcccuuuucagccgugagaacuacggccgccugcggcucaucaccaguuccaagcaccgcugcauggauagcagcgccgccuuccugcaggggcuguggcagcacuaccacccuggcuugccgccgccggacgucgcaggugaccccccgggcggcccgugugcugucccgguccucccacccgcccuggaugcucucccgccucccccagacccugggcuuuuccgaugccccccaguucucuuuccucuuuucccaagccaucaucccucgggcuacguccucccugucgagggauauuacagacuuggcuaucucuuuuuccccuuacacguauguucauuuauuaauucaucagguguaaauucagcaccuuguacucgcugccugcuuuaguagaguuggggauccaacaggaaaggggacagacgaggucucccgcaauuuuugcgcucccguucccaaacugaauugccccuucgagcgccaacccaucccuucccccuucccuggcgucuaguuucacaauugggcgcacguuuuaaaaaacagaaucuagaauuuucuuccucgggcuuugcuuccgauacuaguuuuuccuucuuucuuuuuuuuuuuuuuuaaacucaucaucuuuuucagaugacaguuuuagaccuacacccuguuuuaggaaccugaucucaagccuuuguguccuccuuuuuucuucuguuuuguucauguuuuuacuguagcguucccaucguuguagcugugguccguggucacaagcaguaacaacucauuuauuccauuaauuacacuuuuucgaaauuugagaaaucaucuaguaaggccccguuauuucacaggugaagaacccgagcccaagaguaugccuucuuaauugucuuucucuaaggucuaguauccaagucuucuguuuuccuagaaugguucuuuuucucuuagaaaauguuguaauaguuacaaauaauaaugauagcauacaccucaugccuauuguaugccagguaugccucacauuuauuuuacaaaauccuuacaaccacaaucuggaguugauaguauuuuccccuuaucucaaagaugaggaaauugauacacgaacacauuaaauaauuugcccauuuucauacagcuagcuguggacccaggaaaucugauucagagcuugcuuucuuagccauuaugcuauacugccuccauuuguccaauaacauaccuaauaagaauaaaaacauguaacauuuuuguaccacagagaugagcaagcauuaauaguuucuugaucacuuuuaaggccagaauugaagugaggauuauuguuuagcuucaaagcccaagugaaaaauuagaaguaggcugguuuguaauuucuucuguagcuguugaacagugaaaccaucuguaagggauuucuccacugauucugugucauguuauuguggguaauucaguuagcugacuugugucuaauuacuuguugaacuguguuuuuuuuuaaauauauacuuuuuccauuagcaugagugaaaauuccucauaaaucuguuaaauuaacagaauggugaaagcagaacauauuuuaauauaacacaauaucuauagcgacuuccuggaacaagugaauuuuuguucucagauggcauugcgaagacuggcauuugacucucaguacagagccagggaugaaaauacuacaguucagaauaagcccacuccugaccguuuucagugucagauagcaaacccuuugccuagccacuuuauuauucucuauagacaauaguuuugccuauuauguacaucuggucuuuugagggagucugcugaauuagauuuguaguuuuguagaaacagaacaaugccuuuguuuuuguuuaaagacuagcaauaauuagauaguaacaaggauaaaauacccagaugcacuugggaaauuauauuuuaguguacacagaaaaaaggugacaaaguucgcuuauuuuccuagucaagauauuuucuuaagaauugcaauccaguugacaaagugggcagaauuauccauuucaagagaaacaaacauacauacugauuuuuuuugcauacacauccaaagcccagauaaaacuauauucaauuuucucauauuuuauguacaaaaaugauauacuugguguucuuuucgugguaaauuguuggagaaaugauugaaaaauguguguuuugaauaugacugaaaaaaacguaaagggcacaccaguaguugaagcaugauuaugaaugcuucuccaauacauauuuguugcccaauugggggcauaauguaauuuauuaaauuuuauauagaaaguuaucuggggcuucaguuaaaagauaaaccaauucacaggcccagcacagugaagcacaggagacccaaaacaucagugcguuuugugcugcugucaguaguuuuuguccaaagcagaaucuuuguaaaguaauacagaguugggaagguuaauugagaaaauaaaauacucuguuuagacuuuggcuuagagugaaaaaauagauuccauauguugaauucucucucaccuuguaaguagaaacuuugcugauuuuuaguuugcuuucuaaaguuuuccgugccugacagaaacaguacuuauuaauguaugaugcaauuucauugcguagcaucucuacaacacauuuaaucuucaaucucuauuucuuuagccuuuucuagcuauucucaugcguuacagccauuauaaauggggaauaauuuuaccccaagaguuuccugaccaauaugugcuuauuucagcugugcggauuaguaagauguuaguguuccuuuuucacacuuaacauuuucaauaauuugaaacugucauuuaugucagugauuuacaaauacauauaaauuuuuuucucuuucagauauggaguuuggaccuccaacaguuaaugauaaacuaaugagauuuuuugaucacugugagaaguuuuuaacugaaguagaaaaaaaugcuacagcucuuuaucacguggaagccuucaaaacuggaccagaaaugcagaacauuuuaaaaaaaguugcagcuacuuugcaagugccaguaaaugauuuaaaugcagguaauaugucuguugucuuuuauuugaacuuaacaguuuaaauaauuuugaacugugaaaaugaaaacauaaggaaacagucuuuuuuaaagacccauaauugaucuacauuaagaaaauaauauguucugggucaaaaaaauuguauaccuugugcuuacuauuuaccauuuuuagauucauauucuucuuugaguguuauuuaaauuacuguacaagauucuaguuauauucuggaguuuuuuugagggcagaguaauauaaagccucaacuguaggcauuauuuuuaaaacaaauuaucuuuucugaauuucccccugauaaagugauacaaauggaaaaaucauauaaauucuuuagcuuuugaagcaguucaaaaguaccuguuaauguguaagagggguaaguuuuagaaagugaaaagcaaaguacuaugauguuuuuugaguuauauguagcaaugcugagaagaugagcagucaugucuaucauaaguuauugcaguggaugggcugacuaugcaacuuaccauccaaacuggugggacacuuucgaaagugaaagggaacacuauuaauaauuuugccaggaaagcaggugggaaaccauggcacauggucaccuagcaaugggagauuaagaaaauaagauuuuuuucuguuuucuaggaauuuauguuccauaggguagauguugacaaagauacaugcaaagauuguagauuacauuauacucugaauuaauuuccaaaagacuggaaguagauguuggggaaaaaauagauuagaauuuaucagucacagggccuggaugcuuuauaaggaucaaaaagaagaugccuagacuagcauuugaaauugaauuuuuucucucucuccaaacuggcaguacauuggcaucgccuguggagcuuuaaaaauuauuuacuuuauugggaaauaauucaaacacgaagauaacaaaaaaggcuaauguggugaacaucccuauacccacaacuugguuuuacuaaauuuuaacuuugugcuucaguuacuugccuuaaauaaauugaggucuacuggucccuuuccuggaucccauucuucuuccuuucucaccagugguaauuguugucaugaauugagcauuuauauuaucccaugccaguuuuauacauaaaugggauauuguuuugcagauuuuaaaacuuuuaagagugguaucaaaguuuauaccaguccaaaauucuauuuuuaugcaacuuuuuguuuuugauguaauguuugcaauucuaguccuacauuuuaaauguauguauuucauucuacaucuauaccaauaucuagccauuauucuguuaguaggcaguuagguuguugaaaaagauuuuuuaaaacuauguuuagucucugaaugggcaagaauuauguauuuuacugaugaaguaacugacagcaacuucuuuuuggaagcaguauuaaguauagugguuaaaauaauggauucuggaauuggacuauuugcauuugaaucuugacucuacuauccuauugaauaacuaugauuuuugacaaguuuauuaaugucuuuaugccacaguuuccuuuucuguaaaaugaacaugggaauuauucuugucuuauaggauuauugcaaagauuauauaagauuaauucauacaaagcauuuaguaccuggcgcaguaauugcgcaauaaauacuuuugcuauuuaaauacccuuuuguuuacauagggggugaugcuauauguauuuucaguaacuuacuauuuuuacuuaacaauauauuugucucuagacaaauauagaacugucucauucuuuuaaauccuguguuauuucaugggacauaugaaugacucgauuuguaagucaaugcuaguuaaauuguuuaacccaucaucgaauuuuacugcuguaagaggcuguugcuaaugcaguccaaauucuuuuuauagaaaccauuuuccuacugaaguuuuucuuaguuuuuaacucuuucagguaaugcuacagugaacauucuuguagucuguuuuuuacacuugagaguuuauuuguaagauaaaauaggugaggccgagugccguggcauaaccuauaaucccagcacuuugggaggccaagguggguggaucacuggagcccaggaguucaagaccagccuuggcaacauggugaaacccugccucuaucaaagacacaaaaguuagccagucuuauaacuuggucuccaaauaaauaaauagauuucuaaaaauguuuuuuaaagauaaauaggugaaauugcuggguuaacacacaugaauauuuuacaucuugacauauauuuuuaaauuguucucugaagguguaguaaaaauuuauauccacaguauaugagaauguucauuuucccauaucuuccaacaguagauauuauuagucauuuuaauuuucgccaauuugauuaaugaaaaauaguaucuagcuuuaauuugcaguucuuugauuacuucugaaagugaacauauuuucauguuuaguagccauuugcauuucuucuaaaaauuaccccuucauaauuuuguucauuuucuauuggguuauuuuuguuuucuuaugaaucacaaauaccuuuuauguauuauggauauauuaauuauaucuuuuaauucugccugacaaaggauucgcccuuugcuuguuguauguugcuaauauuuuaauuucuugcuuaucucuuagguuuguugauggugccuuugauugcacagaaguuuacaucuuuuacauagccauaucugucucuucauuauggcuucugaguguuguauuuugucuaggaauccucccaccgcaagauuauuauguuuuccuauugucuuccuuuuuuguuguuuuauuuuuuucucaggggaguggagggaaagggucuauuucguuuuuuaaauauuuaaauuucuuauccaccugaaauauuuuugagguucugaaagauugaccacgaaaucagaagggucauaacagauaagucagagcuauaacuuaaauaagauaguguaucuaaccucuuuacuuuguaaguggggaaauugacacuaaagagagcuuacccaggauaauuagugguaaagucaggucucagccugucuucaucugaugcuuuuucucccuguacucugaagaguuuuuuggugaauuuuuuuuuucugguaaacucucuuccgguuuaagaauauaccauguggacugacuucauaguuucagaauuagagcuucgaguguaaauaagccagguccuuucaucaaauguaccugguacuuacaagccacuauauuguaucagguauugagauuauaaaaccuuuucuuuacguaagcaaaguuuugaauggcuuuucuguauauucccaaugaaauacauuuuuuuuguauuauauacugccucaggaauucuuuaaacucagaacuagugcaaaaugcauguaacgccaguugauuuuuggucccauuuuccuuuaggaaaacaggaaaggcaguaaaauuaaagaaaaaucaaagcaauggaggcaaccacugcaguugacuuuuuuuucucucuagcauuaaauaucacccacuucucauugacuagagagcagcaguguuuuuauuuacuaacaaaggcuacuuuuuauagcccaagcauucauucccuuaucacuucucuucaauacccauauguaucucaaaguaauguaaucagcaaauuagcaguguaaaaaugcuagauaacuuauucugaaauccacuuccgaaaucauuugagcagcuaaguuugaaaaacucauguugguaccaacauuucucucuuuagugugugauuuuucccuuuuugugcuucuccuccuuggcugucucuccuuucuccuucccccucacuuaccuugcacuuccuucccucuccaucucuguagucuucucucuccuuuuauaucuuuucuguacuuacugcugcuucuuaguuauaaaaugaauuguauaauuuaaacuguuuaauaaauguacuuuguuauuuguaauuuucaagucggguacuaaaaccuuuauaaccuuagccccccuccuugaacccucuaaaauuaacaaaaucauauuaaguuuuauauagcaaguccuuggguuauacuuuuuguugauauugcuaggcaaauaugcucuuaacaaguaauugccugaggcaggaggauugcuugagcccaggaauccgaguuugcagugagcugugaucaccacugcacucuagccuggacaacagagcaagacccuguccaaaaaaaaaaggcagaaaaaaguuaccaauuacagaaaauuucuuaguuuuauugggcugaaauuuauacuuccucaugguuucuuccugauaguucaguucugcacccuuaaauuacacagagaaagucucuuaauucuuugauagccaggaagaaacuaaauuauuucuuccccaaacugaagauguccauuuuauugagcuguaccacacauggcauucuacagauauuuagccuuugaaaaauugcagaaaauaaugacccacaaaauuuuaccuuuuuuuccccccagauuuaauucaaguagccuuuuucaccuguucauuugaccuggcaauuaaagguguuaaaucuccuuggugugauguuuuugacauagaugaugcaaagguaaguauuauuuuugcaguuucuuugcuuuuuuaaaaaaauuuuuuuuggcuugcuuguuugcauuugguuacuugaagcagcuuuucagaaaaugaguaguuagggaacauaaacuguuuugugacuaacuccuaauuuuccuuaaauaaagagagauuaaagguucaaauuggucccaccuacuuguaaauaguuuagguucaaaaaacucuggaaacauuuuuuccaugaugauuugauuucuaaaucaucccauuuacagaccuacuuuuaacccaucaucaaauuuuacugcuuggaagggauuauagagcugauauaaucccagauucuuuuuaugggaagccaaagcucagagagaauaaauggguuuccaaaguccuagcaacuauuuuauaacaguuuucaugggaaauuguguucuguguuuuacagugaacacuuguauguccuucaccuauauuuaccaguuaaccuuuuuugccacauuuccuuuaucacucucucuacuauauuaguuuccuauuggugcucuaacaaguuaccacaaacuuacuggcuuaaaacaauauaaguuuauuaucuuaugguucuggaggucagaaguucaaauugaaucuuacagggcugaaaucaagguaucaauagagccguauacaauagagccguauucuuucagggggcuuuaggagaacaucuguacccugcuuuuucugaucuccagaggcugcuugcauuuccuaucacucagacuucugacggguacaucuccagcucuaacuguccuuccugccugccucucguaaggauacuuguugauuacacugggcccaccuagauaguccaggauuuaucucuccaucucgagauucauaaguuaaucacacuggcagauucccuuuuaucagguaagguaacauauucauaggaugucagggauuagaauguggacauaugggagcuguuuuuucugucuaccguguguauauaaucuuuuuuuccccgccccaccaucaggaugcuucacccuuaaauacuugggcaugcaucuaggacaagaacauucuuuuguauaaccacaauacagaauacuauaguucauauuuauguauaucauauauaucacaauauuuucuaauguacagucaacuuucaaauuuucacgucuuaagucuuuuauagcuguuuuuuguuugcuuuguuuuauaagauucaggaucuaauaagggaucauucauugcauuugguugcauuucuuuuagucucguuuaaccugaaagagugcuccagccuuucuuuuguccuucguacauuggcguuuuggaagagucuaggccagguuuuuugcagaauguuuuuggaugugucugauauuuuuuacucaggauuagauucagauuaaacauuuuugacaagagcacuacguaagugauauauccuucucagugcaucauaucagaaggacugaugucugcuugucaugucauugauuauuauuacuauuuuuuugagacagugucucucucuguugcccaggcuggagugcaguggcgcaaucucagcuaacugaaaccucugccucccggauucaagugauuuuccugccucagccucuccaguagcugggauuacaggcgugugcuaccaugcccagguaauuuuuuuauuuuuaguagagaugggguuucaccauguuagccaggcugaucuugaacuccugaccuuaggugaucugcccgccugggccccccaaagugcugguauuacaggcaucagccaccacuccuggccagugauguuugaucauuagauuacaauggugccugccugauuucuuuauuguagagguacuuuuuuuccuuguaaauaaagaacuucuuggccgggcguggugguucaugccuguaaucccagcacuuugggcggccaaggcggguggaucaccugagguuaggaguucgagaccagccuggccaauguggugaaaccccguccauacuaaaaauuaaaaaauuagccaagcgugguggugcacaccugugaucccagcuacucgggaggcugaagcaggagaaucgcuugaacccaggagguggagguugcagugagccaagauugugccacugcauuccagccugggcaacaaagcaagacucugucucagaaaaaaaaggaaaaaaggaaaaaaaagaacuucuaauuuaaaugacugugacuugaaaauuuaaauacauguuuauuaaauuaauugaauaauaguuucuuuuuacaugugaaaagaaauuaaauucuucuuuuaaaaauuaagguugucuuuugauugagguauuuucuauuauuuacuucagcaauuuguuagaaaauaauuuaucccugcuuaggacuuucacugugaaauagguuuauaugcugaaguauuuacaggugaaauaaaaugauaccugggauuugcuucaaaauaauacagugguggugguaggagcaaagcugaaaugggauugguugaauguugauuauuguugaaguuggaugaguacacagagguucguuauacuacuguuuuauauuuuuuauguguuuaaaguucuuuguuaagaauuuuuuuuuuuuuuuuuuuuuuuugagacagagucuuccucugucgcccaggcuggagugcaguggcccaaucucagcucacugcaaccucugccucuugcguucaagcaguccuccugccucagccuccccaguagcugggauuacaggcaugugccaucaugcccggcuaauguuuguauuuuuaguagagacgggguuucaccauguuggccaggcuggucucgaacuccugaacucaagugauccgcccgccucacccucccaaagugcuggguuuacaggugugagccaccgcaccuggccaagaauguuuuuuacaauuaaaaauuaauagacauuuaugaaauucugagauaauuagauauccuggacuuuguguaccuucagcaagcauuuuuugaguuuccguucugugacaagcacuugcuuggaacuaaagacacuaacauaagauagauauuguccucaaagaaugccacaaggaaugaaagacauguaacuaaaccauugcaagacaauaggaugucuauacagugauagaaguauacucagaugcuccuuaaguuauggugggguugcauccagauaaacccaugguagauugaauaucuuaaguuggaaguacauuuacgacuuacaauggauuuauccagacauagccucguuguaagucaaggagcgcacugaaaguguauugcuuuugaaccauuguaaaguugaaaaauuuuaagucaaaccaucauaaguugcagacugcccaugaaagguguaguggggcacaaaggagaaaguuaauuuguaggauagcuuuuuugcaauuugugucugcuuuaauaaguauaucuagauuuucucucuccugggauuaguuuugguauuuaauauaccuauaaaagucauuuauguuauccauuauuugcugaauuaagcaaauauaucuuuugauuuuaaaaaguguuuuccuucucugaaauuauuucuccguaauuguguauuuuugcuuucaauuuuuucuuuauuacaguaguuuauuguuuacuaauuuauuuuuucccuaagaaacaguuuagcuuuaucuguuuuugaacuuuauaaugauggaauuacucagcguguguuuuuuuucuuuugguaucuagcucuuguucaacauuaaguuuuuaagauuuauuugggagcuaaauggugagaacacauggacagauagaggggaacaacauacacuggggccuuucagagggcagaggaugggaagagagagaggaucaggaaaaauaacuaaugggcacuaggauuaauaacuggguaaugaaguaauccauacaacaaacucccacgacacaaguuaaaaaaaaagcuucccauuuauagauugcuacuuagaaggcagggauuugaacugggaggaauuuaaaaugaucuugaccuguuguguugugaaaagguuuacaaauuucaggaaaauauaccucuucucaaauggauugggaauuaugaggucacagacauuucucaggauuccguaaaacauguaccuguagcagaguauuagaggagauugaagcaaaggggcaagcgguaacuucuugggggcgauuaagucauuguauuaucauggugggggcagguuauacaguuguuuauauuugucgaaagucaucagccuguauauuuaaaucauguguauguaaauuacaauuuaauaaaguuuuaaaaaugaaaaaagauuuaugagguugcauauagcuacaauuuuuaauuuucauuacuguauaauauuccauuauaugaauauuuuacaguuuauucauuaucuuuucaguagacauuguuuuuaguuuggggcuauuaugaaccuuguugcuaugaacauuauuguauauguuuauugggguacagguauaccuguuucugaagguguaugucugguagaauuaucgauucucaugcuucagccuccugaguagcugggaccacaggcauccgccaccacaccuggcuaauuuuuguauuuuuaguagagacgggguuuugccauguuggccaggcuggucuugaacucuugaccucaagggagccacuugccucagccucccaaacuguugggauuacaggugugagccacugcaccuggccuuuuuuuuuuuuuuuugagacagagucuugcucugucacccaggcuggaguacagaggcgugaucucggcucacugcaagcuccaccucccggguucaagccauucugcugccucagccucccgagcagcugggauuacaggcacccgccaccacacccggcuaauuuuuuguguuuuuaguagagacgggguuucacccuguuagccaggauggucucgaucuccugaccucgcaauccgccugucucagccucccaaagugcugggauuacaggcgugagccaccgcacccggcccuuuuuuuuuuuuaaauauaaaguuuuagugguaagcaugugagaauuuuuuaaaucuccaguugccuccuuuuuauuucuaauaguagauuuuauuauuugaauagauugaacagacuauuaucuaauuccuuuuuaaauuucuuaguguuuacgucucuuuguuaacuucuugauuucauugccuuuguguaaggacagacucucucaagccguguuuuuccuuuacucucacaccaccaucacaaucaucaacacagaagacuucugugaccaaaugugugggagccuuuccccugcacgccaagcaggagacaccagcuggguguccuccaguucagauuugacauugucuaccuggagguaguauuagaucccacagguugagggcucaguccccaagugccccaucgguacucuucuguucagcuggcuucaaguuggcguucccaugaccucuucuuuggguucaguuaauuugcuguagcagcucacagaacucaaggaaacacuuuugcugguuuauuauaaaggauguuacaaaggauacagaugaagagaugaguagggcgagauaugggggaaggggcguggagcuuccauguccucccugggcaugccacccuccaggaagcuccacauguucagcuaucuguaagcucucuaaacccaguccucuuggguuuuuauggaaguauuccuuccccccaggauaugaggcaggacccuuucagggcaggaucuuaagacccccagaaaggcaggaagauuagaguucugccuccgcacaggugaaagggaggcaggagagagauucuguuuccugaggccugcccuggaggccuaacacacccagcauuauaccaaaagacuacaacaagggauaugggaguuacaaaccaggaaguguggacgaaagccaauauauacauaucauaauaccacaggucagccccugguuuucgaagagggauaccuuacaucaaaagaauauauacaaucauuaauaauccaguccaucaucuguaugaaugucuuccagggcaaggccacucagguuugccagcuuccuuucaauccugucagguuccaaaaccaggaguggucuuggcaaauuuauggcuucacccuuucaugcaucugucauacuugagcuaagagacagcgucaccuuuugcucugagccccguucaaggcguucauguaauaugucauuuccuucaauuuauaacccguuuauucauccuuuuucccucagcuguucuccuuuucuucauuaauaaauaucuacacugcuaccuuuggaagggacacaaguugccauugugcugugcuagucuagauuguaggcagcaaugcuaguguagcaaguagcuccuccucaccccuuuaauguauuuuuuguuuuguuuuuauauauggcacugacccaccccugcucuuaaaacuuacuaugacaugcacuuaguuucucuaggagcucuuucgggaagaaagguuugugacuauuguagucaucuugaaccucuuuuggguuacauauuuuaguccccuaguugugguuuuagcuacagguuuuaguucuagauagagauuucaguucuccacuucuacaugagcaaaugaucaaaugauauguaaguggaaaauuuaacccucagauaaaggcuacuuaauuaccagcucccgguuccagaccuuucagcagagguuaauaacuguaaucagugauagguagguuucaaaccguuuucuauacuuuuauaaucuguaucauucuuagaaauauaaaagguauaguguguguguguguguguguguugguaauaaaugguauuauaggguauguauuauuuuuaauggguucuuauucaacauugugucuuggagauuuuuccaugucaguacauggaaaucuauaauauagaacuuuuugauaacugcaaaguauucugaaguauguguauaccauaguuuauuuaaccaucuaccuacuauuggaauuuaguuguuucuggggauuuuuuggcuucuauaagcagugcuacuauaagucauucuuguacauucucccugguguuccucugugaauaucacuuuauaagaaauggaauuaaaugggucauaggguauguguguuuucauggauuuugccaauuugcccucuagaaugucuauaccaauauacauuccuuccaacaguacccauuuccccauauccuugguacacuuuuauuauuauuuuuucaccaaacagauacaugaaccaaaguaacucauuuucuauuugacuucuaccuucucaaaauucuuauacauuucucauccaccuaugguaucuuucugugcuuuaaugaauauucuucuucuuuauucuuucuucuaaauguauccuugacauuuagaagaaagaauaaagaagaauauuaauauaauaucaucuuaauauaauguuagaagaaaggagaggugagcacauguccuuacuccacucucuugagcuguccugaccuuggaugauuggcugugagcacuuacuggcuugcucuugcacaccagcaucuacauucccccaauccaaauuugugaugcagcauaaaucucucugugguaugaaccuuagggaccaacucuuaaaugcuggaaaggacaaauacuauauuuugugcagaaugguaauuaaacauuguaaccauuucuuagagaaucauuauuaaaucagggaaucuuguuauauuuuugaaaauauauuagaaauuauuuuugaauuuuuuuagguauuagaauauuuaaaugaucugaaacaauauuggaaaagaggauauggguauacuauuaacagucgauccagcugcaccuuguuucaggauaucuuucagcacuuggacaaagcaguugaacagaaacaaagguaagaacuuucuaaaaaaugugaaguacauuuugaguuacuacuaaacuucuggaaauuuuuuuauaaugaguaauuuuaaaaaauaguuuuugcuuguguuuuaaaaaaauuuuaauauaaugugauacaaaagaauucgauaacauauauguaaauuauaaaacauacgaaccuuccacucuacccaagaacuagaauauucauaauaaauugcauuuguuuacuuauguguuccucaacuauuccauuuuccugccuccucuugcccuucccuuuccuccagaaacuauucuuuggaauuuuguauuggucauuccuucgccucuuuaaaacaguuuauauuaugaauguauuggugcccaaagaauauauuuaguuuuucuuggaaucauacugcuuauugucuuuugggacuugcuuuguuuccccccucaacuuuauguuuuuaauauucaacauauuauugcauauagcuguaguucauuuucacuguaguacaauauucaauaaugugaauauaccaucuacucuugucagugggcauuuagauaguuccuaucuuuugcuguuauaauuaguguaauuaugaacucuauguggcuccugcuaugaaugugcaaaauguuuuuguuuugaaagagaaaaagcuuuuguuaacauuuauaaucuucaauuaaaaauaauuuuucaugacuugaaccuuugauagaaccucaauuccaggcuuguuucaaacuucugggcucaaggaauccucucccguuggucucccaaaguguugggauuacaggcaugagccacugcacccagcugagcacagagaacuuuguaggugguagaaguuuucccaaacuggauuguggugauuacacagacagcuguauacauuuguuaagauaucuaacucuuuaauuaaaacugaugaauuucaugguaguuaugcuucaguaaaacuuaaucugaguauuuaacaaaaguguaaaaaaaaacggaaugaaauaauuuuuugguaaaaguggaaaaauuuuuuuuaaagaagacuccauuuuucugaauuaguaaaguuuuuuuuuacaaggcaacaccaaaaugcuuaugacauaauuacugaaaauguuuuaaaauuauuagaucacuucccugcauugaugcgcaauauauuggaaaauaauugaauuuuuuuaauuaaggauuuuacagugucauagggucauuauuuuuuaaaacaguuugagaaauaauucauauguaggcaugucucaaagauagugcaaguucaauuccagaccacugcaaaaaagugaauaucacaaugaagggagucacacaauuuuuuugguuucccggugcauauaaaaguuauguuuauacuauaauaagugugcaauagcauuuugucuuaaaaaacaauacauacauaccuuaauuuaaaaaugcuuuauuacuaggaaaugcccaugaucaucugagccuucagagaguuguaaucuuuuugcaggugaaggguuuugccucagguguugaggcugcugacugaugagaguggugguugcugaaggcugggguggcuguggcaauuuauuguaaaagaaaauaucaaugagguuugcugcaucaguugacucuuucuuucaugaaagaugucucuguaacacaugaugccguuuaauaacauuuuacccacaguagaacauauuuuaaaauuggagucaauccucucaaagccugucacugcuuugucacugucacaauccuuuguugucauuucaacaauauucauaguaucuucaccaggcguagauuucaucucaagaaaccacuuuguucauccauaagaagcaacuccucagguguucaaguuugaucaugauauugcaguaauucagucacaucuuugggcaccacuuguaauuuucuugcuauuuccaccacaucugcagcuacuuccuaucauccaugaggguuggaaucagccucuuccaaacuccugguaauguugauauuuugaccuccucccaugaauuacaaauauucuuaauggcaucuagaguggugaaaccuuucugggagguuuccaguuuacauuccucagauccauuaaaggcaucacugucuaugacagcuauagccuuaugacauuuauuucuuaaauaaauaauauuucucugucauaugaaauuucuguuuuuuuuuuuugagacagagucucguucugucacccaggcuggagugcaguggcgugaucucggcucauugcaagcuccgccuccuggguucacgccauucuccugccucagccucccgaguagcugggacuacaggcaccugccaccacacccagcuaauuuuuuuuuuuuuuuguauuuuuaguagagaugggguuucaccuuguuagccaggauggucucgaucuccugaccuuggauccgccugccucggccucccaagaaauuuauuucuuaaauaauuuauuucuuaaauauuucuuaaauuuauuucuuaauuaauuucuuaaaauuuauaaugaaaucaaaauuacuacuugaucuaugggaugcagaauagauuuuguuuuagcagacaugaaaacaacauuaauuuccuuguacaucuccaucagagcucuuggaugaccaaguguauugucaaugagcaguaauauuuugaaaggaaucuuucuuucugagcaggaggucucaauaguaggcuucaaagagccaguaagccaugcuguguaaaaauagaugugcugucauccaggcuuuguuguucuauuuauagagcacaggcagaauagauuuagcauaauucuuacgggcccuagaauuuuuggaaugaccagugaguauuggcuucaacuuacagucaggagcugcguuaucugcuaacaagagagucauccuauccuuugaagccagacauugauguucuagaugguaucuucuuccaaaagaaggcuguuuugucuacauugaaaaucugcuuaguauagugaccuucaguuaucuuagcuagaucuucuggaucacuugcaguuucuacaucaggacuugcugcuucaacuuacauuuuuguguuauggagauagcuuuuuuccuuaaaccccaugagcuaaccucugccagcuucuaacuuuucuuuugcagcuuccuuaccucuuagcuuuucuagaauugaggagaguuagagccuugcuguggauuaggcuuuggcuaaggggaauguugcagcuguuuggaucuucuaccagagcacugaaacuuucuuccuaucagcaauaacauucuuccacuuucuuaucauccauguguucacuggaguagcacuuuuaauuuccuccaagaacuuuuccuuuucauucauaacuuggcuaacugacccaagagaccuaguuuuuggccuguuucagcuuaggacaugccuuccucacuaagcuuaaucauaucuagcuuuugaguuaaagugaaagaugugugagucuugcuuucauuugaacacuuagaggccauuguaggauuauuaauugacguaauuucaguauuauaucucagggaauagggagacuggaggagaggaaagaggauggagaauggcuggucgguggagcagucagaacauauacaacauuuaucaguuaaauuuaccaucuuauaugggugggguucauggcaccccaaaacaauuacaaaaguaacauaaaagaucacugaucacagaucaccauaacagauauaauaaucauaguaauaauuaaaaaaacuuugaaauauuguguauuacuaaaaugugauacauuacuaaaaugugauacauuacuaaaaugugauacacaaaaugagcacgugcuguuggaaaaauuacacagauggccuugcuuaacucaggauugccacaaaccuuccauuuguggcaaaaugcaguaucuacaaagcacaauaaaucaaagcacaagaugagguaauaccuguaucauauacaguuuaccuacuuaaagugcacaauucaguguuuuaguauauucacagaguugcacaaccaucacuacugcaacuuuagaacauuuucaucgccucaaaaagaaacucuauaugcugugccuuagcagucacucuccauucacccucacucugccauccccuggcaaccacuaauauauuuucugucugcaugcauuggcauauucuggacauuucauauaaauggaaugauauaauaugugguucuuugugacaggcuuuuaugauuuagcaucauauuuuuaagguucuuccauguuguacauguagcaguagcauguaucauucuuuuucauggcugaauaauauuccuuuguauuacuauaucauguuuuuguucaucuuauuuucuuuuuuucaccuuuuuuaaaguuauacuucaaguucuaggguacaugugcacaaugugcagguuuguuacauauguauacaugugccaugcuggugugcugcacccauuaacucgucauuuacguuagguauaucuccuaaugcuauccuuucccccucccccuaccccacgacaggcccacgccaugacaggugugugaugucccccaugcugugucaagugcucucauuguucaguucccaccuaugagugaaaacaugcagugcuugguuuucuguccuugcgauaguuugcucagaaugaugguuuccagcuucauccaugugccuacaaaggacaugaacucauccuuuuuuauggcugcauaguauuccaugguguauaagugccacauuuucuuaauccagucuaucauugauggacauguggguugguuccaagucuuugcuauugugaauagugccgcaauaaacauacaugugcauguaucuuuauagcagcaugauuuauaauccuuuggguauauacccaguaaugggauggcugggugaaaugguauuucuaguucuagauccuugaggaaucaccacacugucuuccacaaugguugaacuaguuuacaguccaaccaacaguguaaaaguguucucacauccucuccagcaccuguuguuuccugacuuuuuaaugauugccauucugacuggugugagaugguaucucauugugguuuugauuugcauuucucugauggccagugaugaugagcauuuuuucaugugucuguuggcugcauaaaugucuuguuuugagaagugucuguucauauccacccacuuuuugaugggguuguuugauuuuuucuuguaaauuuguuuaaguucuuuguagauucuggauauuagcccuuugucagauggguagauuguaaaaauuuucucccauucuguagguugccuguucacucugaugguagguucuuuugccgugcagaagcucuuuaguuuaauuagaucccauuugucaauuuuggcuuuuguugccauugcuuuugguguuuuaaucaugaaguccuugcccaugccuauguccugaauaguacugccuagguuuucuucuaggguuuuuaugguuuuaagucuaacuuuuaagucuuuaacccaucuugaauuaauuuuuguauaaggugugaggaagggauccaguuucagcuuucuacauauggcuagccaguuuucccagcaccauuuauuaaauagggaauccuuuccccauuuccuguuuuugucagauuugucaaagaucagaugguuguagaugugugguauuauuucugagggcucuguucuguuccauuggucuauaucuuuguuuugguaccaguaccaugcuguuuugguuacuguagacuuguaguguaguuugaagucagguagcaugaugccuccagcuuuguucuuuuggcuuaggauugucuuggcaaugugggcucuuuuuugguuccaugcgaacuuuaaaguaguuuuuuccaauucugugaaaaaagucauugguagcuuaaugaggauggcauugaaucuauacauuaccuugggcaguaugaccauuuucacuauauugauucuuccuauccaugagcauggaauguucuuccauuuguuuguguucuguuuuauuuccuugagcagugguuuguaguucuccuugaagagguccuucacaucccuacaauugugaaugggaguucacucaugauuuggcucuauguugaguaggaguggugagagaaggcaucccugucuugugccaguuuucaaagggaaugcuuccaguuuuugcccauucaguaugauauugguuguggguuugucauaaauagcuuuuauuauuuugagauaugucccaucaauaccuaguuuauugagaguuuuuagcaugaagggcuguugaauuuugucaaagcccuuuucugcaucuauugagauaaucaugugguuuuuuccuuugguucuguuuauaugauggauuacugauuuauugauuugcauauauugaaccagccuugcaucccagggaugaagccaaccugaucaugguggauaagcucaucagggauauuggucuaaaauucuuuuuuuuuguugugucucugccaggcuuucaggaugaugcuggccucauaaaaugaguuagggaggauucccucuuuuucuuuuaacuggaauaguuucagaaggaaugguaccagcucgucuuuguaccucuuguagaauuuggcugugaauccgucugguccuggacuuuuuuugguugguaggcuauuaauuauugccucaauuucagagccugcuauuggucuauucagggauucaccuucuuccugguuuagucuugggaggguguauguguccaggaauuuguccauuucuucuagauuuucuaguuuguuugcguagagauguuuauacuauucucugaugauaguuauauuucugugggauugguggugauauccccuuuaucauuuuuuauugugucuauuugauucuucuuucuuuucuucuuuauuagucuugcuagcagucuaucaguuuuguugaucuuuucaaaaacccaccuccuagauucacugauuuuuuuugaaggguuuuuugugucucuaucuccuucaguucugcucugaucuuagcuauaucuugccuucugcuagcuuuugaauguguuugcucuuguuucucuaguucuuuuaauugugauguuagggugucaauuuuagaucuuuccugcuuucucuugugggcauuuagugcuauaaauuucccuguacacccugcuuuaaaugugucccagagauucugguauguugugucuuuguucucauugguuucaaagaacaucuuuauuucugccuucauuucguuauguacccaguagucauucaggagcaguuuguucaguuuccauguaguugagcgguuuugagugaguuucuuaauccugaguucuaguuugauugcacuguggucugagagacaguuuguuauaauuucuauucuuuuacauuugcugaggagugcuuuacuuccaacuauguggucaauuuuggaauaagugugauguggugcugagaagaauguauauucuguugauuugggguggagaguucuguagaugucuauuaggucugcuuggugcagagcugaguucaauuccuggauauccuuguuaacuuucuguuucguugaucugucugauguugacagugggguguuaaagucucccguuauuauugugugggagucuaagucucuuuguaggucucuaaggacuugcuuuaugaaucugggugcucguguauugggugcauauauauuugggauaguuagcucuucuuguugaauugaucccucuaccguuauguaauggccuucuuugucucuuuugaucuuugcugguguaaagucuguuuuaucagagacuaggauugcaaccccugcuuuuuuuuguuuuccauuugcuugguagaucuuccaccaucccuuuauuuugagccuaugugugucucugcacaugaguugugucuccugaauacagcacacugaugggucuugacucuuuauccaauuugccagucugugucuuuuaauuggagcauuuagcccauuuacauuuaagguuaauauuguuaugugugaauuugaucgugucauuaugauguuagcugguuuuuugcuaauuaguugaugcaguuucuuccuagccucgauggucuuuacaauuuggcuuguuuuugcaguggcugguaccgguuguuccuuuccauguuuagugcuuccuucaggagcucuuguaaggcaggccugguggugacaaaaucuuucagcauuugcuugucuguaaaggauuuuauuucuccuucacuuaugaagcuuaguuuggcuggauaugaaauucuggguugaaaauucuuuaagaagguagaauauuggcccccacucucuucuggcuuguagaguuucugccaagagauccacuguuagucugaugggcuucccuuuguggguaacccgaccuuucucucuggcugcccuuaacauuuuuuccuucauuucaacuuuagugaaucugacaauuaugugucuuggaguugcucuucucaaggaguaucuuuguggcguucucuguauuuccugaauuugaguguuggccugccuugcuagguuggggaaguucuccuggauaacauccugaauaguguuuuccaacuugguuccauucuccccaucacuuucagguacaccagucagacguagauuuggucuuuucacauagucccauauuucuuggaggcuuuguucauuucuuuuuguucuuuuuucucuaaacuucucuucucgcuucauuucauucauuugaucuucaaucacugauacccuuucuugcacuugauugaaucggcuacugaagcuugugcaugcaucacuuaguucucgugccaugguuuucagcuccaucaggucauuuaaggucuucucuaggcuguuuauucuaguuaaccauucgucuaaucuuuuuucaagguuuuuagcuucuucgugauggguucgaacauccuccuuuagcucacagaaguuuguuauuaccaaucgucugaagccuucuucucucaacucgucaaagucauucuccguccagcuuuguuccauugcuggugaggaucuguguuucuuuggaggagaagaggugcucugauuuuuagaaucuucagcuuuucuguucugguuucuccccaucuuugugguuucaucuaccuuuggucuuugaugauggugauguacagaugggguuuugguguggauguccuuucuguuuguuaguuuuccuucuaacagucaggacccucagcuucaggucugcuggaguuugcuggagguccacuccagacccuguuugccuggguaucaccagcggaggcugcagaacagcaaauauugcagaauggcaaauguugcugccugauccuuccucuggaagcuucgucucagaggggauggguugucagucggccccuacugggaggugcccccccaguuaggcuacuugggggucaaggacccucuugaggaggcagucuguccguucucagaucucagacuccgugcugggagaaccaguacucucuucaaagcugucagacagggacguuuaagucugcagaaguuucugcugcauuuuguucagcuacgcccugcccccagagguggagucuacagaggcaggcaggccuccuugaguugcagugggcuccacacaguucaagcuuccuggcggcuuuguuuaccuacccaagccucagcaaugguggacgcccuuccccuagccucacugcugccuugcaauucgauuucaggcugcugugcuagcagugagcgaggcucugugggcaugggacccuccgagccaggcgcaggauauaaucuccuggugugccguuugcuaagaccauuggaaaagugcaguauuaggaugggaguguccugauuuuccagguacugucugucauggcuuccuuuggcuaagaaagggaauucccugaccccgugcgcuucccgggugaggcgaugccccguccugcuuugucucaugcuccgugggcuacacccacugucugacaagcccuagugggaugaacccgcuaccucaguuggaaaugcagaaaucaccugucuucugcauggcucacacugggagcuguagacuggagcuguucuuggaaccuccuccucaucaucuugcuuauuuucuuauaauuugcuuaucucaccuacaaauaaauuacagagggaaaaaugcaacuaauugagcacuccauuuuugguagcuaguagcugaugguauuuuaauaaacugagaagcuaaugaggugaauuuucaugcauggcuuguaguagcaggugcaguucugugguguagaggcaauaugacauaguaggcaguugcuuggauuugguuugacuccugguccugcuuuauggaugcugcagauuccuuacuuuggaaaagaggaaugaagaaugccuagcccuaaugugaaaauucaaaauacuccaaacuccaaaacuuuuugagugcggaugugaugcagcaagucaaaaauuccacaccugaccuccugugauggguuguaguugaaacuuuuaaaauuauuuaaaauaucguauaaaacuaccuucaugcuauguauguaagguguauauggaacauaaaugaauuucaugucuagacuugggucccauccccaagauuauauauaugaaaauauuucaaaaucugaaaaaauuugaaauccaaaagauuuauggucacgaacauuuuggauaaggaauacucaaccuauaccucaccugacucauggaauugugauaaucaagugagauaauacuuauuaaagcacuuaguauaauaugauauacagacaugguauugguauuauaugugauaguucucuggcccaaacauguccuuaaugucuuuuucagauauucacacacccuuccccucuaccaccccugccccccuuggcaauuguccaaauaaugaaaacaagagcuuugugagacuuauucuuuucaaacuuuauggcgucauuuauuaaacuaacuuccuuuucauugcaagauggaaaacauuuuuacuucuuuuggaugauuaugccuuguggcuugaaaggaaaauucauucaacaaagcagcuacuauguuuauaugucaggcagugaugacugaggcaaagucauugcacuguggcucuuacagucuagagaaaauaaaaacauuuuauaaaagccauguauaaugauauaacuguuuauguaagauugugaaacaauguaagaaguugaaagagagaguuugacccuuuaagacaggaaaucguuuuggccaccgccucuuguucuaacugaagaaggaaucaacaaacacugcucagcagugagcgaugaugaagaaacuggcagaugguuuccugggacuggguaucucuguacuaaaagacugaugaggauuuuaaaagaugcuuauuuugcugaauuaagauuaaaccuuaaaauaggaaaggagaauaaaguacgguuugagacuucugucagguuucucuccuaaaaacagauugacuagugcugugagaagcacuucuaaagaaaaucaauauaugcucagcaaggagcaaguaaguuguuuuuuguuuguuuguuuuuaacuaauggacuuuuaaaaguaauuuuagguucacagcaaaauugaguagaaaguacagagaguuccuacuuacugcuuuucuccacacauugacagucaggcaccagugugguagaauaauaagcuuuuaauagaauguuuaucuuuguguuuuuccugaucucuucuaucaaaacauuagccuuuuuuuuuuuuguacaugacuuaaaauccuuuuuuuaaauuuggaauuagaguuuauaagugaguauuuugacauccauauuuucugacaaaaugacuuucacuuucccaaguucccaggcuauuuuugcuuucuccaucccaccccuaccccuuguuagaauguuaguauguauacagauugguuuuuuuuaauauuaacauuaaaucagggacauucuucagugccacugaauuuuuuuuucaacauaauuuugauagcaugguuuuacuucauggaaaaaauggaagauugcaaauuguuaaauuuucaguuaaauauaaccggcccuugaaauucagcuccuugcauuuuauuaggaacuugauuuuuauuuuccuuuuugcaccaucacuauaguaaugggauuaaaguuaaaaccagcaaauuuaagcagauauuucuauuuaagcagauauuucuauuuaagcagcugugauuagaaaagcagauugaauucacugaagaaaugaaguaucuccagauuuuauuuuacugucuccuuccccauauaucuguuaauauaaucuuuuuagauucgaggauuucaacaaguuacuucauguuuucucaaagauuuauuuugggucuauaauuacuugccucgagaucuuccauuuuaaguuaauuacuauaaaauauuuuuuacuguuacuaaauaccucaacucucaguguuaaccuuuuuuuucuaccuuuuuguuggguuucaaaucauugauauuuucagauuucauagucuauaagguauggcuuuuuaaagcuguguagucccauauuuuaacguaagauggcagcauugagauaaauguguagugacaccaagugauuuuaguuauuuggucaauuagcccauuguaacaggggaaacuugcugcuuuaaaguucuuagaaauguacgccaauucuagguguuuuugccaacuuuuugaagucacaguuccauggaguuuagccagggguaucaggaaucuuuucagugcuaggaaucucuguaguguugaaagauacuggcuaaauauuuuuuuuuuuuuuuuuuuuuuuuuuuggagacagagucucgcucuaucccccaggcuggagugcagugacaucgucucggcucacugcaaccucuaccucccagguucaagugauucucaugccucagccucccaaguagcugggauuacaggcaccugccaccaugcccagcuaauuuuuauauuuuuaguagagagacaggguuucgccauguuggccaggcuggucuugaacuccuaaccucagguggucugccugccuuggccucccacagugcugggauuacaggauuacaggggugagccacagugcccggccacauacuggcuaaauauuaauaaguaaaaguuuauauaacuagccuggcuguacucugaauucauauucaaauguccagcugccuuuugaauagacacuuuuugacuaucacuagauuguaggucuacuaaguaguuauucauuauuucugcacaauuauuuuaccuuuguacauuuuuuuuuaaaacuauucuuguugaauuguauccaguuuuguaagaaucacucuuaaaucuguugucauaucuauucuugucauaguuggagaguauaccuacucugugcugaccccaacaguagaaccggaaggcaaaucuuguuucaguuacuauuuuaaaaaaagaaaccucacacacacaaaaccccacaacuuuuuaauaacuguuaaauaaguagaauaggcuguuuugugaaguaguaaguguccuauuuuagaaauaugcuaguugaaucuggauaacugugucagagauucuauggaagaaaugcuucuaccaccuaagagguuaggaaauuauuucauggcuccauaacuaaaggcucaguucauuucaauucagcaagcaguuuuugagcacauacaauguguggucacaaugcuaggcauugggaauacauaaacauggauaagaaguuauacccgcuacauccaaggggcucucagucuaguaaggaagaugucuuaagaaaguaauuuagucaaaagcgaaaggaugcuugggaaaguaagucaucucugcaguucaugguaguuggaaauggcuucuguguggauguaagauguaaggugagccuuaaucauugacacuguaguguaauggaauuugcauuggcauaggauuauuaaaacucaaauccuuguucagcguuuccuaaccaaaauuuugucaucuuuaaaauucagguaauacucauguuucaagguguugagaagguugaguggaguucuguguucauguaugucuguguaccacacaaauacauguaaagacacauuuaucuuuuacuacuaugcuuuacacaauuaaguauuuuauuaauuguuauuaauaccaucaugacaaucauuccaggcaaaauuuggcuagagaagaauaaggaagacaucaaggaagaagaguauugagcaaaggccuaugugggaaugaaaauguaaaaugcccaaguuaauuugaugguuugaguuagacaguguugggaaauaagcuguuaggguguuaucuaugccagagaaaaacaguauacuuuaccugucaucuagaugcugauuuaaaaauuuuccuggccuggcgugguggcucagaccuguaaucccagcacuuugggaggccaaggcaggaggaucgcuugagcccaggaguuugagaccagcgugggcaacagggguaaucccuaccucuacaaaagaaaaaaaaaauuagccaggcgugguggcaugugccuguagucccagcuacucacgaggcugaggugggaggaucaccugagccagggagcucgagucuagggugagccgugaucaugccacuguacuccagcuugggcaacagagcaagacccugucucuaaauaaauaaauaaauaaauuaagauuguuccuauuucugcuuuaguuauuuguguuaauuuuaaauaaguuccauguauucugagguuuacacuuaaacaucucucuccuuaauuagaacauagacaaguaaagucuauuguuauuuuucaagaauauuuggacaaaucuauugaaauaaauauacagcguuuuccagguuaucuuugauaacccacuauguucagguuauuuggcuggcaacagaggguauauacaaagaugaaugcauugaaauugucuccaaacucaaaguuuagagaacacuuauaauagcacuaaaacagauaaaaacaaaauuacugagagagaauuaauuugaacucuuugggguuugguaaaggcuuuaugaggagucuuugaaguaggcuaccaaagacuuuucuuucacuaaucucagcauaucagcucuuaguaauuguuuugauguguuuuuuaauaacucgauugagguauaauucauguaaacuguacauauuuaaaguguacaauuuggucaguuuuuacauauauauauacgcccaugaaaccaucaccauaaucaagauaaaauauccaucacauccaaguuucuuugugacccuuucuaauucacuuucuacccccauuuucagguaacacugauacacuuucugucacuauacauuaaguuguauuuucuaggauuuuauauaauggaaucauagugaauuuuuuuuuguugggcuucuuucacucaacauagugauuguaagauucaucuguguugcugaugaaucuaauaguucauuccuuuuuaagaccaaguaguauucuguuacauagauccaccaccauuuguucaccuuuugaugaacauuugguuauucacaguuuuaaggcuauugcaaauaaugcuucugaauauuugugaucuuuguauguuaugauuugauuucuugggaaccuaccuaauuagauggaaugguugagucuuaaguagguguauuuuucacuuuuuuuuuuuugagacagagucuuacucuguuggccaggcuagagugcagcggcacgaucuuggcucacuucagccucugucucgugggcucaagcaguucuccuggcucagccucccaagaagcugggauuacaggcaugugccaccacgcccagauaauuuuuguauuuuuaguagagaugggguuucaucauguuggccagacuggucucgaacuccugaccucagauaauccacccaccucagccucccaaagugcugggauuacaggcaugagccaccgugcccggccgucuuuuucacuuuuuaagaaacugccaaacuuuucccaccaauguaugagaguuucaguuguuccacauccugccaacgcuucauauggcaggucuuuuuaauuuuaaccauucuaauggguguguaguaguacuuuguugugguuuuaguuugcauuuucauaaugauuagugauacugagcaucuuuucaugugcuuauuuacaucuauauaucuaguuuggugaagucuuuauuuugugugcuuuuuaauuggguuaucuuuauuacuguuuguguguguguguguguguguguguguguguguguguguugucuagguacaaguccuuugucagauuuaugcucuauaggaauauauucucuuagucuaugguuugccuuucuuaaaaaauauauauauauuaauggacugauuuugccccauuauugaggcauuucacccugaguauuuauauguacccuguguauuuugagguuuucccacucuggcuuaugugaaaacuauucuguuuuuuuguguuagcuuugggaauuuuuuuucuuuuuuuagacggggucucacucuguuacccaggccagagaacaguggugcgaucauagcucacuacagccucaaccucccaggcucaggcaauccucccaccucagcuucccaaguagcugcgacuacaugcauauaccaccaugccuggcuaauccuuaaaaaauuuuuaauacauggaacuuauuuuuauuuauuuauuuauuuuuauuuuuuucucacuguguugcccaggcuggucuccuggugggcucaagcaguccuuccccucugcuucuggagucacugggauuauagauaggaguaaucuguaauuagcucugcuaauuuuuuuuuuuuuuuuaccuauuccuuuucaauguuuuuucuccgggauuuggauaguuuucucauacgcaugugcuguucagugccagcugaaaauuugagggagccccugcuggucugcagcacucucuucucagguacuccugcugugaauucagccaguguggccucccuaaauucucacucccaucucagcugcucagggcgacuucccgagcuguuugggcauccccucccugugccauagucuggaaacucggcaguaagcuggggcaguuguuggagucaccuccuuugccuuccuuuucuuauaacuauuguugagugucugaaacuuuguauguuuuguucagcuuucugguacuuuaagguaggacaguaaaucuggucccuauuacuccgucuugacuggaaguggaaacuguuucaguguauuuuugcuugaggaagaaaaaugucauacuugagucauuuuaguucuugauuuauguuaagcuguuggauuggugcuucuccaaauacucacuggaacugauguuucaauuagauguggaagacuuaacaacaaauuuuuuucugguaauuuucuucccaaagcaucuggcaguucauguugcuuauuuguauacuuacauaaauaugggaauuauaugaguuguguaaagcuguauuugauauuccuggaucauguuuaaaaacauacuuugcauaacaucaauugagugugaaacgugaauuaagagcuuagaaagaucuagcugaguacauuuggggggaaaacaugcaauuauuaguuguuuuuucugguugagcuuuuugaauaacuugaaguaguugcuuuguauccuuuaucuacuuugaacacacacauaguuaucaacccucauuaaaagacaggauuuuagacuuaaacuuuguuuuugguugaagacauaauaaaaucuccucaccaauuucuguaaguaaaaggagggguguaauuuggagaacugcaguaauccucuuaaccauuuucacgcuguuauuccuaaaauaagaaggguugaccagaucucaaaccuaaaacauuaugauucuguauauuucuauccagacauuuauauagauuacucauuugcuuucauauauuuguauuaauaguuuacauuuucaagcaaaauauguaucuuuucaagugguuuugucacuuuuuggaaaaugcaacauuccaaguuuaaugcauuuuuaucaaggagagagcagaguuaaagguguaauuccuuuucuuugggauacuucugccaagagucucaaagaaagaauagucauuacaauguaaugggggauguaaguuaauuugagaacuaugacuaguuggaucagaaugcagagcaucugaauuuuucuuaauuugguguuaaauauucauucuacuuagacauuuuaaauauaguauuaggacaaaauuaucagacauuuguggaauauauaugacuuuggggauauaaaccaauaugggacagaauuauagacacauuauuccucaggaugucacauuguaauauauagcacggggauucuugggguauagagucugaaaucccaaaacuauauuuaaguuuuuauggaccacaugccuuucuuuaguacgaaguuccauuuucuuagauucucagaugguuucauguccuuugugaaaguuaagaaccacagaugcagugaggauugagugauugcuuuggcagcccuccuuuaaaaaacauuuaccucuuccuguauuuuuugcuuguuuguuuguuuugagacaaggucuuacucugacacccuggagugcaguggcguaaucauggcuuauugcauccucgacuuccugggcucaagugauccucauaccucagccucccaaguagcugggacuacaggcaugcgccacagcgccuggcuaauuuuguggggaguuuucguagacacaaggucucuccauguuucccaggcuagucucaaacuccugggcucaagcaguucucccaucugagccucccaaagugcugggauuacaggcgugagccaccaugcccagcuuauucuucuguuaaaggaaaaacuugguccuuucugucaugguauccugaaccucaccacucuguuuauugaaugguagugacaaagccacaugagaccauagauaaaauauagcaaucuuuaugcucuuagcaaucuuaugacaaaauacaugcaagagguuuuauauaagaagagcauaauuaugaguauaaacugagaaggaauucguuucacauuuguuguguuuuuugcccuccuauaccuacaugccuauguuucucucucuuucuccucucugucagucucucuccucucucugucucugucucugucucucucucugucacacacacacacacacacacacacacacacuuucuuacucccucauucagacauauacacaugcucauacccauuuauuguugccaguauuuugggcuuguucauagaccagcuuugguuuguuggagaagguuggaagugaaaccagaaaaguugucauaccaucuuugugauuuugguguauucaaagagaaacuggagauuugguuccuucaaauagugauugggcauauacuaacuggaguuccuaggagaugguuuaagaaccagauuggacucuuuuaagauuaacucuaaauugugacacagggcaaagagcagcauguucauagacuuggaaccaaaucacuucuucauagaaauuagugauuuacuuuauacaguccuggcauauaccuuuaauggcuucugguaaaaauuggaucauaaauaaauacuuuugugaauuuguuuuucgguguuuaaaaguuauaaaaacaaacaaacccuacuguaugugcacacacacaaacuccacagcugucucagcuuccaccaguugaagguauccaagucuccauuuuuggugucuguauacuugcaauagaaacauaauuuguuuuuccauuugacacuaugcuacuuaacuuugucaaagaaaauagaaaugugaguaauccuuauaaaugggcaaacacagcuauuuaagaaggauuauauauuagcucuuuggaagcucuuuuggucauagauaauuaccuggaggcaguuguuuuuuuauauacccgaguuugauauuuugccaguugaguuucaaacaaugaaguagaaauuuguuuauauauugcuuagucauucuuguucauaagaagagcauucugaaauucuuaacuaugaaugggaccuugauuugaaccauauaguuuaaaaugccugaaaaauuauuggcuaaguccucuugaauuuuauaccucaugauuaugaguuagauguuuuacuuauuccuucuuugggaguuguuuggaaaaaacucaaacccuguuuuuccucugccuucacaccaacacaacaauagucaacacaacuucugcguuaguccauucuugcauugcuauaaagaaauaccugaggcuggggaagagacacuuaauuggcucacaguucugcagguuguaaaagcauggcuccagcaucugcuucugaugagggccucaggaagcuuacagucaugguggaagagaaagggagccaguguaccacauggugagagcaggagcgaaagcgagagaaggaagaggucccaggcuucuuuacacaaccaaaucucauaugaacuaacugagcaagaacugacuugucaccaaggggaugaugcuaaaccauuugagagggauccucccccaugucccagucucuucccaccaggcccuaccuccaauguugggaaucacguuucaacaugagauugggaggggacaaacauccaaaccauaucauuccaacccuggcccccuaaaucucauauccccacauuucaaaauacagucaugccuucacaauaguuccccaagucuuaacucauuccagcauuaacucaaaagucccaagucugaagucuacaaagucucaucuggagaugaguuucuuccaccugugauccugugagaucagaaaugaguuauuuacucccaagauacagugguaguacagacauuugguauaccuccuauuccaaaagggagaaaucagccaaaagaaaggggcaguaggcucugugcaaaucugaaaccagcagggcaguuguuaaaucuuuuuuucuuuuucuuuuucucucucucucucuuuuuuuuuuuaaacagagucucacucucuuggcccaggcugcaugaucacagcucacugcagccuugaccucucuggcacaagccauccucccaccucacccucccagguagcuaggaccucaggagugcaccaccaugccuggcuaauuuuuguauuuuuaguagagaccggauuccgccauguuggccagguuggucuuaaccuccugagcucaagugaucugcccaccucagccucccaaagugcuaggauuacaggugugacccacucugccaagccagucuuuaaaucuuaaagcuucaaaacaguuuccuucuugccaugugaaaccugcuucccccuugccuuccgucaugauuguaagccuccugaggcccuccccagaagcagaugcuagagccacgcuuccuguacagccugcagaaccguaagccaaaauacacuuguuuucuuuauaaauuacccagucucagguauuucuuuauagcauugcagaaacggacuaacacaaaauugguaccaaggcauggggcacugcuauaaagauaccugaagauguggaaguagcuuuggaacuggguaaaaggcaaaggcuggaagaguuuggagggcaaagaagacaggaagaugaagaaaaauuuggaacuucugagagacugguuaaaugguugugaacaaaaugcugauagcgauaugaacagugaagucuaggcugaugagguuccagauggaagugaggauguuauugggaacuagagcaaauguuaccccugucacauccuagcaaagaaccuggcuguacugugugcccuagggauacccucaucaguuuuuccucauucaagauguggccuggcugcuucuaacagccuaugaucuaauaugggagcaaagaaaugacuuaaaguuagaacuuauauacaaaagggaagcagaguguaaaaguuuggaaaauuuucagucaagccaugugguagagaaagaaaaaguauuuucaggagaagaauccuagcaggcuguggagcaaccaccugaaaaagagguuaucauggccagggcacaguagcucaugccuguuaauuccagaacuuugggaggucaaggaaggaggaucacuugggcccaggaguucaagaccacucugggcaagaaagugagaccucaucucuacaaaaaauaaaauaauuagcugggugugguggugcaugccuguagucccagcuacucaggggcagaggcgggaggacuguuugagucugaggggucaagguugcagugagcuaugaucacuaaaaugaguuuggucauuucuaagacacuggauuauaagacauauuaaaagaagauguuuuaaguuaguauuauguccagguaagguuucuuaaaaauaaauuuuuuaaaaagaaaacaaaguuaguuuuaugagagaagggggaggccccagacucuuaaacaaccagauuucaugugaacugagaagucacucaucaccaaggggauggcacuaagccauucaagagggauccauccccaugauucaguaccucccacuaggucccgccuucaacauuggggaucacuuuucagcaugagauuuggaggagacaaacauccaaacuauaucaacuucugugacccaguguugggggauggggguuccccaccaauaagcagcagacaccagcuagguauccucuaauuuugacacuaucugccuggauguagcaucagaucuuacaaguugaggacucaauccccaagauugcccccugcccuuuucagacaccagucauaagucugggccucuggaacaccugacugacuggcuucaaguugggguuuucacagcccccucuuuggguucacuuaauuuccaggaguggcucacagagcucaggaaaacauguuuaccaguuuaguauaaaauauuacagaggauacaaaugacacauaaaaugagguaugggggaaaggauguggagcuuccaugcccucccagggccacaccgcccuccaggaaccuccacauuuucagcuguccauaagcucuccaaacccuguccucuuggguucuuauggaggccucauuacuuagacaugauuaauuaaacuauuggccauuggugaucaacuugaccuucagccccucuugcucuucccugagguugagggaugggcuugaaaaugcuaacccuguaaucaugccuuugccuuuuugcugaccagcuccauccugaagcuaucaaucaacaugagcaugcaaaaagacagcacuuuggagauuucaaggauuuuaggaguuuuguaccaggaaacaggaacaaagaccaaauauauauuauauuucacaauaucauuggaaccuuaagaaagaagccucucuccuuucuuacggagccuagaggaauaaagauaauaauaaagauuacuuuauuuaugaauaguaauacuuuacaaaguaaucuuuauuaucuuuauucuaguuugcccuugaaccauuaaagguuacuaaguugaauucaggcugagaaaaacaaaauagcaaagaaaaacauuuauguuugagauuuuagugauuuauauucugagauguuauguaauggaaauacuuuugagauaaagcaaaaaauacuuaacauucuuuuaguuguugcaacuuauuuaagaguguguguaauucuuacccuugaaaccucaaccuagacauuuagugaauucuguuuuugaaaugggaaaaucaagaauaaagucagauuuuaaaaauuguauaaaacauguaguugcuaaaauguaauuuuaaguccuccuuaggguuucaguuuuaugaacccuauguccuccuuaagguuucaggaaaccuccuuaggguuucauguugauagcauauuauaugaauuauuauggcaguuuuuucuauuuuauaaguuguuuuucucugagauaaaauuucucuaagugggauuuuuaauauucaagcuuucuugacuuuuuuuuuaaaaaagacauaaaccaaaccaaguauauucuuaccuguaucuaguaaagauuuguguacauacauuuaggagugauuuauacauaugucuugaagugauaauuuguuuuaggugauuauauguuuuauacauguuuguguuauacuucaccaguagugauauugucaagcaaaaaaaaauaugcagcaucauaaaauuaacuuuguuuucuuuuuaaaaaauuuauucuuaagaaaccuuaccuggacauaauacuaacuuaaaauaucuucuuuuaauaugucuuauaauccagugucuuagaaaugaccaaacucauuuuaguuauaucuaggaaaucaaagguaaagauggagagauuggcaaggagaggagguucaugaauugagaguagaauguguaagaagcaugaaauagaucacaucgagucuggauacaaccucagaauccuucucaaugcaguguuccaaauagcuauuaauuacugauuggagauuuggcccagauacugguuuuaugacuaaaaguugucauuuauugacauauucucuuucuucuaagcaagaguaaaaauuuagaugcauacacccuugucuuuguucaucugcuuagaggcuuacaucauuagugaucaugucguggggcaaaauugggauucagccccggaggccacaugguucuuggcuucacggaggcaagaauucaagagugagccaaaagacuagagcgaaagcaaguuuauuaaaaaguaaaggaauaaaagggaggcugccacauaggcagaguagccuugagggcugcugguuggcuauuuuuuaugguuauuaauaaauaauagcauaaauuaaucguaugcuaaacaaggaguggauuauucaugaguuuucugggaaaggguagggaauugucaggaccaagaguuccuucccuuuuuagaccuuauaggguaacuuccaggaguugccguggcaucuguaaacugucacggcacagaugggagugucuuuuagcaugcuaguguauucuaguuagcacauaaugagcagugaggaucauugaggaugagcagaggucacugucuuugcccucuugauucuggcugguuguggcuggcuucuuuaccacauccuguuuuaucagcaggguccuugugaccugugucuugagaaacacguucugccgaauuaucucaaucagcuuuuuauagaacugugcuuuucacugaauauuuuuuucuuauugcacguucauuucagaugaaaaaccugagaaauguggucuucgccuuugcguuggaaaagaauugaugccuuauuuaagaaacaaucagcuagguguggugguucacaccuaugaucccagcacuuugggaggccgaggugagagcaucacuuggggccaggaguucaagaccagcuugggcaacaagcuaagaccccguuucuacaaaaaaaaacuuuaaaaugaguugggcaugguggugcacuccugugguccuaguuacuugggaggccuacgugggaagagugcuugagcccaggaggucgaggcugcagugagccaugaucacaccacuguauuccagccugggugacagagcgagcuccuguaucuuuaaacaaaaacaaggaaaaaaauaucauuuaaaaaaaauuuugugggauuuuacaugugcuuuugccaaauugcauguugcugaagaguguuacuaagcacugacaacagagucuuccucagucauuauguugaaauacuauguuucuucccacaaauaagaacugauuugauuuuaaauuauuauuauuuuuuuuccaagacagauucuugcucugucacccgggcuagagugcagugacgugaucuuggcucacugugaccacugcccccugggucaagugauucuucugccuugggcuucugaguagcuuggacuacagucaugugccaccacacccagcuaguuuuuuuguauauuugauagagaugggauuuuacuagguuggcccaccuguucucaaacucuuggccucaagagaucugcccauggccucccuaagugcugggauuacuugauuuuaaaugauuuuaaucagcaaugguuugaaaguaaauuuaagugacuaagaagugacuaaguuccuaaauuauuuacucuacuccucauaaacaaguauuuucuuauaaaaggcauuaagguuuuuccaaguaaaauuuuuugguauaaauuguuuccauacaauuuaauuuaugguauaccugugguuuugcuuuugcauuuggaucuuuagcacuuuuggauaucugaugaauuuuaacauaugcuauucaaugaaaugaguuuguuacuugauaccguguuuaccuuuagaauaaaguguuagguacuaauauuuuaggagaacugacuugaacucaucuccuggauucuaaacucagcacaccacuaauuugugugcugggucacuucacugcuagaacugcuguggcuuuugcugccacuguggcuguuugcuaucacagauugauugauggcucuguggcaaacacuaccauagagccaucgaucaauaugugauagcaaauaugugaguauuuuucuguagcucaaauccaacagcuuugcaagggaaguagcuuaucuucauuuggcaggaaugaagccugagagagauugagucauuugcccuaaaauuugcucauaaccaaguuaugcccuguaguuuucaagcuucuuaguuuuucccucucuaaaaggguaugacagaaccuguaucauagaguaagcaauuacuuugcuaaggcuacacagagcagcauuucuguuuuaagacuuaguaggaguguauucaugacccagcucaaacaccaccuccucagcaaagcgcauucaauucuuccuuagucacaaggauuuguucucuggguuucucuaacagacacaugcgaaucugaaagagccagaaauguuucauuuguguuuuuguucuuuuaucccacuauucuucuccccuccccucccccuccaagaagaaacuagcauggugccuggcacuuggcaugaaaugacagagccugucacaucuaacaaauuaaccaaaugggucuuuugaaaagucucuucuuuauuacguuuuggaaaacugagugcagcuuauuugcccaggggcuuuuguaugaauaugagcaucaucagcuagcggcuuuuucuugaguagcaagcuauguuaagucacaaaggguaaaaguaaaaaaauaauuauuaugaaugaaauugugcucuuuuuuaauacuuuccauuaucacaaacuuaaaauauuuauacuugguuauuguaaaaauauauaaauuauaaaaauaaaauuauaaguguauuauucccuauaggcacauuucaauuucuaagcaaaaucuuguuuuugcuuuuaauggcucuacuuuuuuuaaacuauuacccuugucuuauuauuguuuuacuagugcauuuaacuagaccuuuaagauauuggggguuuuugguguguuucaaauuuguauaauagacauugcucuauguaagaagauaaucaauacuuacggacuuuauaaaaaguuagcacuuuuccuuccuauugaaaauugucuggaauucuaaaauacaauuuuaaaacaaauuggauucaucaaaugguagaagacaguaauuuauuuuugaugggaugguuuacugugagaaucuaauauauaaacuuccuugauuucccauaaaacuuccaguaagcauuuuuaaguauaauuuuccucaaauuucuucugaagaauucacugauuuuaacauaucacugacaguaaggcaguaaaaaaaggggggaagguguuuacugccuuuuguauaaacccaaggaaccuugaaauuuacaacuuaaauuugagucacagucuagauuucauuucuucuguagcuugaaugcaauuaauagaacuuugaacucauaauuugugcauagcucuuuuggucucuuuccuucccccaauuuauaguuuucauguguguguuuuuauuugucuuguaucuuuucuccuauuugcuauuuauuugauuaacuuuugaaucuaaguauguaagacuguccauaccacugucuguccugugcucuccaacacaguagccaccagcaacaugugauuguuuggugcuuaaaaagcagcuggucugagcgaagcuguccauacuguaaauuaugcacuggaucucagacacuugguagaaaaaagaauguaaaguuuacuaauggcguauaaauuacuugcugaaaugacaauaguuuggauauaucgucauaucuuguccccaguuuauuagaguucuucugugggggaaagaggagagaguuacugacaguaaauucuucugguuagacaguggagguguugcugcuguugcugcuauccucccugaccuguuuugugugcuaauagauuccauggagagcaauaacugaaaguugaauuuaggauugcuucuggcuuugagguuucugccuaauggcuaaaggauuuaaaauguaaaccaguauauuuauauuacuuguuuuucuuuuaacuuguauccuuauuaaauuucauuauuuagauggugacaguaguguuaguuuagacuugaauauacucagauguauaaaggggccaggcaaguaacaaaggaaugaauucauccuauguuagacaauguggaaugauacaugugcuguguaacaaguauaugcccucucuacaggguggguaaccuuauuccuguuuagcugauuauggucuuacggguauauauggacuuguguugccagaucuuucagauuucuaagaagagcaaaaaucuggauuuuuaagaaucuuaaaccucucaauuuuuaaauacugauaaguaauguaaaauuuaaaaauacuuaugcuggucaaacuaaauauggcuguguucugaaugcuaccgcuugguaacuucagaccuaagagauugcuucuuggaaauaaauacagguuuuagguauuuuagaugaccuaauuaaaguauaccaguuaugaagagaggcuugguaagcgccuguugaugaauggcuuuuaaguuuuacaccuuuuagagaauauuaaucugaaaguagugaauaauugucuuuuaguuuguuuugaaauacuguuaacaguuucaguguacuuuuugaguauauauuucuagcguacucuuauauauggaaguuauucugcuccuuauuuuuucuuacaugcuuuucuguaguuauuuugauaugaauuguuuuccugaacauuuagaaaaagguuugugucagauugcuugucucaucucacagagcccccccguucugguguguguacuguucagaaguaugauggguuguuuucugagauuuccuggcucuguuccccuccccccacuuucaucuagacuuacuuuuuccuuuaucucuucugucccucuccugcuuggcugaaauuccacucccagcaguuucucuagugugagcccuguguuuggagaguucacaggagcuccaggauucucuagccccgggccucacuguaggccugccuugcacucaccaaguccuggagaggacuaaauacuucccaauuucagcugcuauauccaguucacacacagcgcuuccagugaauaccugugggcuguuugggauucucuuguucucagauugcucagaugcucuguggcuucucucugcuuucuucaacagauacugauaauaucuagugcuugagguuggaugcuacuuggagugguucauagagaauacuuuuccaccuaguuauguuguaaauguuucccauggguuuuuggauuugcuaucugcuugcuguguuuguguguguugggggcagagggaaucaggaaggucuagaacugcugcuucuauccucccagaaaauccagaugcacuaaauugauaaccugaugagugguggcaaaaagucagacagucauguuugaauagguuuacaaauuauauuuaagaaaaauauuauuuuuucuauaaagguagggaaaaggcuaagcagucauucacugcuucuuaauaaaaauucuuuaccagaaaaaaaaaaucauagaaaacuucaagaaaaagaauugauucagcucaguguugaaagugguuuguauuccuggcacuuuauacucccacucccaaccagagacacauuguuucagccacaauagguuacaucacuaaccuuuuuuggguuuuguaaaccauuaaggauuacaugaauuaccauguaauccuguucagacuugguaagacauuuacugaauauugcuuguucuuauucccuagauauaaauaaaauaauaacacuuuauucaaaagagcuccauggaguaauauuuacuaagggccagguugcucaguuuuaugcacagaaaggcaauacaguguugaaauacacaucuguuucaaguucccauaucuauaagacacuucucucucuuuaaacuuaaaggaaaauauguaugcacacuuauauggauuuacaacaguacagugaucugaauuucggaacuuaacuuucaguauaaaaaguuuaguucucugccacacggaauuucagccguaugcuuguguaauguauauaaagauuuaaaaaaauagaugggauuauuuaaacuaaaaaaagauguggaaguuacuccuaaguguaaauacuauguucuaugacauuaauauauauaccuuauuuucucuuaauuucuauuugaaggucucagccaauuucuucuccagucauccuccaguuuggucaugcagagacucuucuuccacugcuuucucucaugggcuacuucaaagacaaggaaccccuaacagcguacaauuacaaaaaacaaaugcaucggaaguuccgaaguggucucauuguaccuuaugccucgaaccugauauuugugcuuuaccacugugaaaaugcuaagacuccuaaagaacaauuccgagugcagauguuauuaaaugaaaagguguuaccuuuggcuuacucacaagaaacuguuucauuuuaugaagaucugaagaaccacuacaaggacauccuucagaguugucaaaccagugaagaaugugaauuagcaagggcuaacaguacaucugaugaacuaugaguaacugaagaacauuuuuaauucuuuaggaaucugcaaugagugauuacaugcuuguaauagguaggcaauuccuugauuacaggaagcuuuuauauuacuugaguauuucugucuuuucacagaaaaacauuggguuucucucuggguuuggacaugaaauguaagaaaagauuuuucacuggagcagcucucuuaaggagaaacaaaucuauuuagagaaacagcuggcccugcaaauguuuacagaaaugaaauucuuccuacuuauauaagaaaucucacacugagauagaauugugauuucauaauaacacuugaaaagugcuggaguaacaaaauaucucaguuggaccauccuuaacuugauugaacugucuaggaacuuuacagauuguucugcaguucucucuucuuuuccucagguaggacagcucuagcauuuucuuaaucaggaauauugugguaagcugggaguaucacucuggaagaaaguaacaucuccagaugagaauuugaaacaagaaacagaguguuguaaaaggacaccuucacugaagcaagucggaaaguacaaugaaaauaaauauuuuugguauuuauuuaugaaauauuugaacauuuuuucaauaauuccuuuuuacuucuaggaagucucaaaagaccaucuuaaauuauuauauguuuggacaauuagcaacaagucagauaguuagaaucgaaguuuuucaaauccauugcuuagcuaacuuuuucauucugucacuuggcuucgauuuuuauauuuuccuauuauaugaaauguaucuuuugguuguuugauuuuucuuucuuucuuuguaaauaguucugaguucugucaaaugccgugaaaguauuugcuauaauaaagaaaauucuugugacuuuacuaccaggacuuuucucuuccccaugucaaaauacaaucaauaauugaugguaaaaguuuggaaauucaagca

SEQ ID NO: 192789 - RNA, 38331 nt, Homo sapiens
uucccgguggcuggcugcucugauuggcugaacaaauaguccgaggguggugggcauccgcccucccgacaaggcagaccaggcccccugcagguccccuauccgcaccccggccccugagagcuggcacugcgacucgagacagcggcccggcaggacagcuccaggugagagugccggcgccgcggcgcugccaggugcgggugcggcguggaagcuggugccuucagcaaggggagggucgcgccccgaggcucugccggccggcaagacccucugcguuuggacccagcgagucuugccuggggugccugcgggugcuuuuucugcgggcguuggcucaaggcaucugccaaucaaccagggcaacuucagagagcaacuucagagagaagcccacucucuucccugggcgcuguccacuuuccuggacaggcgcggucuccggucagugaagcugcccagugcuccuggaccgcgaggacagcagggaugucugauuccucucucugcauccucgugcucuccccuuagcuccuccaggcaucccauccuaccucucuuguuagccaacggcguggucgaaagcagacuugggcaucaauccugguuaaagucccagcgauacugcuuuuuaaacagcugacacuuugcuuccaguacuucagcugggugaaccucagauuccugaaaaauggaauuaaugguacugccauagggucgguggaggaguaauugacaguagaucagaagcgcugccugcgguggcuggcgccucgcaagagcuuaaaugggagucguaauaauuguuguuauuagaaaguuaaauagcaugcugcguuggggccuuuucuucugccacugaacuguuggacugcucuuaucuuuuuucagaaucuguacuaugcaucuaauauauacguggcacuuugcuugguccuggggguacaaagcugagucagauuguuacaaagucuaaauaacugagauaaagguguuaauacagcccagaaaagcacacuuaauucagccuggaagguuuuuuuuccccccuccuucgagauuuucagaguaucuccuucuuaguaagaauugcuuggcuuaguauguugagaaaaacauacuaaguauguaguguuguguuggaaggaaaacuuaacugggugagauuuucagcugaguagcuuuagcuguuacucucauggaccuuccucugggcgguugauacagguucuguaggaaaaccgcugaaugaaagcagcuccugcagaugcuauucuguuuucaauugugguaauuccuuuaauuuuuucccuuucaauuuacuccuuauucucuaguaauaauggacuuuugggagguugcauuuaugauaaaaaauagccuggggcuguacaauccuuccuaucaugaagaaguacaaaguuguaaguagaagcaguggccuugcuuugccaaugcacacugaaggggauaacguuugcuccuguucagaguucacggucgggcgcgguggcucacgccuguaauccuagcacuuuuggaggccgaggccggcggaucacgaggucaggagaucgagaccauccuggcuaacacggugaaacccuguuucuacuaaaaauacaaaaacaaaauuagccaggcgugguggugggcgccuguagucccagcuacuugggaggcugaggcgggagaauggccugaacccaggagguggagcuugcagugagccaagaucucgccacuguacuccagccugggggacagagcaagacugucucaaaaaaaaaaaagaaagaaaagaaaagaaaaagaaaaagaaaaaagaaaaaagaaaagaauuucagaguucacuacuucuuggaaaaaaauaaucccaggaggaauuccaucaacagaagggagucaguucacuuuugcaaucuccugagaaucaauuucuuaagacuuguggaauauucaguuuaaacacaaaacuaaaaacaaacagcuguauuggaguauuauugacauacaauagcauggcauauuucaauuguacaauuguauaaguuuuugcauguguacacaccugugaaaccaucaguacauucaauauuaugaaccuguacaucaccuccaaaauauuauuugugcauaccccuuugugauccuuucuuacugccccuucucuccaggaaaccacugaucugcuuucugugaauauagauuagacugcauuuuguggaguuuuauaugaaugggaucagacaguacuuuuuuuuuuccuuauuuugaucuggcuucuuuuggcauaauuauuuugagauuaaucuauauuuuuuuguguuccuucccuuuuauagcugaguaguagguauauaccauaauuuauccaaucauccauuuaaagcauuuggguuuuuccaguuuuugucuauuacacccaaagcuguuauaaacauuuauguacaagucuuuguaugggcauacaugccugcaucuuuuuaagugauucuauuuauuuuuuaaaaauguagaaguucugggaucuaguccuagguuuuucucugaccacuugcgugaucuuaggagaggcauuuaacuuugccuucagcauccucaaggucuuugcugugauuuugagucaucacugccagaaaccaagauggucuuuguugauuugaugguuagagaauuucagaaggagagagacgggucaaauuuuuccuuucuguuucuuuugaaagcucuauuuucuuucauuucacuuuuuucccaugaaugacaaauuuaaaugcugacguauaauuuggggcaagaacagaagugguuagauaaguaggaggaagagcuaauagugguuagauaaguaggaggaagagcuaauaguggcugaacuuaaacaugucuaaaucauagguggaaggcaagaggugggaaauaagcaagcucagaaauuuugugucucuuucuuuuucucaaacuauccucuucuaagucuugccuuuuguuauuucuccaugaccaauuuguuuuuaacuuugggguuaggaggugaauggguaugcuggacuccaaaggucauauaucaacuggagguggugggugggagguuucuuaguuaaaaguaauuccuuugggccgggcgcgguggcucacgccugucaucccagcacuuugggaggccgaggcgugaucacgagguuaggagaucgagaccauccuggcuaacacagugaaaccccgucucuacuaaaaaaaaaaaaauacaaaaaaauuugccgggcgugguggcgggcgccuguagucccagcuaccugggagucugaggcaggagaauggccugaaccugggaggcggagcuugcagugagccaagauugcgccacugcacuccagccugggcgacagagcgagacucagccucaaaauaaauaaauaaauaaauaaauaaauaaauaaauaaauaaauaaauauaaaauaauaauaauaauaauuccuuugggaggcggaggcgggcaggucacgaagucaucugagaccagccuugccaauauagugaaacccugucucuacuaaaaauacaaaaauuagccgggcaugguggccugcaccuguagucccagcuacucuggaggcugaggcaggagaaccgcuugaaccugggaggcggagguuguggugagccgagauugugccacugcacuccagccugggcaacagagcgagacuccgaaaaaaaaaaaaaauuccugggcaggcgcgguggcucacgccuguaaucccagcacuuugagaggccgaggugggcgaaucacgaagccaggaguucgagaccagccuagccaauauggugaaagcccaucgcuacaaaaauacaaaaauuagccaggcgugguggugcgugccuguugucccagcuacuugggaggcugaggcagaagaauugcuugaaccaggaggcagagguugcagugagcugagauugcaccacugcacuccagccugggugacagagcaagacuccaucucaacauaaauaaauaaauaaauaaauaaauaaauaaauaaaauaaaaauaaauaaauaaaauuuaaaaauuccuuauucuccuuucagauauggcuggagucauuuguuucauauuuuccuuucaccuuuuacuugcccuaaaucugguucagaacuuuuugugggagcauuaaguuaccagaauauuuuuguguaguaaaauucaagcaaauaauaauagacuguuuuauuauacagaaugaaaaugcgguucuugggguugguggucuguuugguucucuggacccugcauucugaggggucuggagggaaacugacagcuguggauccugaaacaaacaugaaugugguaaguuucucaaaguuauguacuuuuaaaaugcaucuauuuccccgauccaguuaugugagcuacaugaagccauacccauacauucaucucuuuauaacuccuuugcuuuucaauuucucugaauuuuuuuuuuuuuuuuuuuuuuuuuuuuuuuugaggcagagucuuacucugucaccugcccgcccaggcuggagugcaguggugugaucucggcucauugcgaccuccgccucaggggcucaagugauucucgagccucagccucccaaguagcugggacuacaggcaugcaccaccaugccuggcuaauuuuuuuuguauuuaguagauacaggguuucaccauguugcccaggguggucuugaacuccugagcucaggugaucuguccaccucagccucccaaaguccugggauuacaggcgugagccaccgugcccagcccaauuucucugaaucuuagauucaauuugcuaggcuuuucucaccagguaauauguagccaacaaaccucaguuuaauguuauauauacuucuuaauaagauaaauuaugauuuuuuauuaauucauuucauuuuuaagucucacuaaguuuguuuaaacuauaaaaaaguauuuaaacuuugcaagaacauuaccgcuauugagagcugguuuuagaauacauugaacaaagguugugauuaagaauguccagggaacauauuucuauacagaagucaaaguaucugagcuaaauuuuguuagaaaaaauaugcaaaaauaaccacucgacuaauuaaaacaucugaaaguuauuaaucguaaguaaacaauaaaaucuggaaauaccucauuuaggcacaaaauaucaguaaaguacaaauuauuaaagaaaacagcaacuuuaaaauagauguugcagugacccagcugaagaaucaggcaagcuuagggacucgcagagaaauucacagugagccaggagaguaugaccugauaacagggucuuaaaguuaaguuuuacuucuuagcucaaagcuuuucuuuugccucccaauuuuuccaacuuuuaaaauaauuuuuuaaauaagaaugauaaaauuaaauucuuucaaguacuuaugguagagaggguaugugcacuuauuuacauuaaauccccuggauaauugaauuauccauaucccacugagcuccugauuaacaauugucccaugaauccuuccuuauagaaaagugaaugugaccauaauucccuauuuuguucaacuuuucuuccaucccaccuugacauucuauguaauuauuuuaguccauugauaaaaacaaguuaauauuuuuuauacuuuauuggccagcaggggaucucucaaaacaaagaaaguguuuuauacauugacaguucuagcugggauauuuagaaaagaaagaaaugagcauuuauuugugcccgguaggcaggauggaaacaaagaggcccaagaugugguaaaguuaggcaaauuugguauaaaacaugcuagaaugaugaaacugaaguuuaaccagacaccgguagguggaacacaagcgugaaacaagggaggauuuacucuugugaugagaaguuggcuacuagauuuagcagacuaaaauuucaaugacaaaugcuuucuuaaagccuggagaacauaguuuaucugcuccuuugcuuguuaaugugggagacuguuucagauucuguccacccaauuuccaucguccuuuuucucuacagagugaaauuaucucuuacuggggauucccuagugaggaauaccuaguugagacagaagauggauauauucugugccuuaaccgaauuccucaugggaggaagaaccauucugacaaagguaugggaaggcucuuaaaaguaaaaaccagaauucuucuggguuuuguguuaguaaccaaguucagauuuaacuuaaaaacauugaaaugggauuauuuuuagacgaaagcacuaacuguguugagguuugcaaggcaaagaaaaauaauuuucuuuuaaagaaguaaggacaagagucaucuaauuuuuuguucaaaggccagauucauuugaggauaugcuaaaaucucugaggcuuuguuuuuuuaaggaaguguauuuaaugaaauguuuugagcauuaaauagauggcuuuugcuauuuaaaaauuauuuaauuuuuuugaauucacauaaucuaaaaaucagagaauuagaagacauacagugaaaugccucccuucucucucacucccuacuuccugcuuuuuuguguaucuuuuugaaauaacuucauuuuaaaaucuuuuuauuuccaaaaaucucauuagaaacaaauacacacacagauucuuauuuuucccuugccuccauuugaaugcaaaagauggcacuauuuuguucuuugaauuuuuuacuuaauaucuuggagaucuuuccauacaauacauaaagcacaucuuccagaagugcaugauauuucacuauaugacuguaucauuauuuauuuaccaaguguccuauuaaugcauauuugugcuauuucagucuucuguuaacaaauauugcugcuguaaauaagcuuuugugugugcaaguuuauuuacaugauacauguccagaaguagaauuuuuggaucacaggauauaugcauuugugauuuugauauauauugccaagcugauuuucaugugcauguguccugauaauuacuaucacuaugaauauaugaaaguucuuguagcuuuggcuuaaaaaguauauauauacauauauauguauaucuuuuuucucucucucauuuuauaacucaagcaaaacugcaguuuccagugcagauaaaggaauuucuagacagacugauugaaauuauuaagcaguuaucagaagaaggaucuaaucuuuauucaauuaucucuccagauguagcuuauuuauuuauuuauuuuuuugagacggauuuucggucuuguugcccaggcuggaaugcaauggugcaaucuuggcucacugcaaccuccgccucccagguucaaguaagauguagcuuauucucuaacauuuuuuuguuucuggagacuuuucuuggggaaauuaagguuuagauuaagguaguuagauagcuauuuauucuucaauuuaaguguuauacgggcaaaagagccaccuuugccucaauuccugcccaaauuguuauucaaagcaaacuuaaacacccuuuguguuaaugugagcauuguauuauuauuugcuuuguuuuuucuuaauuuauccuaguuuaacuuuuuucuuccauguguucuagcuguaauaagauuuuaauaauguuuagguggccacgacaaccauuuuuuuugaaauuugauuucuaacucuugagauuuuuaugcuuuacagauauaugccauuaagcuuccuuuuuauaaauauguuauaaaaugagugaugaguuauagugagagcuuuuaguuuuuccugugcucaaaacacucaaaacauauauuuuaugcuagagcgagcauaugaucuugguuuccuuccuuuuuuuucccccaaagaauaaccccuguauacugauuucagacacuguauaaagaaaaaugcuuuauauuauuuuucuuaaaauuauaguugauuaauuaguaacgugaaucacuguuaaaugaugguaagcaucucaguaaaacuugcugagagcucuccuccuauauccagcuucagacuucucucuccauacagugguuaaaacacucagagucacaugcccuaccuguguguaucacacuguugcaggggaaggugcagugcccuggaauaugaagaaagugagcaugagucuugauaugcucccagguaauagaaaggagacuuaugggaccuuggugcuacaccuggguuugccccugacuucuugugugcuuuguuuuuucuuuuuuuuuuuuaaccucugugggauauauuauauauacuuuauuuuauuuuuggcaagaggguuggggauugggagaguggagagucuaggucuuuagaaugggggaauauagacugaaaguauuuacucuaagcuaaaucuguucauagcauuugguccucauguucuuucucuauucugagaggcccucccuguaggggaucacugauguguaugucauaccugcuaugagcuaaccucaguggggagucuucaaggaagucuacagugaacaacucaguucucuaaaggaauugugauuuuccuaagaacugcauaggcgcuuuccugaugguuugcauuuccacauucuaaaacagagcauggacagaggcucuuuacuguccuucacuccuauucaagagcaagguuguugccacugguguuauuuccgguguuuaaaggcaaauagauaaaaagaauggagaaggccuuucacacccaaagugaaacgcguccucuucucaugcaucccgcuuccccuccugacuuccuccucuauuauuaauagcaccagcauccuccuaaugaccuagccuggaaucugcagaaucauucuugaccacggguccucucuaggccacccacguuaaauugcuucaguucaucuuuuucuucuguuucccugaccaccagccuacauuaggcucuuguuaccacuuaacugggcgccugaaauaagcucagcagcugagagagucuugagccauuuccauuuucaaggcuccucguauacuaacagaaagaaagaauuucaagacaggauuauggaaauucaguuugcuuauauaguuuaagaaauuaaugcuuuuaauacacacaaaaauacugcuauacauucauacuauuuacaaguaauuacaaaauguauuaaaacauuauucauuuuuugguaccacauuccuuguggaaccugagucuacagcugaauggugagcaucuuucaguccuguugccaugggccucuuugacugacuguguagccucacuuggagaucagguuuuuuuuaugaacacagggcuuggccacauggcuucucugcucauguuugcuuaaaggcuuuaccuaacugcucuuuucucugccaggcuuccuguucucauucauccuaugugguuuugcaggauuaaguuucuuaaagcuuagcuauaaugaugugaaauugccauucagcaaucuuuaggggucucagaaaugaagauacacacuguuccuuaaauauucuguccagcugguauuuguaccuuucaccuccauucugcacaguaguagcccuuggcuacucgugcaguaugugcaugcuguuucccaccauuaagcaaccuucuuaggaaguguugagcaaugcuuugcuccugaagggaauugaaauucagaaauuacacuucauagggaaguggcucuguuuucaucugcucagccuuauuucagaaagucauggggaguuagcacuggagggaucucagauuccugccugggcuagggauuuuuguuuuuuuuuaaacacacuucacugguggauuccaagguagaauucuugguuuuggcaaccuguguucuagacuaacauccucauuuuguuggauaagacagccagguucaaauagggaaaugaauuugucucagggcagagggucauguccugaccugucugacuacagauucagugaucuuugaacuggagaauguggccuuacauaauaaauauuaaccaaguugaugccaugauaggcacaauauauauuuuauauauauauacacacaccaagaguggcacauuuguaucugaaaguuaugcaucugauugccgagugggugaaguggcacucuagacugugaaagccuggaaugacugccuucagcaugcagaaacaggcuuuucaacuguggccucagcaaagauuccccagggguuguccauugagcuauuagagucauagcugaaaauucacagcguggcuugugaguuaagucuuuagaaggagaccaucagcuuguauuuugcuuugauuguuuauuuuagaauucugguugauuucuagauuuuucuuuccuuauagaaaaauccuucacuucuaaagaaacuauuuuuugaaucacugcagugcucuaacgggcuacacauaggcguugguaaucugggauguaauuccucaccccugguggugccgaacagacaugguuucauuaaucaaugccugagcuuggugacuugggcugagcucaggcucauguagcacucugauggcgcauuggguaggggauugcauucagaaccuuugccuaauggagcagcauaagugaggucagcuguacagcuuaucucauagacccagguugggaucagagcagaaagccaaguggaaaggaagauagugcucugcccuguccccuucccuccucuuccuccugguuaaccgcucugaccuguccucuguucucaaccuaauuuucacaucuucagggaggauuuccucagccucucacaccaggucaggccccuggcuacauauucuuauaguccucuguguuuuucuccaucgcaauuaagacaauaaacaauauauuauuauguaggugaugaugugugugaccucugucauccccaccagacucugcggggaugaagacuuuucugauucucuuuacuugguaaauugcuuuagcuccaggcugcagucuacccaagcaugcuccugcagcccuccugugacauugcgauuuaauaguguccccugcucaagggcacacugcaugaaggauuuccuacuccugggcuccuaggaguccacgaacacaacuuaaaugcuuccugugguggguaaaacuugaagcuguauugccucaugauuaagcugagcaugugaagagccaccagucauggguguaaguucuggcucuacuauuuaacuggcugugugaccuuggcaauuuucuuuaccucuugaaguuuugacuuauucaauuauuaaacaggaagaauaauacuggcuacuucguaggcuguugugaaaauuugauaaggccugugaaauauaugcaguauaguaagugcaggugauacaauuucuuuuacaacauuuauuuauuuaaaauauuaaugaauaaauacauaaauauuuuaaaagucucaccgugucucccaggcuagaaugcagugguacaaucauagcuuacuacagcuucaaaugauccucccucagccucccaaagggcugggauaacaggcaugaaccauggugcccagccucuguuuuuaauuuugaaaugucaacauggauuugaugguggucucugauauugacuucuucaggauuaagcccuccaugacagggauguauucuaaacuguguggacaggaggaagaugcauuuguuuacaauggacagaaguaagaaaaguaagaaaugucauagaacuaugucugggggucaggugacaagcacugugucauuucuagcccuguguccccugcaggugcuuucuucuguggacccucugcuccuucuguugagggagaauuuuggaugagagcuggauaauuucccaaaauucgcucaacugugaagcucuggaacucaaguugcugugcugcaaagcugucugaggacaggccgugguggcagagaggggcagggaagacaggcaauuuggcauggagaugaugggcacauuugucacaugaccuggguuugauucccagcugcaucguauacuaauuguguguccuagggcaaaugauuuagucucucuaagccucagaggccccaaaggaggaagaaugauguaaauggcccagcaccauccugggugcguggaaaacucuaauuaugauaauguccuggaacguucugcagugaacaagacagaccacauuacugccuucguguugccuggugaucagagugauuauugcugguuuuggggaaaacagcauucugaggcauggaacgguuuucuucccugcucugugaugcagggugcucuuguuguguucacuccugcaggucaccugcuccccagcagggugacagugaagugugagugcaguggacugcacaguggcaaaggccacaugacuccugaaugcauccuguggacaggccaagcgcugugcccugugugaaucaucaggugaacucucauacaauucuaggguguaagaacuccuauuaccuccuguuuuacagaugaggaaaccaagguuuauaggguuaauuaacuugcccaagauaaagcagcugauggguagugaaggcaggagucacacagcccgugacuguuucugcccacuuggcccucuucucaggcuagagaacagcuaugaugucccugauaaagucacacuguggaaaguggaaaguaucugacuuagauguccugcaucugcuagauguccugcuugugccuacuacagcaacucagagagcuguuaggugacuuaucugagauaaugcguguaaagugcuuaagugcuuagcauggugccugucacauugucaacacuuaguaugcgcuugcuguuacuaugauuauauuaccugggccaaagaaugccacuucacucuauccuucuucauagugguuauguucuaauaauauuuuauuacauuuacaguuaacucuuuaacaacauggggguuaggggugcugucccccagaguuauugaaaacugcauauaacuuuugcauuccccaaaauuuaacuaauagccuacuguugaccagagggcuuaccuguaacguacauagccaauuaacaaauauuuuauauguuauauguauuauauuccauauauacaauaaguaagcuagagaaaagaaaauguuauaaggaaaucauaaggaaaauaggauguauuuacuauucauuaaguggaaguggaucaucauaaaggucuucauucuuauguuggaacaggcuaaggaagaggaggaagaggaggaguuggucuugcuguuguaggaguagcagagguggaagagggggaggaaguggaaggggagacaggagaagugggcacauucaggguaacuuuaugaaaauacauuguaauuucuguccuuuuuucauuucccuagaaauguuucuauagaauagcaauucuuccaucauuugcuuuaguuucagugccugugucauagaagcgucaguguuguaaaggaagucuugaauaauugcaauugccacccuucuccugaauugucuaauaucaguuuguuuucuagcacugcaucucccaugucuucuuucccaucgucuggugcuguuuuagaagcacucgucuccaucaaaucaucuucuguuaauuccucuggugugucuauuagcucuugacuuuauuuaagaugcauauauugaaacuauuuaccugcucccacccuccaccuuuuugccauauccacaaucuuuuucuugauuuccuugauuggcuaagucauggauauggauacugugaagucaugcacaacaucuggauacacuuuucuccagcaggaauuuauuguuucaggcuugauaacuuucacagcuuuuucuguaacaacaauggcaucuucagugguguaauucuuccagaccuucaugauguucucucuguugggguucucuuccaauucaauccuuuccauaguguauguguguaaugagccuuaaagguccuuaugaccuccugauuuagagacugaauuaaagauguguuugggggcaaguagaccacuucgaugccuuugguauugaauucaugggguucuggguggccagaggcauuuuccuauaucaaaagaacuuugaaaggcagucccuuacuggcaaagcacuuccugacuucaggaaaaaagcaucaauggaaccaaucuggaaaaauaguucucauuguccaguccuucuuauuguacagccaaaagacugacagcugaugucuauauuuucccuuuaaggcucagggauuagcagauuuauagguaagggcagaccugaccaucaacccuacugcauuugcacagaacaguagaguuagccuaucccuucuugccuuaaauccuggugcuuguuucucuuccuuacuaauaaacguccuuugugggauauauauauauauuuuuuuuuguuagaauggaacacuuucaucugcauuaaaaaccuguucaggcagauacauuuuccucuaggaauuuauaugcagccucuugguuggcaggagcugcuucuucuguuaucuugacauauuuuuaaaguuuuuaaaauuuuuaauucuuaaaauuaauuaauuuuugguuuuuuagagacagcaucuugcucugucaccaagcuggaguacaguggcaccauuauagcucacuguaaccucaaacuccuuggcucaaccagucuucucaccucagccuucuaaguagcuaggacuacagacaugugccaaccauacucggcuaauuuuuaaaacaauuuuugauagagauggggaucucacuguguuuuucagacugguuucgaacaccuggccucaagagguccucccacuuuggccucccaaaaugcugggauuacaaacauaagccaccgugccuggucuauauuggcauuuuaaaagccaaaccucuuuguaaaauuaucaaagcaucuuuuauuggcauuaaauucuccaacuuuagauucuucaccuucuuuuuucuuuaaguugucauauaaugacuuugcuuuuucuugaaucuuagagucuagaaucuauucuugcuuuaucuugaauauuagagucuagaaucauauuagagcaauccugcacccacauaaaagcugcauuuucaauaugagauaaaagguauuucggaaaaagugcaagguuuuggcacuugcugucauagcugcaaugacaaauggcuucacaaauuuucuuucccuuuuuuuuuaacagucaucuuuaugugucauuuaucuugaaaugaagauaauugaagcugcagaccucaaucuaugacacauaucaagcaauucaacuuuuucuugucuggacuuuucucugcuuuuugggagcacucccagaucacuauuaguucuuuguauggguccaaugguguuauucaagguuuaugauaucgugcuaaacaugaugaaaaacauaugagaacugcaagagaucacuuuuuacugcaaugugcaauuuacuggagaaacugcuuacguggagaugauuagugucaugagaaauuuaagcagauauuuacaauacuugagcaacaggaggcggcuacaaaauuauuacaguaguacacaauaaacucuaguuaauuuuaugcaguuaugauuuaauaccacaucuuuacauuuguuuacauuucucuuaacugucaauggcaccauguuuggucuguaagugugugucuaaguuuugaaaauguuaacuuuuuauacuuuguguauauuuaugguaauaaauaaaaaaggccaauaucuaaauauauuuuaugcauucaugacauacuuaaccuuuuaguaacuuuuuauuauuuccagacuacagaguuggucuguuaguuuuucucaaauuguugcaaaucuccaacaaauuuuucaauguuuauugaaaaaaaauccauguaugaguggaccugugcaguucaaaccuguguuguuuaaggaccaacuguauagauuuauuauuguuacuaucagggaccauuauuuauucagcuuuacuauguauuaacuacuucgucauucucacuuuagaaaaggacaccuauacuucagagagaguugagcaaauccuacaaaguuuuguagccaguaagaacugaggucugcuucaugcuaacgcccuggugucugaccaccuccuuguucucuguuuugguucugcccuggcccucagcugauuucucacauguguuuuggagugugacggaguccuguccggacucagcauccuggcagagaaggccagugccuugggaggcaggaggaacuuccccaccuacccggucaucuuccuccugcgggacugugggcucagcacauucaguuucggagcuugaguaaucgccuccuggcuuccacccacacugggaaggcagcguugucguggacugccacugggcugcuucuuugucagcuuuguccuauuuagggccauaaugaaaucacuugccaucuccaggcugagaaaugguccuuuagucuuuucccuuaauccccagcccuccuagggcuucuuuuucuucaaguugcauuugcacagaacucccagagccacccguagggcauagcuggggaaggcagcccuugaccugucaugcugguuugucacucugacaaacagggcuucagggugccugagugcauugagcaggcugggccuuggaggagcugccugaccaggcgaggcugagugggugccccuccuuucauucccuaucccccuccaucuacuagagauuacuuucuucaagcacuuuguccacauccuuucaaaaauagcuuucugccuucagccggaaggccucaguguguucuagagacuucucucuuguuaaccuucuuucccuagcaaagcacugaaaagcauggccuguggugucagacacaccugguuagacuccaacccucacgcuuccuagcucucguucagccuugggcaaguuacuugacuucuuuaccacaauucccuguucuguuaaauggcaguagugccaacuucaaaggauuuucaguacaguaccuacagcauacaagcgugcaaucggcgcuagcuaucauuucaaucagcuguucucagcaaggugaagugaaaucugaaauaguucacuggaagaugugaacagcaauagguuuuaccuucccagagagaaacauccuuugccagucaauccuuaaauccuucuuugguggugggaugggaaagaaccacauuguaccuuccuuucuucccccuggugggagcaggugagagaagcuggcaacaguuggcugggccugcuuccagcguccagucuuuuccauucccuuuuguauucacccaaugccagagggaaggggcaagagguuuggaagccauuuuuaaagguuuuucacccgaggauucgauacuauuuucuuugcugaggauccgucaugccuaauggaacugccaucucuagaaguucaguaaguuauauccucugcaucucccuccucagaagagacuuuuuuguucugggaugaaaggaaacuggcccagccuggaaagaugugcaccccaugaaguccuuccuauucccuguguccccaggucagacaaggcacuggacuuuuccuagugguuccccagccuggcugcgcgucagaaucaggcagggaggcuuucaugugcacacuggucccaucuggccaaggccugggugcagugucagcucuuuauucaucuggcuccuauguuuucuccagaacccuuuguggaaacaucugucucuuacuuagaauccaggucaaauguuugucccacuggccaaguaacuuucuccuucuucugggacuuccugagugguguucuagccuucuucuugcuggguuagacagucaucgugugucugacucccucgaggauggagcucccugugggagggaguguggguuacccaucuuugcauuccuagcaucuauuaguuuggggcaaaaguaauugugguuuuugccauugcuuuuuuauuuugugggggguggggguaaauggaaucccucucugucacccaggcuagaguccaguggugcgaucuuggcugaccacaacuucuaccucuuggguucaaacaauucuccugccucagccuccugaguaacugggauuacaggcacccaccacgaggguuucaccaugcuggccaggcuggccucaaacucuugaccucaggugauccacccgccucggccucccaaaaugcugggauuacaggcgugagccaccgugcccggccugccauugcuuuuuaagggcaaaaaccacaaugacuuuugcaacaaccuaauagcaguggcugguacucaguaggcaccacuaaagguuugcacgaaacguaauguauguuuucaaaucacuucuugauauuuuaccuucuagugcacugcuuaagauacagcagauuuccauuaaaaacuuuucaccugaauguggaggacacagcugaguggccuccauucucuaaagccaugccauuugucagacguuuaccuuucuucaucagcccuuuuccucaucugccagcauuucccaugagaaaacaguguggucugcaguacccuuugcagugcuuggcccagauucuccagauuugaaaacauuuagcuuguaaagaauagauucacuguuuccuucccaucugcugcaucuuuugugccuguuguucauugagcuuuuguauucagcuugaaguaggggauggaagaacccuaacaaacaaaaaaggacaauuagaaaaauagugucuuugacuuauucucuggaagccuccuucaaaggauaaaguaauucccugagaaaagcguugugcaggugugaauucggucuggguggaacaaggguauuuaccgauguucuuagaagcugcacagccaccuuaggcguggucuccuggguagcacaugcuccagcuguccacaggccauuccuuucuucacacucaccucccaggaaaacugcagcagcuccucauugcccuugggaauccaggaguuauuuauuggggauguuuaaagacuuuccugauguaucuucaacuugucagcuuccacauuuccccauucaaagcucuagagguuacagagggaaguacagagacuuuagggaaauuuuaaacauucuccaucgagagaagguggggagcugaguccuggucccaugugcuggccaacaucuccccuuccagccucuguccuggccuggcugccacauaucacccuccuucuccucucucaauuauccuugccccagggcccucuuugguuucaaaccauuccugccuuucucuggacacucuccccugaggaguagacuaggcagucccauguuuuccguguuaacuacagaggcacagauuggaacaagugccaaggaauuaggccaccuaccgagccuuccucuugccucucucugacucuccauccugagggaagacgauugcagucguuuuuguuggaaaugaccugaccugugggagcagcccguuccuggccuuucaaagucaagucaccuuacucauggccuagcuccugaucacuccuggugggugaaaagugccucaacauaccuaaagagcugugacaugagcaggaaagccccucuuucuagaaaguguugggcaccaucaguacagcagagccacugcaucguacagcgcccggucaccauucucacguacaguuaccaugagaugaugauggugccuguaguuacacauuuuucaacuauaauuuaaugauaaauuaauuuugguaauuauaauugucacuuacacugcaguuuauaauuuuggauuuuuaaugaucaauuuucauauuuucccagcuggauuaucauccucuucauugaagccaagaagccugugcauaagacgcuguaucuaccacaaugccuuccacuuacauuuuucguaguaaauuuagucuuguuaauauugcauuaaaaugaaccuuugaaggcaaagaugagcacauaaagcagcccuaaucuuguccaguuugcuuucuauuuucuccccauggguagaaguucaccugcauggcccuggcauuucuauuuugugauuagaaaaucacaccagccauacaugauguuucacuucuguaauccccgcacuuugagaggccaaggcgagagaaucacuugaggccaggaguuugagaccagccugggcaacauaguaagaccucaucucuaugaaaaguuuuuuaaaaaauuggcuggauguugugguacacaccuguaaucccaguucuucaggggccugaggugggaggaucacuugaguccaggaguuugaggcugcagugagcagucaugccacugcacuccagucuaggugauagaaugagaccuuuucucucuuaaaaaaaaaaaaguuaugggaaucauuuuauacucuuggccugggguccugcuauuuuaacaacacgaggguauagcacccccagguuguacaacuccagggaguaccauguauauuuucauguaugugagcagugccuuccggaguagucuacggaagcuaccuugcagcagaacugucauuuaaaaacaauuugcuaguuaucaaaucuauauuaggacauuagcagaaaugaacauuugucaauucacuuauagucuuaucaucuggacaaaucauucuucucauuuuuccuugguauuuuacacuccucuuugguguacauuaauuuugcacagcuguaauuuagaguagucuauaauuuuguauuuugcuuuuuuuuccuuugcaagguauaagcuuuucuaugcugucacuguccuugucaugguugauggauaauuauuauaccaaguggauuucaaugaauuauuugaccacuugacaauuagcuuauuuccaguuuuucacuguuauaaagaaugagcagagggcaaaggaagcucucauuuguucacugugacccgugugucagucacuauacuggauacuuaccucacuuauuccucuuaacaauuauuuuuggaacugagacgcagacugguuaagcaacuuaauaguaugaguugauauauagugaacucuuacugugugucagacucuuugcuaccuacuuuucauauaauaucucauaucucacuguguccuauaaaauguguauuaucauuucuacucuucagggaauuauauuaauuuuaggagauguuuccccaaggugucauguuagaacuuggagaggacagaguugagccuagguuuguuugagcugucuaaaacucaugaucgggcugggcgugguggcucacaccuguaaaccccgcacuuugggaagccgagguggguggaucgcuugaguccaggaguuugagaccagccugggaacauggugaaacacugucucuacaaaaaacacaaaaauuagcuggguguguuggugcacgccugaaaucccaacuacucaggagguugagauggaaggaucacuugagcccagaagguggagguugcugugagcagagaucacgccacugcacuccauccugggucacagagcaacauccuaucucaaucaaucaaucaaucaaauaaguggauaaaacucauggucaguauaaugucagcuccauggagguacuuuuuuuccucuuguuuuuguucucugcuguguucucagugcugagaagaaggccuggcacauaguugguacucaauaaaggcuuguuucaugaauaacugaauggucucagcguuagguaagcagcuugaggucagguuucuuuggcucccacaucuuuguuuuuucugcuauaucacugucucggguacaggugaguagaaaauaaauucucacaggcagacacagacacauauauuuaugaauuugugugugugagccuuuuuaucuauuuaacuuuuauucagcuuuaaaaauuuuuauuaaauuuuauuuuuuaaagcaguuuuaaguucauagcaaaauugaguggaagguacagagauuucccauacacccucugcccccacacuccccuguuaugaacaucccucacagaguggaauuguaauuguuacagcugaugaaccuacauucacacaaaguccguaguuuacauuaggguucccuuuuuuuuuuuuuuuugagacugagucucccucuguccccuaggcuggagugcagcagugcaaucuuggcucacugcaaccucugccucccggguucaagcaauucuccugccucagcuuccugaauagcugggauuacagguguggggcaccacacccagcuaccuuuuuuguauuuuuaguagagacaggguuucgccauguuggccaggcuagucucgaacuacugaccucaagugauccacucgccucagccucccaaagugcugggauugcaggcaugaaccaccacacccggccacuacaguucacucuugauguuguauauucuauaguuuuggacaaauguaugauggcaugugucuaccucuauaguaucaugcagaguagucuuacugcccugaaaaauccucuuuacucugucuaugaauuccuuccucccuccuaaccccuggcaaccaggaucuuuuuuacucucucuauaguuuugucuuuuccagcaugucauauagaaugcagccuuuacagaucuugguaauauguauuuaagguuccucuacaucuuuuuguggcuugauagcucauuuccuuuuagggcugaguaauacuccauugucuggauguagcacaguuuaguuaugcauucauuuacuggagcacaucuugguugcuucuaaauuuuggcaauuaugaguaaaacuacuauagacaucuguaugcagguuuuuguguagauguaaguuuucaacuccuuuggguaaaauaccaaggaaugugauugcuggauuauaugguaagaguauguuuaguuuuguaagaaacugccaaacuuuuccaguguggugcuaccaguuugcauuuccaccagcaaugaaugagaguuccuguuccuccacauccucuucagcaguugguguuuucagcguuuuuggauguugcucauucugauacguguauagugaugucucauuaugugugaucuuuuucuuuccuuuuguuuauuuuguuaggaauuauugugagaaaugcaauuacgaaagcaaauuguaaaaacauuuuauaagaaaaaaauuguaaaaacauuuuauaauuucuuaaaaauauauugauuuuuguuuuugcugcuuacauaagugugucuuguuaguggacaugcaaaaaaugguccaguuucacugcuaccuugccagugcuguuuuaaaaaaauucuuuacuaacauuauaugugaguacaucacuaugucaaucuuucaauuuauuucuaguucauuauuugcuuauggaucuuuuacgaauguucuauuuagcaagauaucauauuuguuuugaagcuuggugcuacugccuccuaaacaaugaauguuuuucaggucccaaaccaguugucuuccugcaacauggcuugcuggcagauucuaguaacugggucacaaaccuugccaacagcagccugggcuucauucuugcugaugcugguuuugacguguggaugggcaacagcagaggaaauaccuggucucggaaacauaagacacucucaguuucucaggaugaauucugggcuuucagguauauaugaauugauaauggcauggauguauuuccuuaguacucuuaaagcagacaacaggcuuccagcagaagagguagauaggugguaacucugaaguuguaugagaggggaaguuagugucuuuugaaagguuuuaaauguugcuaggaauuuaaugacuagcaguaagguaaauuauaaguaaaugauuacauuaagauuuacauuuaguuaggaauucuuaaguuacuucggcauuucugguggugugggugcugcuggguaaacguuauuccauaacuuuccuccuuucuccauaaauauguaauccagauguucacuuuucuucuuuccagaaauuauccuuuccucccucuuccuucuggcuccaccaguuaauugcuguaugacauuggacaucuuacauaagccuccugugucucgguuuccuuauuuguaaaauggagcguaauaaacaccuaccucauaaggucacugggggcuuaaaggagagggugcagagaaggaaccuccacagaaccuggcaccuuguaugaacuggcuagggguuggcucuucuccugccaguggcaacaugcgcaugcauauacccauacgcacacuuggguuuuggucuauguuuugguaccagguauuagagaaagucagcagcacuauagcagccuccgggcuugcuucccauuuuuaaaaccagaggcaccucuaaggacaugaaacacaagaaugagagcuuuuaacaaaaggcauauacaagaauugguuuauugucacgcuauuuguaacaacggaaaacaggaaacuacccaaaugcaugucagcagugaauggauaaaguguuguauauuuauauaguagaauaagaaugaacaacuuacaauuauaugcagcaaaaaauggauuaagccagauacaggagaauacacauuguauaauucuacuuacagaaauauuuaaaaacaggcgaaacuaauuucuggugugaaaaaugaggacaauaguuacuuuugggagacacaacuggaagagagcccaagggggcuucugcaguccugcugguguuguuuccuggacucacugcugguuuucccagcuguguuuaguuugugauaacucaucaaacugcauacucaguaugugugugcucuauuuuauguacuauuucaaugaaagaguuccuuucuuggauuacaguuaugaugagauggcaaaauaugaccuaccagcuuccauuaacuucauucugaauaaaacuggccaagaacaaguguauuaugugggucauucucaaggcaccacuauagguauguauguaaauaagaucagaaguugauauaaauucuucauuacagaguuuguacuuuucuuaaaagugaaauauaaaaagauguuaguucaaauuccauuuauuuuuaaaugccaaacagaaauaaugaauaagauaaggaauguugguaacauuuagucuucuaugaaaauucauguauaugguugaaauugaagaaauuaauguaagccacaauauauuacauguuuuccuagaugaagcaagauagggaugugagagaguagaaaacaaguaguuucuaaguucagagacuuacauaaagaaaacaagaaaauauacugccuucugaaguuaaguggaauauaacuaacuacagguacauuugguuuacaaaaaauuuugaaaaguuauaugcauuuuaauuuaugcugauuauauaaguaaugcauguucacuguagaaaaacagaagaacagaagauuuagcaaaauuaaagaaaauaaaaauugcccauaauucuagucagcaagaguuuuuguaauuagggacuaggaaccuguccuauaauuuauuuaauucucccuuuuaauguuuacuaugacuaacaccuuaguguucccaucacaugcuuuccuuacaauauauuccuagaaggagccuuacuauaugaaagguaugaauguuuugaagggucucaaaacaugugguuauauugccaggaaaaaaauggaguuaggcauuuuucuuuauuuauauuucuucuuucaugacuugccugcuugggaccuuugccccacugcuuccuaaagugacauucuggggccagguggcaagacgucagagaggguuguauuaauucguuuucaugccacuacuaaagacauacccgagacugggcaauuuauaaagaaaaagagguuuaauggacucacaguuuaauggauugugagcuagggaggccuuacaauaaugacggaagagcaaggaacaucuuacaugguggcagacaagagagagugagagccaagugagggaguuuccccuuauaaaaccaucaaaucucaagagacuuacucacuaccacaagaacaguauggggggaaccgccuccgugauucaauuaucucccaccaggucccucccacaacacaugggaauuaugggaacuacaauuaaagaugagauuugggugggaacacacccaaaccauaucaaggguuaaaauauauuuuaaagcuaggggauucuaaaugugugaguuccuuugaaaucauuggugguuuauuucaacguggugucuguaaauuguucuuugggggaggggcaugggggagauaaaggugauggggugaggcucuuggaaauagucuguuauuuacauuguaaaaggaacugggaagauuuucugauucucccagacuggauuucuuccagugcuuaucuagguugagauuuggagcaagcauuaacaaaugcuugauuuacuaguuuaaccaaauucaguguuagggcacacggaaguucagagugccccaugucaaguguuuuggcuccugcuggugguauuguuugcgugggucucaggccuccgcgagagggcgucgcgagugacggccuuuguguuuucugagaaggaaaucccagaugauggaauuccuguuuucuguccuuuguucucacagguuuuauagcauuuucacagaucccugagcuggcuaaaaggauuaaaauguuuuuugcccuggguccuguggcuuccgucgccuucuguacuagcccuauggccaaauuaggacgauuaccagaucaucucauuaagguacuuggaccccucccaucccucuccucuccccgcagauuuccuccugagaucugaagaaauggcaaggggagggauaaucugugccuuccuccccugcguuuugauaucaguggagcagugggcuuuucuuuuuccguuuaccccuccuuccagacccagggguggccggggacgccugucguuuccugcacacuggugccacguguacucaugguuagcaugugucaguacagcucugcccaccucacagggagagcaaggagagucugggagaaaauaauuuaagcauuuguggaguugcccuuuaucccaugaggugagccugugcacagaggauguaggagaugggagauaggaaauguucccaaaagcccaucccuagcuacacugagggugaccuaacaacgcuaucauuauuguauuuuauaauauggcuccuaaacacagccaguagcuucaucagggcucugcccuaaagcuguggcacccgaaccucuguucagggaggaaauagauuucaugaaaaagaguuuuaagcuagguaagaccagauguucuauuaugcaugcauuauaugucuuuuaugaaauauauguucacacacacacauaugaaauccuguauagaaauauauacaugaaaugagguauaacgucucucaugggccauuuagaagacuuaaauaggaaagauggaaucuccuaggcuuaggcaguccuucugccuuggccucucaaagugcugggauuacaggcaugagcuaccaugccuggccaauaaaaaaaauuuuaaaaaacaaaauaaaaaagcaagcgaugggcuggauuuggccugcuggccaguagcauugaauuagaugggcacaccucuggcagacauuacugaucaaucacagccuugacuguuucuuagaaguaaccaccgauccaucagagucagaugaaaauuacuuggggauggcccugggaggggugaucauuaaggcccuuucccacuguagaaguccgcugaaaacuuauuugauuuucugccuccuucucuucauuuggagaauuuaaauacaccucuguagugugugauuuuugcuuugguaaacuugugcaaaagcauccugauuugauguccacugguugccauucucuccugaggccauucguggagacauuggguacuugucucugcuucugaggugagucacggagacuuaugcaccagagugaaaugcugagauguucuuggguuucuuuuuauuuuguaggacuuauuuggagacaaagaauuucuuccccagagugcguuuuugaaguggcuggguacccacguuugcacucaugucauacugaaggagcucuguggaaaucucuguuuucuucuguguggauuuaaugagagaaauuuaaauaugguaugcauguuuauaguaagauuugauuuuuuuuuuuaucugugaaugugcuuauuuguguugaaugauaugggagaggugggaaugaccucaucagaacucuaaagagucuuucauuugagaggcacaagcaugaacuuuggccaaugccuagaauacgguaccaccugcugccauccucaggcugacuguggucaccuucuuauguuguaccuagauggagauuauugaaugaggagaucugucacaaauuaagcuguaauauuuauaauuacucuagugauuuguuucuuuuagaaaucauuauaaguauaaacauaaagaugggaacaauagacaguggggacuccaaaaggaaggagggagagggacaagggcugaagccuguugaguacuauagccaauauugaguacugugguuaugggaucaauagaagcccgcaucucagcaucaugcaauccacccuuguaacaaaccugcacauggaccccccgaaucuaaaauacacaaauuuucaaaaauuacuauaaguauuuaaauuuggaacggccauuuacauacacauaaguguaugcuugcaguguguguguauuuauaaaaguacauuuuauaaaauguaaacccauuuuauuuuauaaaauauaaacccuuggccaauacuaugcccguguuucuaaauauguuuguuaguuugucauguggcauuuugaaaaaaaggguuaaaauccuggaauaaaggcccuaaggaauuucagugccauuuuucuuuugucugauaauuaaagcaaggugugauuguuauaugaaauuugggaaauucaggaaagcaugaagaacaaaaugaaaaugcccuguaaacgaaacccacacagucccgugcuuaccauguuguugcaccuccuucauauggacuuuguaugugguuguauguauuuuuauagggcagauuuuuagucaaauaauuuuuuucuaccucucaucucacauacuugagauuauggcucuaguuuuuagugcuuugaagggcaaaauacaauguuuauuaucaaugccaccuuaaugcuguuuucauucuucauuucaauguauuuauuuugcagucuagaguggauguauauacaacacauucuccugcuggaacuucugugcaaaacauguuacacuggagccagguaggcauuccaggagugcauuugggguucauguaaaaucaacaucagaaaggucugggcaugcaaacccuuuccaaauagaaagacaaccugcuuacaaaucugaucugguuuucuuccccagaguccuggguuuuugucaucgugcuuguguugcuuuugauaccugugguggggcacacuguguuauacguggguucacaaacagcuacugggguugacauuuuucuuuucccuccucucccuuccucaagucucagguuaauauauucucucccuuuccuucucccccagcuuucuuuuccuccuccuguuuccuccccuccaucugcuucucauugaguccuagauuuuuuuuauuucuguguugcuucauaaagagugauuuuaaguccguuuuggagauagaaaccgcuguuucaacacuaaccccugaucacaauaugcuuggaauagcagugaauaaacuggagcuaaaccaaugauagaugugaaugggggccccugacuuuugaaauacaguuuugauuauuuuaucauguaaauaagucauguucauucuagaaaauuuagaaacuacaucuagaaaaaaauuaucuuaaaaugaaaauaaaaucauucuauaacccuagacagagaggaaaugcauauccauagauauugaaugucucugcauucuauucuauaccucuuuucaaaaagaugcuguuaaagacauggauagaaauaguagauguagaaauagauugauuuuucuccugcuuacuguuuuacagcuugcuuuucuuuuuucaccugacaauaugucagggacuucuuucuaccucaggacauaauuuugugccauuuauuuuucagcuaacuucauuuuuaauaugaaacaacucaccauuuaagcccuaaaccaagacacuguaggugucuugaauaguaauuuccaaacaccuggcagucacugcuugcaucagaaucaccaaauugcuuuaaaaaguacacuauuuaauaaaucauugcauuaaaaaaguaaugagaguuggaauuauaguggaauucuuggauuggcuaccauccaggcuuauaaaacaaauacuccugugucccaaucauuuggacuagagaaucuguacuuuuauuuuuucguuuuauuuuauuuuuuugagauggacucucacucuguugccaggcuggaguguaguggugcgaucuuggcucacugcaaccuccgccucccagcuucaugugauucuccugccucagccucccgagucguuuuauuauuuuaaaaaaaaauuuuuuauugagguauaagugacauagaauauuuaaaguauacaauuugauauauuucaguguuuguauacaccugugaaaccaucaccauaaucgacacagcaaauauaucaucauccuaaaaggucccugcugccccuuugugauaccuccccccaucccuccccucaaucccacugaucugcuuccugucauuguagcuuaguuugcauuuucuagagcuugcaugagaacagucaugcaguuuauacuuguuuuugucuggcuucuuccacucagaauacuuguuuugaaauuuuccuauguuguguaugucaguaguucauuccuuuuuauuucugaggaucugcauuuuuaaaaaaucugccugguagauucuuuugcuccaccagguuugggagcagaccuguucgggacauccugauacuuucaucuccuucuucaguugccccaggaacucuaacagugcuauaguucuccuuucccuggggcucgucucuaaggaacuaggaagagccuggccugaggcuccugguccuuuauaguaacuagaaggcugagaguuaaaugucaguuccucaggggcagaguuuguuguggccuaaaagaggggcaucuggaaugcaaauaguucaugacgugcugaacagcacaugcuuaccacuuaaggaaugcccccaaaccuucaaaaauccucaaauucacaaagauugaggauuuucguucuugguucaggucucugcuuuucuccuuggucacauuuaugcuuauagucacuuguuuucuucauauacccugucacuagaauuccccuacauuuuugaggaugccuaggaccucuuaccuaauggacauuuuccuaaaaggcccaaugucugucaccucaucaguuauugcacccccagagaugauggagggugacugagcuggcuggaggcagauccugagcuuucccaccagcuuagugacugccagcagcccacacacaguacacgccaggccucagcaaaguacaaauggccaccagaccugggaugucagaggcccuugggaauguugaaaccaaggcuguccuaggccaacucuauuuuauauuacagaccuguguugcuucacccuucugugucuugggccuccacugggcaugggguuugcaguagagacauuggaucggcuaucaucuaggcuacuggucuuguuccagcccucuuauccagcagcuugccagggucaaaggcugcagggugagggccagagcacugcucugugccccauuugugaccuggugacuuuagauucuaacuacccuggaauauaccuccagaauauuugcaaagcccagauuugcuguacaaggcagccugggccuuugcucuucuacccgcuguaccaucuuuugucaguaaaaugguugguugcuuugugcagccauuguaucggaucuucccuuuggcuuucccuccucugggcuguuggccaggggcugccacuggugcaggcugcaggcuccaagaggcagugcaggaaaaggcuucuguggaagcugggcaggccuggaugccgggcaggcuggggcuagaauucagguguggcauuagagggcucuuaugguaugaguuugggguugaccuuaaaggccauuuuguuuacaguccauucagaaguuuacuuuuuguuuaaauaauuaggauuaacuuguuaauaaauuccauaccuuguucuuuagcgggauuuuaaauauagcauacucaucuuuccauucuccuuauaaaccugaugaauuucggagcuccccagagccaagacuugauauuacuucucacuuucucacuggcccugcccagagcccagguacucucaccuguuugaagaaggccaucccaguguaguuuuccaguguuguucugaccuaccuaaggugcuauuaaaaauacugguucuugggccugucugagaccuguggagacucugaauuccuagggcugugacccugggaucuauguuugaguuaagugccuuagaugauuacgaugugcucuuuuuuuuuucuuuaaaggaaaaaacauacuuuugguaggcuuuuaaagaacacuguaaaaaggauauucaguauaauuuuuguuaaacauguaauauguuuuaugaaauuuuagaaaauacaugagugaaagaaaaaugacuuguaugucuagcacccagcaauagccacuauuaauauuuugguauaaucuuacaguuuuguaauauaaucauuuccauuacaaaagucagaucauacuacaucugcuuuuauguaaauuuucauuuaaagaaaugccauuauauuuguuagauacaaguuaagcuguuguauuagagaccccaaaauacagcugcuaaauaaagaguuuauuucuuucucauaauaaaguucagagagagguggcccagacugaugauagaggggguuuuggcuguguuccaugaggccaugcagggacccaguucccuccauacuauagcucugccauccucgggguguuguccucuucugccugguugcagcccggucaccuccaugucucuuccaacucacaggaaggcaggggagagggagcucagggcaagugacuuugugcgaaggagauagcuuagaagugagcgguauggccauagccuggcugcucgcaggaggaugaggaugugguuucuaucuuggcagccauguacuuagggaaagcuuuagggauucuguuacugaaaggaagaaggcaagaaugggaauggguggcagucucugccauaauuaaaaaugccuuuccgggucaguaacuaaaguuuuaaaauauuugucauaaagggcaguuucuguugcuugaauuuuauuaucauuuuguuuuuugcagugauaguuguuuugcagucauaaaucaucuguccuuauauguuagaguguuuucuuaggaugauacauuuauagcaguagacuuaguaagggagaggguaggcauagcuuuaagacuucuaauacauauuguacuuuagaaaaguugaacccguuuacauuuuuauuaccauucaagaccuaaauauaauuuuuaaaugucauuuuaaaacgguuuauccuaauacuauaggcauuuccuccugaucauuaucuacauauacucugugauaugauuaucacagaaguauaaccuuaguguauauuugguuucauuuuuuuccacuuaguauuauuuaugagauuaucuguaagccauuuucuguuuguauuuuauuuauauuuaugacaguggcauaccccuuguguauauuuauguaacauauuuacccaaauaucuauuauuugaaaugguaaguuuuggccacaagguggcgcccgguaaaaagaaaugcccagacauucucuucaaaacugcuuuugguuuaugugaagucuguucuuaucaacugcauacaauucuacuguuugauguaauaaaacacagagcgagaugauauacuacaagggauuguuacuuauuaaaauugggcuuuagcuuauuuccagguuuuuguuacuggaaaucaucuuaauacuuuucuuuugaaauauccuuucaaguggauagcuugaaguccuaagugacuuagcacaaagucaaauuuagaacuucagucugagcuauaggcaaguuucaccuuuguauucugugcucacgcuggugcuucauaugaaugcugaaggacaugugacaaagugaugaacugcugucuguguucaguggcagaauaguuugcaucaauauauuuucacugacaaagauggggaacagauguaccaacaggugcugugaauccaaauuuuguuuugcuuguuaaauaugccacagguauuuaauaucagucauuugcaacggcaaaaacagaugccaaauauuucuccuguaacaauccccuauaguauaucaucucacucugucuuuuauuacaucaaacaguagaauuguaugcaguugauuagaacagacuucacauaaaucaaaagcaguuuugacaaagaaugucugagcauuucuuuuuaccaggcgccaccuuguggccaaaacuuaccauuucaaauucauuuggcuugccaauuuuguguuuaauuuuugacauacauuuaauuugagaguguagaggaaauauggauuugcacuauuuugaauuuuaaaaauaagugacauuuugcuaauauuuuauauuauacuauuuuaaauaugaauaaauguaaauuucaauacaauuucaauuucauggcucuaguaucccuaacuaguuagaauugugcuggcaugcaguacuacuuggugauuauacugauaccaguacucaagaaaaaguguuuaaucaauaccaucauuaaaauuugacuaauauaacuagacaaguagaauggguaaauagaaaauauacagucaucccucaaguaucuuuggggacuggcugcagacaucauccccaaaccaaaauucacagauacucaagucccuuauauaaaaugauguaguauuugcauauagccuaugcauauccuuucauaugcuuuaaaucaucucuagauuacuuaugaugcuuaauacaauguaaacgcuauguaaguagguguuacacuguuuuaaaauuuguauuuuuuauuguuuuauuaucuuuuauuguuuuuuuccaaauauuuuccaucugcaaaauaucacuuggcugaauccacagauacaaaacuggauauggagggccaauuguauauuauaauuauuuuaucuauauauauccaucucucucucucucucucuauuauauauauauauauguauauauauauguagcuaccuaucugucuaccuuuauuucccaaguaaaaugacuaacucuuugaaaaagcuuaggaugcaaauuucagcagaaaaugucagcauaaaguuccgcuagcaggagcaacuguugaucuaguauaauugacagcauaugugcauagcugcuuucuugugucaggugguagcugcuuaacaaucauacaaugagaaauugagucauucaguaaagcaggacaaaaccaugccaucucauuuaaaauaaugccuuggaaaugaagaguaaaucuggauauugguauaaaguugauuuccgagguuguggcuagcuccagcaaccuaugauguuaucucuaacuuuggugucagauaacucuuuuccaaauuaucuucuuuuuaggcuguuaaauuccaaaaguuucaagccuuugacuggggaagcagugccaagaauuauuuucauuacaaccagguaaaguuuuuagucuuuucauuaaagggggcccugaaaacucaucaagaaagccagccuggccuaucaggauucuggccaggcucaggugcugugggaaauguuugcaggaguugacuaguguuuguuuuccaucaguccauucagaacaauccaagcuuuguagcugguguuguggacugggccuccucucuuuguccuuuccccagcucuaaauaagaaucaucacuguuaugcauuacucagaguaaucacgaacauagccuguagagucagacaguccuaugucuguuaucugguagcuauggggccuuggccagauuacauugcuuaagccucuucccugcacuaauaaaauuagcauuuuugagcaugcuaaaugcacugaagugugaggcacuuugcucuguuuuuuaaauuuaauucccagagcaucucugugauguaaacgugauuaucucugacuuaaacaugaggacagugaggcuuagagaauuucugugacuugucuuacacccaaagggaagaaguaggagggcaugaccccaaacucuuuccagccacuauugccuugaguguacuaccuauggaguacaacaccuuccuugccggggauuaaacauucauuuuggugcccagccuacggcagcagcuccacagcuaguggcgauuauaauuagcauucucucauuugggguuagauuucuuuuuuugugccgguaauggcaacuugaaaagauacucaaagagauuuuaaaaauuuagucuguuagucaaacuuacuagacaauguuuaauggagauugcgcuuauugugauuuugaaaauuaaaacaacaacaacaacgaggcuuucucugguuccuuuucauuguagaguuauccucccacauacaaugugaaggacaugcuugugccgacugcagucuggagcgggggucacgacuggcuugcagaugucuacgacgucaauaucuuacugacucagaucaccaacuugguguuccaugagagcauuccggaaugggagcaucuugacuucauuuggggccuggaugccccuuggaggcuuuauaauaaaauuauuaaucuaaugaggaaauaucagugaaagcuggacuugagcuguguaccaccaagucaaugauuaugucaugugaaaauguguuugcuucauuucuguaaaacacuuguuuuucuuucccaggucuuuuguuuuuuuauauccaagaaaaugauaacuuugaagaugcccaguucacucuaguuucaauuagaaacauacuagcuauuuuuucuuuaauuagggcuggaauaggaagccagugucucaaccauaguauugucucuuuaagucuuuuaaauaucacugauguguaaaaaggucauuauauccauucuguuuuuaaaauuuaaaauauauugacuuuuugcccuucauaggacaaaguaauauauguguuggaauuuuaaaauuguguugucauugguaaaucugucacugacuuaagcgagguauaaaaguacgcaguuuucauguccuugccuuaaagagcucucuagucuaacggucuuguaguuagagaucuaaaugacauuuuaucauguuuuccugcagcaggugcauagucaaauccagaaauaucacagcugugccaguaauaaggaugcuaacaauuaauuuuaucaaaccuaacugugacagcugugauuugacacguuuuaauugcucagguuaaaugaaauaguuuuccggcgucuucaaaaacaaauugcacugauaaaacaaaaacaaaaguauguuuuaaaugcuuugaagacugauacacucaaccaucuauauucaugagcucucaauuucauggcaggccauaguucuacuuaucugagaagcaaaucccuguggagacuauaccacuauuuuuucugagauuaauguacucuuggagcccgcuacugucguuauugaucacaucugugugaagccaaagccccgugguugcccaugagaaguguccuuguucauuuucacccaaaugaagugugaacgugauguuuucggaugcaaacucagcucagggauucauuuugugucuuaguuuuauaugcauccuuauuuuuaauacaccugcuucacgucccuauguugggaaguccauauuugucugcuuuucuugcagcaucauuuccuuacaauacuguccgguggacaaaaugacaauugauauguuuuucugauauaauuacuuuagcugcacuaacaguacaaugcuuguuaaugguuaauauaggcagggcgaauacuacuuuguaacuuuuaaagucuuaaacuuuucaauaaaauugagugagacuuauaggcccaa

SEQ ID NO: 192790 - RNA, 11423 nt, Homo sapiens
uuaguguaaguccaauguuuuauuuccuacaaaguuaacuaacauuuuuucucuacuacauagcacucauacaaaugauuucucuuucuuacaugcauacacacauucuguuucacuaauuguugaacacaacuaauauuuugucagauuuauuauucaagaauuacaucauuacagugaauuauaauguuucugaaaacaguaagcagaaaagaugauuaguaaauguuagcauaaaaugaaaugaaaugugaaaguggcugauaucugggugccuaaggaccuugucucacagaguucucaaagucagcagccagucucagggcccgcucauaguacuccagggcuucauucauauuuccuuccaauuuguagacgaacccaaggaggcucaagcuuuccagaucuaaugccuuucuccgaaguuuccuuaaaaccaauuucuucaaagaauugauacuuuuaucccuuguuaaugaugccuguucuauuuuuauagcuuuuaaauaauggauaauugcauugacgucagauuucuuuugaaauuccugaaaccgaccauaguggaaauguaugucuugcauuguuucuucuaccacugguuucaugcauaacaauuuuugaaaauucucuucagcuuuucugugauugccugcuucuauauacauucuugccaggucuagaugagccaccucaaaugugggcuuuuuuuccacugcagauucaaaaugaaauauggcugaucuuaucauuuugucuagcuuuucucuguucugcccucuaggcugcccuuuuguagccuccuugauuuggaucauuugugccuuguagcaaagcccuaucuggugaugcaguaagacagaaguggguguuuccugcaaggccuuuuuuaauaacucaagagcuuuauccacagagccuuuucuucgguaaaacuuggcugcauaucgaaagacauaggucugugaggacauguuggcuagagcuucuucaauguacuuuucuccuucagcuuccuguccuucauccugaagcuucagggcaaggagaaccuuaauauauccauugucuggauuuaagcggacagccugccuuaggggaagcaaagaaaauggcuugugauuuuuuguggcuaauuuaaagccauccaggcgauaggcagagaucgcauacccagcgcuggauucaggguuuucaggguccacuucaagcaccuuuucaaagcaggccuuggcccguucauaauuuuuuccuccacacuucagcaaggcccauccuuccucacagucuauuucuggacacuccauucuauagcggaagggauuugaaagcuucuugcaaauguucuccaccuuguccagguaagucugggcuucugccagucugcccaugugguaauacauccaggcaaaguugccccaggucaccagacuccucacauuugcuugguugucauguucuuccugcauuaaguuuucagcuucuuuuaagcucuucagggcuuccucauucuggccuuucagguguuucacauaggcuaguagguuguguauucccacacuguauuuggugucuaggaauucaaucugauccaagacucuguuuucuaaaucaggcauuucaucgucaucaauggauaacucccauguaaagugacaucucaauugcuccagacuauccuugaccugaugaucaucaccauuuguacuguaaaaacaaaaacagauuuucuuuguuaggugaggaacagcuaaaagaaaaaagucagauaaaauaccuuguauuuuagugcuuauccuugaaaggaucaacuuacuuagguuucauuaaaguuaauguauuuuuaaguuauucauggacuguugauauuguuugcuuggcuucauaugcuggcuagagcaauuuccagccaaguaacuauucuguacuuaugaguccuauuuguagaauggagauaaugauaguauuuaucacacuggguuuggugaggauuaauaaacuuauaugugucaagcacuuagagcauauuauaugcuauauaagaguuucuuauuuuaauauuaagauaauuaggacagaggucaguuagaaaugcagaaccuuaggaaacauugacuucaggaccuuacucugcauguaaugcaacaaauuaagaccacaugaaacagauaauauuugacccggguuuuuuuuuuuucauuuuuuuuuuacuuggaaauaauuacagauucacggaaaguugcaaagacaguacagagauccaguguauccuucacccacuuucuccaaugauuauaucuuacacaacuauaauacaguagcucaaaacuagaaaauugacauugguacaacaaugcuuuuguauagugcuaugucauuuuuuucacguaagccuaugagaccaccacuuugauaaagaaacgaaacuccucuucacuaccacaucucccucauauuaccccuuuauggucacaucugucaccuccucaccuguacuccccuaacccuugguaaccacuaauuuguucuucaucucuguaauuuugucauuucaagaaugucauauaggcugggugcgguggcucacaccuguaaucccagaacuuugggaggccgaggcagguggaucauuugaggucaggaguuugagaccagcugaccaacauggugaaauccugucucuacuaaaaauacaaaaaaaaaauuaggugggcaugguggugcaugccuguagucccagcuacuucggaggcugaggcaggagaaucgcuugagucugagaggcagagguugcagugagcugagaucgcgccacugcacucuggccuagguaacagagagaaacucagucucaaaaaaaaaaaaaaagucaucuaaauggagacuuucauauaaaaggauaguucaauauacaaaaauuaaucaauguaauauaccacauuaacagaaugaagggaauaaauacaugaccaucucaauugaugcaggaaaagcauuugacaaaauucaacacccuuuaugaaaaaaaaaacagacuauagacuacuaauacaggggaacuaucucagcacaauuaaagccauauaugaaaaaccuauagcuaguaucauauucaauggugaaaaagggaaagcuuuuccuccacgaucaggaaugagguaagaugcuccuuucaccacuucuauucaacaugguacuggaaauucuagucagagcaauuaggaaugaaaaagaaauacaagacauccaaguuggaaaggaagaaguaagauuaucucuguucacaaauggcauaauuuuauauguagaaaauucuaaggauucuacacauuaacaaauacauucagcaaaauugcaggauacaaaaucuacaugaaaaaucagucauauuucuauauaguaacaauuuaaaaaucccaaaaggaaauuaagaaaacaaucccauuuacaaaaauagcaucaaaaagaauauaauauuuagcaauaaacuuaaccuaggaggcaaaagacuuguacacuggaaacuauaagacugcugaaagaaauuaaagaagcaauaaauaaauggaaggacauccuuuguucguggauuagaagacauaauauuaagaugucaauacuacccaaagugaucuacaaauucaaugcaauccuaauaaaaaucccaaugacauuuuuugcagaaauagaaaaauucaaccuaaaauucauaugaaaugucaagggaucucaaauagucaaagcaaucuugaaaaagaagaacaaaguuggaugucucacacauucugauuucaaaacuuacuacacagcuacaguaaucacaauauuacaacaaugguauaaagacagauguauagaccagugaaauagaauagaaagcccugaaaaaaacccuuacuuaucugacuguauuaguuagcucagaaugucauaacucaauauaacagagugggugucuuaaacaacagaaauuuauuuucuuacaguucucgaggcuagaaguccuagaugaaggugacaaccaauuugguuccuggcaaggaauuucuuccuggauugcagauggcuccuucuugcugcauccuuaaguggccuuuccucaguggcacagagagagagagagugagcuuuggugucuaaggacaccagcucuguuggauuaaggccucacucuuacgauuuuauuuaaccuuuauuaccucuuuuuagacucuaucuccaaacaacaguucaacauaagaggguuaaggcuucaacuuaagaauuuugggcaggggugggugggaagugcacaauucauuccauaacaaugguggaaugauuuucaauaagaaugacaagaccaucuaauggggaaaggauggucuuuucaacaaaugugugggaaagcuggauauaugaugaaaaaggguaaaguuggacccuuacuuuaugccauauacaaaaauuaacucaaaauggaugaaagaccuaaauguaagcccuaaaauuauaaaacucagaagaaaggaaaaagcuuuguaacauuggauuuggcaauuggcagugauucauuagauaugauaccaaaaucacaggcaauaacaguaaaaauaauuaagcuggacuccaccaaaauuaaaaacuuuuaugcauggaaggauacuaucaacagagugauaagacaaaucacagaaugaaggaaaauauuugcaaaucuuguaccugauaggggauuaauauacagaauagauaaagaaccucuacaacucagcaacaaaaaacaaacaacugauuaagaaaugggcaaaggacuuaaauagacauuucccaaaagaaaauauacaaauggccaauaaacauaugcaaagaugcucaauaucacuaaucauuagugaaaugcaaauaaaaaccacaaugagauaccacuucaugucuguuagguuggcuauuauuuuaaaaaaaaagcaggauauaacaauuauuggugagaaucuagagaaaugugcacugcuaguaggaauguaaaagggggcaagugcugugaaaaaugguaugguaauuccucagaaaaauuaaccauagaauuaccauuugauccagcaauuccacuuuugguuuuauacccaaaaagaagugaaagcagagacucaagcagauuauuuauuuguccauauucauagcagcauuauucacauagcaaaagguaggagcaacuuaaguguccauugauggaugaauggauaaacaaaaugugguauauacauacaauggaauauucagccuuaaaaaagaaaagacauucugauacauguuacaacauggauaaacuuugaagguauuauguuaagugaaauaagccagucacaaaaggacaauauuguaugauucaauuuauauaagcuaccuagaguaggcacauucauaaagacagaaaguaaaauagugauuaacagggacuagggugccgggucugucccacagacccuggcugauggaugaaaugaguacucagacacagguaugcaauguaagagcagcuaggugacugccuggcucuaguggccagagaacauccccgagaagcuggagcugcuuacuuuuauucagugcaggcacaaugccgaaaaccuggagccaacacaaccuguagggaauuaacauuuauuguuccccuuucagggaacaucacgcauguggaugaucaaaggucaguuccuggucaacauaaauaaacaagccuguuuaagauacauucccccacacucccuuguaccuacuccuugcccucugccucagaguuauagaacagcugccuucagcuguucucccccagggcucugcagaaccuucugaccuuucagaaggcuugcauucuuucccuauaguuuuucccgucacucugacugauccuccacacugggggaggagggaauaggaaaugauuguuuaaugaguacagaauuucaguuuaggaagaugaaaaauuucuggagauggaugguggucaugguugcacaauaaagugaauguauuuaaugucauagaacuguacacuuaaaaaugguuaaaaugguggauuuuauguuauauauguuuuaccauaauaaaacaauuugugauuuauuuauggcaaagguacuccaaacaaaguaaauagaaaaauaacaaaaacguggaaaauguuuguaauacagagaagacucucaucuguaauauacaaaguguuuuuguaaauugguauaguucaacagaccacuggaaaucuaugugaauagauaauuuguagaaaagccaauauaaauggccaauaaauaugaaaaaaaaugcucuggaucaagacaaugacucaugccuauaaucuuagcacuuugggaggccaaggcaggagauuugcuugaggccagaaguuuaagaucagucugggcaacauaguaagacccugucucuauaaaaagaaaaaagaugcccuaagccucuagccauuagagaaaugcaaauuaaagaagcaauaauuuauaacuuuauuccacucagauuggcaagaguuuaaauggaugaggacacaauuucugaagccauguauuauuauggccuucaagaucaaucugaugacagccaugaaaauugauaguaauuaaaauuaaaauuuuaauuuuaaaaucaaaauuaaaauuaaugguggucauuaaaauuacauuuccuucaacaaaguaauuccacuccucagaaucuaucucccagaaaaaaauaaccaguacauaaggauguauacucaagaauauucauuaccaacacuguauauauuagcaacaaacuggaaauauuaauagggaacgguuaaauaaagguauaucuauaccauagaauauuauguagccacuagacuacaugaauuagaucaaaacuacuugaguuugauggacuuucauauauaucaagaaaagugaauuguaaagaaguguccaaaacacgacccuauuuuauaaagaaccaaauccuuauauauuuguauguaugugauuacucauguauggagaaauauauguaaguauauuuacagcucaucaacaaaaagauaagcaacccaauuuaaaaaugggcaaaggacuugaguagacaauucuccaaagaagaaucacaaaggacuagcaaacacaugaaaagaugcucaacaucauuagcuacuagaaaaaugcuaaccaaaaccaugagcuaucacuucucacccaguaaguuggcuacaauaauaauuuuagaaaaggagaauaggugaacaaguauugacaagugcuaugguuuggauacaguuugauuguccccaccaaaucuacggaaauuugaucucuagugucacaauuuuggagguagggucuagugggauguguuuggaucauagagguaggucucucgugaaugaccuggugccauucuaguaguagugagugaauucucauucuugugagacuggauugguucuugggggaauggauuaauccuuugagaauggguuguuauaaugugaggaugcccccuggguuuagacccucuuuguaugugcuuccccuuugaccuucuccaguguguuuugacacagcaccaaagcccucaccagaagcugagaagaugccagcaccauacuucuuguaugggcugcggaacugugagcuaaauaaaccuuuuuucuuuagaaauugcccagccuuagaaauuguugcuuauucuucuauagcaacacaaaaaggacuaaggcaauaaggauguggagaaauugaaacccucauacauugcuggugggaauguaaaaugaugcagcugcuguggaaaacaauguggugguuccucaauaaguuaaacauaauauuaccauaugacacauuccuggguauacauuccuggauguuccacaucuggauauauacuuaagauacuuaaaaacagguguucaaauaaaaacuugcacacagauguugauagcagcacuauucauaauggccaaaaaauggaaacaacccaaauguucaccaacugauagauaaaaaaauguaauauauccauaaaguggaauauuauguagccauaaaaaggaaugaaguacugauacaugacacaacauggauaaaccuugacaacacuacacuaaaugaaaaaaacugauccaaaaggucacuguuguauuuuuuuuuuuccuaauuuugucuugaggucucuccugugagaguggcuacaaucuacagcccugccuugaaagagcuucaggguauuuggucauggauauuuacaaugugccuuucuugggauacuucuuuauuuugaugaacagccuaaugccuaagcgucugaucuaugucuagguguccccuuuuauaggaaacuuguuuauaucaggcagaugcccuugugguucuugccugaccuguguuuaguuuauuucuacugagacagccacucucucggaaagccaugaccaguaaagaagaguuugaguguguuggucaggugaaauacaaaggaggcaauugaaaaaaauaguaugugaaauaacagaagcagcuuauuacuuacagauccagagagaagaggguaauaugccuugcagggccaaugggaaagggggagccauugaggacaugccugcucaaccagcgaguggggaaugugggcccaagccuuuaugggaggccagggcguuaccuagguggguuuccuguggagaguucuauuugguggguuuagagcaagcaggugcaauuuugccaaggggucaugcugugacugagagguggucacugcagcacaucugccugguccaugugggguggggguggggucagugggggcaagucaaauaggucauacccugcuaugcuauagggaaguggucaccaggagguaguuauauaaagcagauaucuggaucaaucacauugaggaacuggaaaaagguggagaacuagaaauugucucaagggugacugagcccugcuucuggaaugagaaaguccaacuuaauauucaaaaagggaugcuuaggaaauauaaaauuauaaaaauucaauauaaccacauaguauguguuuccauuuauaugaaauacccacaauaggcaaauccauagagacagaaagcagauuaacaguugcuggggccuggggaaagaggcaaguagggagugacugcuuaauggcuaugcaguuucuccacauagcgagaaaaauguucuugaacuagauagugaugaugauugcacaguaguaucaugaauauacuaaauacuacuaaauuguauacuuuaaaguaauuaaaaugauaaauuuuauuuuacauguauuuuaucacaauaaaaaaucacauugcuaaccugaauaaaauucaaguuuuauauauauauauauauauauauauauauauauauauauauauauauauauuuuccuguaguacauauugacauaaacauaaaagcaggaaaacauaaaagcaaaugaguuugccaucugaaauaaucacaugagcccccacugacacccuuugggaaacauugauuuaaagguuuaaugaaauaucauugaauguagagauccugauccauaucucaaagcuaccacuuauugucugugugaucuuaacauuucuaaaucuaagauuccuuauuguaaaaucaggaucauacagccaugcacugcauaaugauauuuuaguccacaaaggaccacauauuugguggugguccuauaagauuuuaaugccacaauuuugcuguacucuauguuuaaauauguuuagauaaacaaauacuugccauuguauugcaguugccuacaguauucaguacaguaacaugcugcacagguuuauagccuagguguguaguaggcuauaccgucuagguuugauguuugcauaaugaugaaauugccuaacagcugcauuucucagaguguauccccauuguuacacgaugcaugacuguguaaguaccugccuuauaaguaucuuuugagaauuaaauggaauaauuuacauaacacuuuuagaagccaggcugucacuuaauacgaauucaagaagugauaacuaccuuuauaacauuuaauauuauuauuauuuuaauuaucaguaccaacuccaucuguuuacagaggaggguucaucauaggccuguaaugugcauuuucuggaauuuuuaccucuucaaaauuuugccaacuggagcacugaggggaaaauuuacaaaucaguauuaaguaauggauuuuuuguuuguuuguuuguuuuugagacggagucucgcucuguugcccaggcuggagugcagugguacaaucucagcucacugcaacuuacgccucccagguucaagugauucuccugccucagccucccaaguagcugggacuacaggcaugugccaccaugcccaaauuuuuguauuuuuaguagagaugggguuucaccauguuggccaggaugggcuccaacuccugaccucaggcgaucugcucaccuuggccucccaaagugcugggauuacaagcaugagcccccuugcccggccuaaguaaugguuuuuaaaucagcugagaaauucccacauuaggcccuuuagguaaggaagauacggaucuucccaagcagauguggaucaucuucagucaaggacguaccaagagccuagauuuuccagggaggaggcaaucuguuuaucuuaagcucagccugauugcgaaaaccuguuguaagaggccagcagugcagaaagugagaccagaagccuauggaggaaggcugugagcuuuuccuaccacaucuccacuguauuacccacaagacaucagagaggcugcaagacugaggcuuucacauucuuguggguccugcuuuuucucugugguaaagaaccugcagaaagcaaugccucuacucagacaagcuguccauuccuuccccauaucagacagaagugaaucugaugggaaagaaucucucagauugggaucauuuucucccuuccugcaaaacucuuuucccauuucccuccccuucuuugggcuauagcaugagguaagcuuccucaaguucaugcuaacaaacauaaaaaugcauuaaacaauuuauguaugugugaacgugcacacacaugcaugcacacauucaguccauaagcagauacucaaaucgaggaauuagaaaaccugaccucacugagaucuaaccuguugaaauaguauuuaauuaccauuuuuucaaaaacuuuagacauuauggcagaggagcaaagaaauccuuaccucaugguugcuguaaauuaggcagccguucugcaggguuuugcuuagccaggcuccucugagaucuggcuauucugucuuguggauuuucaguuacguuuaaaccccaagacaguguuauauaagggagcuaaacagcagccaaugguguaa

SEQ ID NO: 192791 - RNA, 73334 nt, Homo sapiens
gacaaagacugcauguucucauuuauuuaugggaucuaaaaauaaaaucaauugaccucaugggcauacagaguagaagaaugguuaccaguggcugguaaggguacugacgguugcagggggagguggggaugguuaauggguacaaaaacaaauaagauaaaaagaaugaucuacuaucugauagcacaauagagugacuauaaucaauaauaacuuacuuguauauuuuuaaaugaucuaaagaauguaauuggauuaucuguaauucaaaggaaaaaugcuugaggggauggauaccucauucuccaugauacacguauuucacauugcaugccugugucaaaacaucucacauaccccguaaauauauacauguacuauguacccacaaaauguuuacaaaauaagugagacauucuaauuaaagacuugagaucuuuucuaaauaauguauauacauguuuugugaucuguacacacuuauucuccaaauccuagcuauaauccaaacagauauguaaaaucaguuguauaacagauaaaguaaaaaaaauucauaagacauuguuaaauauaaguaaaccaaauaccugaccuauuacauccuguauagcaaaauaaaugagaauaacagccucuuuccuaggaucuucacugauccaaugucugagauaauagggaaauacaguuugaaagaagcuauuauaaaaaagccuuauaaaaauauacaaauuuugacucauuuauugaauuaaaauuauacuauguauaaaacagcaaucuauaugcagagugauuuaaugcauaauauauacauuuauauuuacaauacaggaugcaaguuccaaugacuaugacuauaaaauuuauauuaaacauuuccauaagugauuuauuuggcuguuuuuguucgaagucgucguuugauaaucuggugaucacucuccuucauuuucugguccauuaaaaucugaaauuaaaaauuucauaguuuuucaaagcuuguaagugaaaauaaaaauaaaagcuuguuuauaaugaguaagacauguucaugugcuuaguaacugaaaugauacauuggagaauuuuuuuuacuuagacuacagauaugccaucuucuauaaaaauuuauuuaaaaaacagacuuuguaaaagauucaacacuaucaaauucuagaaguaaaauaaccuagacuccauauugaauucaaggcagauauaacuuaaaauaauuacuaaaauauuuggagacaagugccucaaauaauuuuuaagaaaugaucuuucguggcaacaaauguauaacuuagaaaguagaaagcacauuauauaguaacuaagaaaacaauuuucagccaagggaagaaaucagguacuaaucaaacagaugcucaaaaaugacugacagaaugguacuuacaacaccaugcccuaauuuacccuaacucuuuacaucuugcauucaagugucaaucucauaucugaaagcucuuguggcaaaaaagguuucuccugauuuuucuuggccacuucuuuuuaauuuuuuuaauuucuuuuaauuauuuuuuuaccuucacuuucauccacuaagcaaaugcaagcaugacagaaaauuugagcuuucccugugacagcacauacuguucugaaucaggagaaugaaucauagacucagggugauaacuacagucucuuccuaauagauccucaaaggcuuaggggaaaggugggaggaaauggcugaaugucaguuuuauauuuuuaccaggaacacuugggcccagauuuguacaacucccgugauuuaaaaaagagaaagaaaaagaaaaaaagauuguggaggcaaauaaguuacuaaauagugacaauucuauuauuggaaauaaauuccucugaugcauuuucaaaugcaaaugcaugacgcuuauauacauuuaauacaguauuuauauuuaauuaguauaaacuuaacacaugugagacuaaaagcaugaccuuuauagcauguguuuucagagaucuaaagaauugaaauucaaaccacuguaaaaaauuaaaaagaacacgaacaguucuacauugaugaaaacagaaauacuagcuuaccacuuggccugauauaucaauaggagaugaaauuucacuuguguauaauuuccguuuggcucguuuugguugagacacauuuucuuuacuugcuucuacauuugagagcuuugaagagcucauuguuucaauuaucuucuuugcuauaaaauaaaauuguuaauuaguuccugaaauaauuuucuaauugcaaaggugauuugaaauccuuaauaaagaugguuugaaauccuuaauaaagaaugaacauacacaaacuaaaaacacugcaauauauauauggugaaagggcaugaauagacaaaucacaaagaaaaaaaguaaaugucaagagaacaugaaauaaugaucgacagcaaaaaaaaagcaaauaaaguaucauuugauuaauguucaauguaguaaaaaaccucaggcaucuuuaaugacuuggaaaauguuuaugcuauguuaagcaaaagagcaggauauauacauaguggaucaugcagcauuaaaaauaaggugguagaugaucuaguucaaugcucaugcauaaaguuaugcacaaugaaugcugcaugaaaauacuuuguaaacccuuuacuucaaguccacacacaaauggagagaaaccaaacuguuaacagcugauugcuuuuagggaaguagaauaggaauuuuuaaauuccuuacuauguacauaguacauaguacuuuuuuuuaauagaaaacauauuuccaugugggaaaauuccuggauagaaauucacacacaugugauaucaaauauuuuuuuuuaaauagaaaaaacauuuaaggcauuagacuaaauugagaagacuacuuguuaagggcugagcugggcuugagagagcugagaguccagguaucggagaagccaguuaagacaacaagccaaaaugaaaguaacaacccagcuuuuuaaccacuuauuucaacaguauaugcgagagacuaaaccugagaaagcaccagcuccuacccacccucuucuauaguccaccacagaauaauacagaucagcauagaagugguggucauuuuaccacccaggcagccccaaacaaaaggcucucgcaguuuuauagaccucagggcuggagguuggagggagcuauacguggaaaaguaccgaguuacaguggagaaaagcgucuucaagguucccccuccuguuccccuccauaagaaggccuccaccaaaggccucaauaaagaggcucugaauggaggcacucaggcuaaauaugcaaauaugaguaagagcaugacuagcuugggggaugcuggauccuugacuauaacucccuuaagagauuauaaugcauuggcuaugcaucaagucugguguaggaagggaagcuugucagguaagucuuuguaauugccuaugguacagccuaaaaaaaauagaaauguuuaaaaaucauacauauguuggccuagagccaaacucaucacuacuaugugcuagccacuauacuaagagcugacaguaugaacuagacagacauuuuguccgugcagauuauauucuaguguaaaagauaauaagaaagcaaagaauuacaguuuaaaaagugcuaagacaaaaaauaggauugaauaauaaagauuaagugaugcuggggaugagggguagugacagggugaugaaggaaggugucucccuaauaacguuccaucagcuaugagggcucaaggguaaggggccagcuaagacaaaagccaggguguguuccagauaaaagaaagcacaggaaaaagcaaaagaaaucaaugauaugaagguaagaaagaagcuggcaaauucuaggaacugucagaaguuagcaggauugaagcuggcuaguuaucaaaccguagaauaauaagagauagauuggagagagucagaaaucaggucauucagaagaaugagaaaucauuaaaggaucagaggaguaacauaauucaaucugcacuuugaaaagaacauucugucauguaugaauggaugggagaugacaagaggggcaagcugggagaccagugauacuaagugauggauuaacagugguuaucagagcagcagaauuuuaaaaauuaaucuccauuuuuucuuuucucucuauauuuccaagugacccaaaacaacaaauauguauuacaguuacaguucaaaauagggauaucuuauauuucuagaaauaaguaaaaacaaaaagaaaaaaggaaaaaaaaaauguaugucaagugcauugguagggaagcuguuaaggaaccaagucaaugaaguaagagaaucauuacccuuaucugauuacauacuuauuauagguaccuaccucuccuugaaaauauauuucuuuuuaauauaaaagugguaguaagccuaaaggacucuaaagaaagaugucccuccucuccaaauuuagauauuuaacaguuugcuguuugucccuccagauauuuucuguuuauacaaacacauuuuuuaaauguacauauuuuuuuaaauguauguaaauauacaaaugggucugauaggucagaaguucccaaacuguguacuaaggcaugcugcagcaaacuuacagaagcaccucaggauauuuucaaucuucagggaaaauagugaugcucaauagcccaagguaguucaauuucaaaacgauacugaauuacauuucuuuucauuaugacauuaucuuugcaaucuggauuuucagaagcugaauuuucagugguuguuuggucuuaaguucuaaugcaugagacuacuagugguucuuugggugcagaggcaaaauggaaauuaauuacugagacauuaagggcacugugaaccaacaaaguuuggaaacgucugugguaagccuucgacaaaaaguauuuucacacaacauauuugauucaauuuaacugcccccugcuucuaguuccuuuccuucccuauaccccucacucuggucucuaauucauccuauugcugucauucagguaaccucacaaaaacccacuacuccaucucaccccuaagauaguccuuccacauucuacaugccagauguguauugcugccuguaauugcaugaacauuuccuacauuuuucugauacuccaccuguguuaaaaccauuccuuccgcauaugugcacacauguguauauaucuuaacauauacacagguaucaauauguccacauuauauuaucaagaaaaaaagcacuaagcauacuguuucugcagcuaaacucaauagguauuuaugaaaauaauguguuuuugacauauuguacauaaacagauaauguuuacauaugcacagaaaaaaaaacacuaggaggauauauaccauaauacuaauacuggcaaacuuguccaacccaccuuauuuuguuguuguuuuuguucuguuuuguuuuguuuuguuuuguuuuaggcuuuuagcggccugaagccaugguuuuuaguuucugucucuagugauaagcagaaaacagggaugaggaaggggauuuccugccccaaccaaaaacagaaacuaagaacccaugacuguauucucacccuuggacacccuagagaguguacuccugcccacauuucaauacacaggauaaaucccaucucucccauaaaaaccuucccaaagcccccuaaucagaguagcucuuuucccuccaauacuaucauaccuuugcuuauaccccuauuacuauauuaaguagccugcucuggaucaguuacuuaaauacaagccuuucucuucuacuacauagcgaacaccuagaucuaucauccuuuuacauguuucuucccacaguaccuaguauaggacaaugccuauuugaaguauaauauucccugaacagcuguugaguuuauauaucaauuagguauuaaaauauacccaacaucuaacaaaaaaaggucauuuaauuaauuuucugcaaaccuuuugauugaagaauugagggagaauguuguaagaagucuccaaauuucuguaguguuccuucuuuuuucuuaguggccagguuuacaccaauuauggaugccugacuccguaaagaauauguuuucuuagaugauggacguauggcaaccuaauaaacaaaacauuuuuuguuauuguugaugagaaguguuagaaggaaauaguuauggccacagcugaauuaaagaggccagagacagguuaugaauucucagguaggaaacuuuaaguauguaaggacagggauaaaagggucagacaauggcaaaaagaguuugacaggcagaguguuaaagucagaaguaaacacauaaaguagaugcuacuggccaaaugcuaaagguuacauuucaacugaaucagauguauaggaaagagaagauaaaugaguuauaauugaacacaacuggauuucuggauaauugcuacaauuuuggacaaauuaaaagacacaccuuuuguuccuuuuugacagaagaauuucuaucaucugaaauaggaaauuucaaauuaguucuggguguagcauucuucuuauuuucacauuucaccaaguccuaaaaauaaugaauuuuagcaccaguuaauuucuugacaauauuuuauuucucuagacucaaaaaagaaaauuuguaaaaagcuacauuaucacuuaaaacagugacucuuaaccgagggcaauuuugaacucagaggacaauggcaauguuugaagauauuuuugguugucuuugccagggagaaggggauauuauuggccacgaguggguagaggucaggaaugcuguuaaacaucccuacaaugcacaggauagauagcccuuaaaacaaagagguauacagcccacaaugucaacugugcuggaguugagaaacccugacugaaggugugaauuuuucaaacauaucacaaguaaugaaauuacauaagcuaaaugaaaaacauggaaggaauaucuuuuauuugaaacugagcuuuaaaauacagcauacaauauaccuaccuauugccuaacucccaaauaauacaagcaucuaugucuaaguucucucauugacauuugacaauaucaaaaauaaaauaaaaacgaaacuucaaauaaccaaagguaaaauguuaaaacuuuuaaaauauuaucuuucuucucuacaacauggguauggcaucuuacucuucuuuuccccaaauaaccucacauaggacaaagcccuuuacagauauacucacugacuugaacugcugcaaauccuaguuguaccaaagauaaaaguucaggaaaaagggggcaagaagagaagcagagaaaagaucaugacugaaccucagaauccaaauuacaaagcagaaguuauaagggucauaagaagcagacaccaugacagggaaaagacagaugguaaucauaggaugccagugaaaagagaccaugaggcuaccuccacacauaguggucaguaaggagcucuuuggagucuucacuggauuagaauauagccugucgggggguggggggcuaggggagggauagcauuaggagaaauaccuaauguaggugacagacugaugggugcagcaaaccaccauagcauguguauaccuauguaacaaaacugcacauucugcacacauaccacagaacuuaguaauuaaaaaaaaaaaaaagaguauguggaagaaaaaaagaaaauaggauugcauaaaugauuuucaugggggcccauguacuuaguuuauuauagcagugaagauugaguaaaaucaguuagaaaauuuaaaguuucuacaugauguaucuacaacaaucuguaaaucuuuucugaaauauacaugagggauauaugccaauaguaaaauuaauaaaauauuuauauuuuaaccuucuugagaacuacacucgguguuuccuucuucguugaaaaaaaauggaucaagaaaaagccaacuagaugaugaaacucaguguuuuaauguuauuuuaaaaaauuaaauaaauauaaaacaaaaguuaacuaguaagacuccauaaaacaaucucuaaagguguuacauguguagcagaaaaacuaugcugaauaauauucacucagcaaaauuauuaccugacagagagccucaggaguauaguuaauacuauuucugcucuuacaucagcuugaaaauauacuacucuucaaagaaguaaaagaaaguugaagaaaaauuauuuugcuagagaguuuguaauuaguuuuaagcuuaaaacaaguuacuuuaaaaauaaguauuacugauacccuuucucccaguugacugcaucggcuccugaggcuucugcauucuucacguaguucuugagccuuggcuuucagcuccaucagauccuuuaagcacuucucuguauugguuuuucuaguuauacauuagucuaaauuuuuuucaaaguuuucaacuucuuugccuuugguuugaauuuccuccuguagcucggaguaguuugaucgucugaagccuucuucucucaauuugucaaagucauucuccuuccagcuuuguuccauugcuggugaggaacugcauuccuuuggaggaggagaggcgcucugcuuuuuagaugaaaugaaugaaaugaagcgagaagggaaguuuagagaaaaaagaauaaaaagaaacaaacaaagccucugagaaauaugggacuaugugaaaagaccaaaucuaugucugauugguguaccugaaagugacggggagaauggaaccaaguuggaaaacauucugcaggauauuauccaggagaacuuccucaaucuagcaaggcaggccaacauucagauucaggaaauacagagaacgccacaaagauacuccucgagaagagcaacuccaagacacauaauugucagauucagcaaagucaaaaugaaggaaaaaauguuaaggggagccaaagagaaaggucggguuacccacaaagggaagcccaucagacuaacagcggaucucucggcagaaacucuacaagccagaagagagugggggccaauauucaacauucuuaaagaaaagaauuuucaacccaaaauuucauauccagccaaacuaagcuucauaagugaaggagaaauaaaauacuuaacagacguuauuucugagggcuguguucuguuccauugaucuauaucucuguuuugguaccaguaccaugcuguuuugguuacuguagccuuguaguauaguuaagucagguagcgugaugccuccagcuuuguucuuuuggcuuaggauugacuuggcgaugcgggcucuuuuuugguuccauaugaacuuuaaaguaguuuuuuccaauucugugaagaaagucauugguagcuugauggggauggcauugaaucuauaaauuagcuugggcaguauggccauuuucacgauauugauucuuccuacacaugagcauggaauguucuuccauuuguuuguauccacuuuuauuucauugagcagugguuuguaguucuucuugaagagguccuucaagucccuuguaaguuggauuccuagguauuuuauucucuuugaagcaauugcgaaugggaguucacucaugauuuggcuguuugucuguuauugguguauaagaaugcuugugaaauaacgccgcauaucuacaacuaucugaucuuugacaaaccugagaaaagcaauggggaaaggauucccuauuuaauaaauggugcugggaaaacuggcuagccauauguagaaagcugaaacuggaucccuuccuuacaccuuauacaaaaaucaauucaagauggauuaaagacuuaaacguuagaccuaaaaccauaaaaacccuagaagaaaaccugggcauuaccauucaggacauaggcaugggcaaggacuucaugucuaaaacaccaaaagcaauggcaacaaaagccaaaauugacaaaugggaucuaauuaaacuaaagagcuucugcacagcaaaagaaacuaccaucagagugaauaggugaccuacaaaaugggagaaaauuuucgcaaccuacucaucugacaaagggcuaauauccagaaucuacaaugaacucaaacaaauuuacaagaaaaaaacaaacaaccccaucaaaaagugggcgaaggacaugaacagacacuucucaaaagaagacauuuaugcagccaaaaaacacaugaaaaaaugcucaucaucacuggccaucagagaaaugcaaaucaaaaccacagugagauaccaucucacaccaguuagaauggccaucauuaaaaagucagggaacaacaggugcuggagaggauguggagaaauaggaacacuuuuacacuguuggugggacuguaaacuaguucaaccaucguggaagucaguguggcgauucccagggaucuagaacuagaaauaccauuugacucagcuaucccauuacuggguauauacccaaaggacuguaaaucaugcugcuauaaagacacaugcacacauauguuuauuguggcacuauucacaauagcaaagacuuggaaccaauccaaauguccaacaaugauagacuggauuaagaaaauguggcacauauacaccauggaauaccaugcagccauaaaaaaugaugaguucauguccuuuguagggacauggaugaaauuggaaaucaucauucucaguaaacuaucacaaggacaaaaaaccaaacaccgcauguucucacucauaggugggaauugaacaaugggaacacauggacacaggaaggggaacaucacacucuggggacuguugugggguggggggaggggggagggauggcauuaggagauauaccuaaugcuaaaugacaaguugaugggugcagcacaccagcauggcacauauauacauauguaacuaaacugcacauugugcacauguacccuaaaacuuaaaguauaauaauaaauaaauaaauaaauaaaaauauauaaauaaauaauacuauuaauaaauauuaauaguaacuauuaauaaauaguaauaauaguuauauuaauaaauguaacugccacuugcagagcaaaagcgaagcauuuucaacacauuaauccauuguuccaaaaaggagaaaacaggaucagaaaccucaucugacuugccaaaucuccacaucuaggacaugguagguuuggcaacccuucaaucaagaaacugcaguaagaagagguuaauagcuuuuagccuaccacuacauagaggcccaaauuuuaacacuggcugaugaaaaaagaauuucucuuuuaaaacuugcuaggaccauacagacaagauuuuaguuaaaugacaaagauuauacacaagcaaguuagcuauuucaguuucucugauuucuacauaacccucuuuucucuuccaauacagggaaagugacuaaguaugaacaggacugguauacugaaauggcucuccaguaaaauccaccaucauuugauguauuauaguuuaacugaagcaaggacgcuauaucuuuuaauauacauagcuuuuuaucugaagaccauuaaaccacaguaauauucuuuauuuuucugagacagucucgcucuaucacccaggcuggagugcaguggugccaucucaucucauugcaaccuccacuuccuggguucaaguuguucuccugccucagccuccugaguagcugagauuagaggugugcaccaccacuccuggcuaauuuuuguauuuuuaguagagacggguuuuaccauguugaccagguuggucuugaauucgugaccucaagugauccgccagccccagccucccaaagugcugggauuacaggcaugagucaccacgccuggcccacagugauauccuuaaaggguauaaaauauagcauaaauugugauuuuggucucuaacagcagugccuaugaacaggagggcaauauagcaguuuaacucuauacuauaacagcuuuauaauaagauuuguucauuaaauuuacucaucacuuaaguauuuaccuccuccauuucauuacucuuccucuuccgagccuugggaaucuuaacugucacuggugugguacaaccaggguguuucacugccauuuuguuuggcuguaaagguguaaauugaaucucuaacucagguuuuggaaaucgagugcuuugaucauuuucuguugacacuucacaagagucaaggacuacagauccauccuacaacagaauguaaaaggaaaaauauuauuuguagaguauacauuuauaaaccacaaagaauuaauucucucaaaugccuauccaagacaaugcauugggaaagacaaaaagcgugcuagaucacagcaagaacagaaagauugagcaaucaucuacuuucuucaggcucacacaugguauguuaaaauuagggguaacaucgcuauuucccaaacuuguaugaucauaagaauuacuuacagaauuuguuuaaaagacuccuggacucuaccacaaacccaguaaaucagaaaucuccaagggaggaggcugagaucuuugacaaacagccugguuauauuaaagaaguaggcugcaaauacuuugcuacucuucccauugagagauggagucucucauuccccucuauuugaauuugggccuuauagccaauaggaugugguagaaauaacauuaugguccucuaaggcucaaucauaagaagcauuacaacuucuguccuguccucuuagaacacuuucaggacacucacccucaaaaugccccaucucagaccagcuaccaugccaugagagguccaauccacagggagagaccacaaauuaaguccaguggaauucccagaaucaacuaccaguuaacugaauuaaucauuuuggacuuucagcccaguuaaguauaucgauuacaugaaggcaagaacauacaaaauagccuaacaauaugauuccccaaauuguggaauauaaaauaacugcuggaauuagaaaauuggaaccaggagguuuuaggacaacauacauaaauuuauggagaaagaaauguuccauuauauguguuuguccaugcaaucaagaauuaagccuuguuuauggauaaacuucaaacuuuucugugaaauuuaugauuuguauuaguccccaagguuagugcuaauuauuugaaacuacuaagaacugucaaggaaaaaccaagagaaaaugaauggcucauguuauuuucccagauuaaaauguccuucucaguuggccaugguggcacaugccuguagucccagcuacucaggaggcugaggcaggaggacugcuugagccugggaguucaaguucagcugccagagaaacauagugaaaccccauuucuuuuuuuuuuuuuuaagacuuuuccuucucauugucugcuuaauaagcuuccauucauaagauacaauaugguaucaccuucuuuaauccauuuccacaaacacucaggcaaaauucauuucaucuuccucaguguuccuuggaguacucacuuuauauuucuacuauaacacuuagcccaugaaguaaaaucaaacaagucauucacuuauguaucuaccuuacuagauucuucacuccuugaggaugacaaucaugucuuauugauguucguauccucagugcuuaaaaagguucccaacucugaaugcucccaauaaauguguuuuaaaaagaaauuuaaaaaguaauuuuaucuucaaaaauuuuaaguaacauagaauuuuuaucuauuucauauccaaccuaagaaucucuauauuauccaaaguuauucacagaacccuaagcccaauacaaauuaaggaaacucacgaguuguuauugaagacuggugacaaagcuacuaaauggauacaauuccaaaaaauacuauuuaacacaauguuuauuaaagcaaccuuuuaugagagcaaauuaucccuauuuucucauuaguaggauuuccuauuucugaccaucaaguuuguuucuauuaacaaaucuacugcuuuuaagaugagauuaacaucauuugggcauauaaucucccaaaagaauuucaccucuccucaaaagccucuaguuucuuucacacagcccagagcacacacagcuaauugugcaguaagguaucuucagcaacuuacuuguacguguuauuuaguaauaguggauaaagagaauaaauaaguggacugugcugccaaauacccaccucuauuuuauuucuggaaauuucaaaacuugucgauagagguucaguuugaaguuugucaggaucugcugaacuaauacguuugggcuugauauccaugauuuguguuuccuaaaguaaggaaauauuaaagcaacagggcauuguaaccugaaaauauauugaagaaaacuucacauaaagaauauaaaaucaagauuuguaugaaacuaaacaauggaaauuacuaaguaaagacaccuuuaauuaccaccuagcccuccuauuucucuuucaaccucagauacucaggaaaggcugggucacuuuccaguuuauugacucugaucuaaggagaaauuugaaagacugcuugcaacuuccaaguguucugcccacauucucuugcuuuacuuucaucgcaacucugcagguaggucuggcaaaaaucauuauuccuacuuuccagaugaggaaauagagaacgacacacguuaaauggcauggucaaggucuguacugaguuagaauugcucaguaucccaacaguugcuuuugauaacacaauuuugaaaaacuggaggcuucucaggaaugcaacuauagcauuacaguacaaaagaccauaaggaaaacuaaaucuuuucuugcagcacauucuuccuccuauuuucucagucauaaaguucuauuucuaaacucuacuuaggcgauuuauaaagaaauagauuacauuuuuaaacuuaauaaacuguaacacagaccuccucaucacagccaucaaaaucaaaagucaaguaaaccucuuaugucaccuccccauuacugccaaauaagaaagacucuacugaauucauaaaagggaaaguaacuagcauauauugauuuccacuggaguaagaacugugcuacuuguuuuacaaucuucauuaauuucacaacucuguuaggaaaacacuauuaccuguuuuagauaaagaucagaaauguuaaguaauucuucucaaaggucccaaaaccacagcgacagcaguugauaccuaguuuuucugacuuucuaggauauauuauuaaacaacacaauacuaccucuuuuuaaagcaaguaaucucucuuacaauaauagucuuuugaugugacacacacauacauauuuuuccuauugucugaaggcuuuaaagcagaagauuuuuaaguacagauuauuccagaaagacuagcuucagauguacccagauucuauuuacugggaagcagcuaucuguaaaaggcaauucucuccucuuucaggauuuccagucucaagguaauauaaaaguaacagcugaaugacucauaaugucucucuaccauuaggcuuacuuucaaaauaauuuguaucuuuauaaaauaaaguuaaggaugggcccaaguauucaaaaucaccaagaguucauguugaaucacauuuccauauuuuaaacgcagacuggggacuaaaccauaaauuguugauuuucuaauuacucuaccaaaguaauuagaaauacuaauauuuucuaauuacugagagauauaaccaaaauauuggagaaaaugcuacaucucagucauugauugacaaaucaaucuuaaugauaaauuucaagacucuaaaucaugaaaaauuuccacauuuuaaauacucugauuccuuuuuggucuauugagacuuacacuuuuuuauucuuuaagaguuagucaauuaaguaauuacuauguucaauuaaaaaggcauagcaaaaaagacuacugacuauuuuagaagucucugauaugauccuuuuuaguuguucaauuucauuaucuuucuguacauuacuggauaucagugcuuuuagcuguauuucuaaagcugcaaccaguugaucucguucuucucgccacuuuugaaggucacuaucuuucucugucagcugggcugucaguauuuccuaaucaggaaauaaagaaaauauuaaaaucaaccuugauauauuaugaaucuaagaauguuuagaaauuauuauauguaacaccauaaauauagcugcaaacaagauuacaagacaaauuaaguagucuagauaaaauauuuaacuauaaaacaacacauaucauuuuauaaauuaaauguccauguuauuuuuauccauaucccaucucauuccaaaaaucagcuuacugguaacuucuuucaauacacaauuacagcuauagcuuucaaacuaguaucaacauuucugccaacguuuggaaaauuaguggguaaaauuacaguaauagcaacaaacaacagaaaaaugaaaacagaaaacaagaccauuuacaauagguucaaaaaucaugaaauacugauaaagaaaauguauaaaaccauaaaauacugcugaaagagauuaaagaacaccuaaauaaauagagagauuggucuguguugaaggaucaaaauacucaauauuguuaagaugucuccuccaaauagaucuagagaguaaaagcaguuuuuaucaaaauucagguaugugugaauguguguggaaauggaaaaggugacucuaaaaauuauauggagaugcaaaucaucuagaauacucaaaauuauuuugaaaaugaagaacaaaaugacagcaauuaucuauaauuucaaguuagcacaauaaucaagacagcauguaaagacagagaaaucaaugggacagaagagacgaucuacaaaugcauggucaacugacuuaaaaaaguggcaaaaaaauuaaauaaaaggaaggacaaucuucccaauaaauggggcuggaacaacagaauaaccaaaugaaaaaaaaaaagaaccccaacccuaaucuuacaacacauacaaaauuaacccgugggcaaaugauuuacgacaaaaguggcacagcagugagaaagaaacagucuuuucaauaaauauuuccacaucaauugguaauucacauuaaaacaaacaucaagagcuuugaccacuaucucacaccaacacaaaaaucaauucuaguaucuaaauaugaaagauaaaaaacuucaaagcuuucaggaaauaauauaacacaccaucuucaaguccuugggcuucauaaagaaaaauauugggacaauuaucuacaauaauacuaauaaaauuaucuacaauaauuguaauaucuaccauaucuacaauaauaauuuaugagaacuccuacucauaaaaaggcaguaagaaagaaaaagcaaacuagagauagaaagaagguacuugcaacacauuacaaaaagggcuucuaucccgaaaaguauaaagaauuccuacaaauaagaagcuagauaauccaacagagaaacagguaagggaacuuguauaggcacagccaauaaacaaaugaaacaaucuucaacuucaucaguaauuagggaaaagcacauuaaaaccauuuuaaaaacugacugacaauaccauaccuuggugggacuauacagcuacugcaacacuaguugggguauaaauggguacaacugcuucgaaaaucagugcagcauucuacuagaauuucacauauauauacccuaucaucuagcaauugucauguguguauauauauauauauauauauauauauauacacacacacacacacacaacagagauauaugcaaaugugcaccaaaacaaauguauaaaaauguuuauaggaaaauuuauucauaacagccaaaaccagaaaacaauccaaauaucuucaacauuaaaaugaauuagcagugguuuauucauacacuuaaauauucugaaaugaaaguggacuaacuccagauacaugcauggaaacauggaugauucucacaaacauaaaauagugaaugaaaagaagucagguacaaucaaauguauucauauauuucaauuuacauaaaacccaaaaacagacaaaacugaaguguaacacugaaggacagauuaguuauuaccacuggaaaagaggcagaagaaggagcuucugggguggaacaguguucucuucuugaaauagguauuaguuaaguggguacuggcuucacaauaacucacugaacuauguucuauuuccuuuccauguuauauguuacaauuuuacaucaaaaauuaacauuacaucaaaaauguguuucuuaaguauggcagacacauacacaaccuaaguaugauuauaaagaaacauaugagagaaaagaguaaacuagcuuucccuaggauuaaaaauucaaagugggauuacuugcuggcauugcuaccagagaaaccacugguuuggaauuggagcaacugugacagccuucuguuuugauuuuacuuauugccucuuacuacugggucaggaagguugggugauagguauacaggaauucuaugugcuaguucuguaacuuuucuguaaauaaaaugauuucaaaaaauuuauucuguaaauaaaaugauuucaugaaaaaguaaacuuuuuuaugggagcaaauuuacaccaugugacaugaggacagagcauucaaugguagacucucuagcuucagaaaggacacacacuucaaccaagggcuugauuucuggaguagaauacauguauggucuggaguuuagcaagcaugcuggaaaguuuagcucacaacagccucauuuuaauaaaaacuggccaacucuguucaauauucaauguuaaaagcagcuuuaaagcuagggaagaaaaaaaguggaaaaacuguccuuaccuuauugaaaauuaacauuucaggccggguacaaugcacaguggcucacacccauaaucccaacacuugggggaagcugaggcaggaggacugcuugagaccaggaguuugagaccagccugggcaacacagcaagucucugucccuacaaaaaauaaaagauuuaccuaggugugguggcaugugccuguagucccaguuacuugggaggcugagcuggaaagauugcuuuugcccugaagucugaggcggcagugagccaugacugcaccacugcauuccagccugggugacagaacaagaccuugucucuuuaaaagaggaaagaaaagggaaagggaaagggaaggggaaggggaugggcacggggaagggaaaggagaaaggaaggaaaggaagaaggaggacaggaugaagaaaaggaagaaggaaaggaaaaaggaaaggggagggaggggaggggagggaaggaaaggggggagggaaggaaaggggggaggggagggaaggaaaggagggagggagggagcaaggaaggaaggaaggaaagaaggaaggaaaucuuucaguuuuuauaggaaaguuuaacuguuuuuagucaaaugcagucauaaaaaaaggaaaugccaacagaugacaauaugauacugcgaaguuacuauuuuuauagacacugguuuuucauuuuaaaauauuuguugcucaauagcuuuccucggauuaacgauaacguuuagcuucuuuuuucugauugccaacauggcaugucagacuaagugccaauuagaaaaaaagaacaggcuaagacaaucauuacaagaccuacagcuaguaaauguaaaacugaaggucauuucuacuauauauauagucuuuuacaaacuauuuaggugacuuuaugugauaaaauguacacaguauuagaaucuacaguucaaaaugcagaaaguuuuaaaauauaauagggaauacucuguaacggucaaaaggaagagauuuuuuacuucaguaucuagacaguaagaagcaauaagguauucucccaacaugcuaaaucaacugaaacaaguuaaaacaagaacauuagugaaugucaagauaaauuggcucagaaguuaucuuauaaagaugacaaccugccuuuaaaaaaccaaaaacagaaaaccauguagaaacuguuaauuccagcaauacauuuaacacaccaaggaaaguaggugaaauacaucaaagauacaauuguuacuaaccauuucauucuguugcuuaaaaaaacgcucccuguccucagcauauuuuuucaucucuuuauuucguauauucucugcuucuuucgcuugagugauaagcaucauuuuuucuucuaaccauuucuuucuaucagcauuauauuucuguucagacuccuguauauauaaaugguauaaguuauuaucgcaugccuacaaaguagucaauacauguuucuauaacauuuucauacaauccauuacuuuucaccucuauaaaaacuuuaauguuucacuuuaaacaaugacaagaucaaagcuucagauuauuuaaaaaauaauaaaauaacugguuugcuuuccuaaacgcauuucauuuauaaguuaauuuugcuaugaaguccauuuaaauacuuuuaucagugaccuuaagaaaaaauaaauaauucaaauuucugaaacaguuaaacugacucaaaucuuccuaaaugccaagagaauaaaaaagacuuuguuugugguggucauuucuaacuggaugguucuaaaaauaaaauauuccugggccuacgagaugccaaauaaaaaauaacuugugcaacaggauauuuauuaaaagaacauccagaagagcuggacagagaauacugcugaucaguaauuuucaaacugguaccacagauucuuuggguucagaggcauuuaauaauauauauaaaaaacccaaguagaacuucauuugaaauaaaaauaauaauaccacuuaaaaaacuucuaggcugggugcgguggcucacgcccguaauuccagcaguuugggaggccaaggugggcggaucacgaggucaggagaucaagaccacccuggccaacauggugaaaccccaucucuacuaauacaaaaaaauuagcugggcgagcuggcguguaccuguagucccagcuacucgggaggcugaggcaggagaaucgcuugaacccaggggguggaggcugcagugagccgagaucacgucacugcacuccagccuggcaacagagcaagauuccgucucaaaaaaacgaaaagaaaacuucuaaaaucacuauauuacaaaguauggcaguccauuccaggauuacaaaguuuauaaucuacacuaaugugauuacaucaucuuagaacaaugcaaaauacacaaauacuuuuuaaugcaaacauucucaauacgguugauacacuuuuuucauaauauuuauuuuguucuaacugcuuuuggaauuucacaaugaaaaggguaaauucuagaauauauaauauguaacaaaaaaaguaguuuuuguauuuguuuucagcauauguuuaauacacagccagaauuuuaaaaaauuuagaggcagacaaucucccaaaacuauuauguuuccuucaauccuacagcuucuguuaugaaugccacuucuaauaaaauguacaaaaugaaauaguauuugguaaauccuacgaaaaaaaaaguuucccccauauguuguauguuaaagcugaacaagaaaaaaacacacacacacaaaauagaauaccuucuauauaguauaguuuuauauguguucagauauacaauucuauuccaauaauuaaacuuugaagagauuuaaaguaaucaaaauaauucuccugauggucauuuucuccacagcaguauuugaugaguaagaaguuuaaggaguagaaaaaugggcacaaggacauuagaagcagugguuuaugaauuaaauaugugaaacauaaaacuaaggacccaaucacuauauuucacuggcacuuaauaggcuauaucuuggaauuucuuccccaugucauuucaaugugcacugaaaaguuauauuuacauauuaacauuugccagguauuauuucacccauaucuaagugaauuacuaaauauaaaauacugaauucuccucuuauuagaaauauaaugaagacagauacauucauacauaaaaacauacauaaagucauaccuguaacucaucuugaagauuagugagcuuuccaagcacaucuguguuguucucauguucuuuauuugaccuuugauuguuuuugguuuccaaaucauugcauuuuuccuuccauuuuuccaauucugauuugaagacauaaaauuauguuuuaaagcauaugcaaaaguuauaccauguagagauacacuugacaugggcuacagacacaaaucaguagagcccagauaaagaacacagaccaagauggaacugaggcuauucuauaguuuaacuuuuaggaguucuuacuaaauucuuagugaagaggaacuacagggacuucucaggaauccaaugaauaguauucacaguauaguauaauaaauucauugucaaccuuauuauauagaaaacuucaugcaguccucaagaaaaaaguuuucuaugcccaugaaaguggcuagaaaaguaugaagucacacagacucacuguccucauccucaucacaauuucauccaccaaaauacaguuauaauagaguuuuaggguuuacaaaguacuauuacauuuuuucaucucaucugaucuugauaagaauaauguacaauaugaaucuucaagucagaugauuuuaaaaaaagaauaaugugcaauaguacauauggcauuaucaucaucagccacauuuuacaaaugaggaaaauuaggcugaguaagcacaaguacccugccaagguuauauauaaaauggcuagacaauuucuuaauucuaaauuucuugcccuuucuacaagaaucacacauaacauuuuuauuaguaaauguuauauuuuuccauauacucuagaaaaacucugaugguauucugaaagcaaugaaaucaaaguauuuauugagaucaacauacaagauaaugcuaaaagccugacaaaggugaaacucaguugaaaacuuacucuuaacaucuagggaacacugcaaguuaucauccauaacuugcaauauauaauucguaaguuaucaugcaguguccuuacuccuuuacugcauauaauuuuagugaaacaauuuucaucacaguggaaaaugacaaguaauaggacauucaaaaaacaccaaauacuuuuccauuaucaaucacugaaaauacguacuacuuuaacaagggaagaaaucuaggaaauuuuuuuuuaaaugaaaaaguauauuuagagaaauguaagcaaucuuguuuuaccuguggccagccuuucaacuuccucuaauuuagccucaagcacuugauccuguucuaccugaguuuguuccuguucuucuagugucauucgcaugucuucaauuauuuucucuuuaacauuuagaucuaaaaaucgggggagaacauuuuagaaauuaauagccucuagauauccaauuuuucuuaaguucuucuaaaauuaaaauacauuuuuauuaacuguaauagaauauuaguuccauauagacagaaacuuugucuuauucaucgcaauauccucaaugucuacaacaguacugguauauaugacauacuaaauauauauuugguguaaagauggaugcuuggaugauugcaagaguggaugaauggaaaaaaguuuuuucagguaaaauuaacaauuucuaauacaauuaaacuauuccgauacaacuaacuauuacuaugaacauaaaucuuaggauuuagggggaaaaaccauuauuuggcaaaauacuuauuuucaguguuaauauucuccaaucaaacuaaaaccuuuaccuccuaaaacuaaaaaagcucaaucccaauuugaacuauuuuuuuuaacaucaaguaguuacuuuuucuagaaaaauauucagagucaaauauuuguuucuauuuuaaauuuuuauuuaaaaccagcuccucagaaauggcuuuugaaaagcuaguaauaacagccuuccuaaaauuguuucuggcccuugaagaaugacuacagcaauuacuuguaagcaacuauauauuaacccugucugcaggaaacggauaaagagggaagaucaguuuguugccucuggugauggcaccuaguagcagggcucauuucagagaacucuuaccaacuauuacugaugucagaggugauaaagcuauaaaugcauagcucaaucucaggcugcuuuuaguaacacaaauacccaaagauggcucccucaaagugcacauaaaacaaagguaaaacaaacuaaacaguaagagaaaacuguaugagcaguuuuuaguauuuuuccauugaugcaggcuuucaggugugcuaguaaaacagaauuccuccuaggauuaaagucaccuucauauuaucauauaaaucucuuucaaaaagcaugauuuucaaauauauucauauuacacaauuaauuauaauuuuauucaaagaauucccucccucuuacacuuugcauuucugacucuaaacugaggacuagaaaaagaauuuacaaaucuaauuaucaauuaaaaaauuuccagaacaccaaugguaaccucacuaauggcuacucaccuauuauuugaaagcuagcaaacuagagcaguaaaggcaaaaagauaauuauuuaaucagucauugacuccaguaauuuacauuuuauuucaggaaagaaccccaaaauacacaccaaaaugauaaaauggaaaauaaagcaaaguaaagaagucugagacagauaucucaucauagcuaucuaaagauauuaucuaaggauaguuaugagcaaucauagugaaauaaaugacuauuaaaugaacaagcaaucaagugcugcauauucaacacuugcuuaccauccccaagaaaauuaaaacuauaaguuuacccaaaaacuugcauauaaauguucauaaaagccaaaaguggaaacaacccaaaugucuaucaacugauacauaaaaugcggaauauuauucagccauagcaaggaauaaaguacggauacauacacaauauggaugaaacuuggaaacauuauucuaagaagagucaaacacaaaaggccguauauuguaugaacugacuuaacaugaauuguccauaauaggcaaauucauacagacagaaaguagauuaguggcugauaggagcuggagggauggggugaaugggguaugauugcugauggguacaggguuucuuuuugaagugacaaaaauguucacuugucacuuuacguuacuauaaacacacaguaauuagauaguggugaugguuguacaauuuugugaauagaaaguacuaaagcccacuaaacuguacacuuuuaaaagguaaauuuuauguuacauauauuagaucuccauuguuuaauaauucaauauuaaagauagguaagugaaaggcauuccgugaauaaauagaaauuuaggaggcagggaaagccuuaagaguuaaagauauaguuuuguuuguugucuauuuguagggaaaugucucauacacaacuuaaaucacaagagcauuuucucucuaaaggaaaaaauaauuuuaaaaaaagauaacgacaucuuaaucaggcaaguuaccaaaguggcugagacucauucugagagaaaagugguaacuaguacagaauagaucauaaaagcugagacaagagaguuucaaaaggugggaggagcuauagauuaccuuuauauuuagaaaaaauacacauacaauaaauacuacuuuauaaauauaacugaggaaaagaagaguguacaauaacaccaaaauaaugaaaaauaaaaagcagggauugcaaaaugcugacagauuuuaacauauguagguuacaagugacuuagaagcauagaaaagguggaagucagauuaaaauagucacggugggccuaugccauacuucuccauauuuggcaaagaaaacaaaaauuaaaauaugauaaaaacuauagggcaaccugguccaaggguagacuuuuccagaguaucuaagauguguccacauucaccaagagggacaaaggagccaaaguaaaggggaauccuaaaagauagcuaugaacuauuuccuaugaaauaggagauguuagggugacaaggccuaagaaaggcagaagaaaacaguacugugugcagagauauauuuucacauccaaguuacccauccaaguuaaccccaccaauguauaagucagcuaaauaaguaauaaucugguuguguuacccuuucuuuuguuggccaaguacaaauaacauggauuaguaaagagagucugagacuuaagagugaagcacaccuggguucaaauccuaguucugccacucacagaacaaagaaguuaagggguaaugaggaggagaggagucuguaucauuuuaaaaacagaaauauguaucaucuauaaaagaaauuuuguggccaggcacgguggcucaagccuguaaucccaccacuuugggaggccaaggcggguggaucaccugaggucaggaguucaagacuagccuggccaacauggcaaaaccccgucucuacuaaaaauacaaaaauuagccaggcaugguggcuggugcuuguaaucccagcuacucaggaggcugaggcaggagaaucacuugaaccaggaaggcggagguugcagugagcugagauugugccacugcacuccagccuggaugacaagagcgaaucuccgucucaaaaagaaaaaaguaauuuuguaauauuucaaacaacaaaucaauacaaucugaguaagaaaagcauaauucauaauucagcaccuaggauuugaaucuaaauuauuaagcagcuuuuuaaaaauuuuauuauuauuauuauuauacuuuaaguuuuaggguacaugugcacaaugugcagguuaguuacauauguauacaugugacaugcuggugcgcugcacccacuaacucgucaucuagcauuagguauaucucccaaugcuaucccuccccacuccccccaccccauaacaguccccacagugugauguuccccuuccuguguccaugugcucucauuguucaauucccaccuacgagugagaacaugugguguuugguuuuuuguucuugcgauaguuuacugagaaugaugauuuccaacuucauccaugucccuacaaaggacaugaacucaucauuuuuuauggcuguguaguauuccaugguguauaugugccacauuuucuucauccagucuaucauuguuggacauuuggauugguuccaagucuuugcuauugugaauagugcugcuauaaacauacaugugcaugugucuuuauagcagcaugauuuauaguccuuuggguauacacccaguaauggaauggcugggucaaaugguauuucuaguucuagaucccugaggaaucgccacacugacuuccacaaugguugaacuaguuuacagucccaccaacaguguaaaaguguucccauuucuccacauccucuccagcaccuguuguuuccugacuuuuuaaugauugccauucuaacuggugugagaugauaucucauugugguuuugcuuugcauuucucugauggccagugaugaugagcauuuuuucauguguuuuuuggcugcauaaaugucuucuuuugagaaguguccguucagaauacacauuuuaauuuuaaagauauuuuauuugaaguuuauucuuuacacaauuucguccagaaaucuaugccauucauugugaccuacauaaaaguuugacuggcuuuauuuuucacaaaauacuggccauuacaagaaaucaauguugcuuugacuacuuauuuuauuuuucuaagaauaagcuuuaaguuaacaaauuauucauuagaaucacuacuuuucacuuuugauaagcugcaucuuauguugcccucacuucccuucagaauuuucaaaggaaauguuaaccaguuguuauugcaacuaccuguuuuguaauuuuaguacuggaagugauaugggaggcaggcagggaagugcuggguacagaaaggcagggucccuggugaaggcuccacccucgggccugugcccacagagugaggacaggcacuccuguuuucacacccaaauguugcauuuuucaagaccacccuggccugccacgcccccauccugugccuacaaaaacccugagacccuggcaggcacacacacaagcagcugaacaucuagaggaacacacuggaagaacacaccagcagauaccagcagaugcuggcaggccaucuacugugagaugacacggaauuugguugcgggcagucagaggagaguccggccgcccagggcaagaccaccuucccgcuccauccccuucuggcuccccauacaucugcagagagcuaacuccacucaauaaaaccuucuacacgcccaugugugauccgauuuuuccaguacacuagagcaagaaucccgggauacagaaagcccucuguccuugcaauaaggcagagggucuaauugagcugauuaacacaagccgccuguggacggcuaggcugaaaaaacacccuguagaacacgcccacuggggccuucaggagcuguaaacacucaaccccagaugcugccacagggucagagcccacacucaagaccugcccgucugcaugcucccccuagggguuugagcugcagggcaccaaugaagcaagucauacccccaucgcaugcccugcgaggggaauaagagaacuuuucugguuccagaaguacaaacuuguuccugaccuuugcaugcucucucauacuguuguauagcuucuuccacuuucugauuauuuaacugcuccuacaaauugaaagaauauaaauuaauugcaaauuaacuuaaaaacacaauauuuaacaguggaucuugaaaacagggcucaauauuaaguuugaaaucagucuccuauauagcugguauaccagcugguaccagucucaagcuuccaacugucuuucaucuuggagaaaaggguagggugagagcaggggaaagaagaaguagagauugcagugagccaagauugcagugagccaagaucgcaccacuguacuccagccuggcgacaaagcgagacuccaucucaaaaaauaaaaauuaaaauuaaaauuuaaaaaaauuaaaaaaaaacacuuuauaugucuuuauuuauuuauuuauuuauuuguuuguuuuugagauggagucucccucugccacccaggauggagcgcaguggcgcaaucuuggcucacugcaaccuccaccuccuggguucaagcgauucuccugccucagccuccugaguaacugggauuauaggcgugugccaccacgccuggcuaauuuuuguauuuuuaguagagacgggguuucaccguguuggucaggcuagucucgaucuccugaccuugugauccgucugccucggcuucccaaagugcugggauuacaugcgugagcgacugugcccagccuauacuuuuaaucuacguuaugacccgguuauuuuacuuacucaacauuuuagauaaauguuuucuuacaaaccacaaaaagcagaaacaagggaaaaugaaguucuacuguguauuuaacauagaaggaacaagaaaaaccauuaaaagcuuccucacugguaaacuuaaacucaaaaugaaggaaaaaagagcucuccaccccuuuuaccuagaaaguagcugcaagauuggaaaaaaauaagccuuaagaggcaagauuaaauuauggggaccagauauccuacaguucuaauuguaacuuaucauguaauccaaacuucacccccaaucucaucuaaugucaccacuaucucaucacuuuguaagucuuaagagugaaucauuauggaauauggagaucucgaauccuauuguuauagaaugcuuuauuaugauuaccuuaagaauuaaaaucauguauuuauaccugacuauucauuaguuugcuucauuuaaaagcaaacaugaaaauaauauaacaaauguauuuuuuuuauuguugccucauccauuugguugauaucaagcaaaaaauaaccauauacaauaaagggauuuugccuuuuaaauaucauuuuuaaaaggaauuugcuguaagaccucaacucuuuuuguuuuuuugcauuuuauuucaaaauaauuuuagcuuugcaagaguuccaaagaauuuagcuucccuuaauguuaucauauuacacuaccaugguacauuuaucaaaaaucaagaaauuaacauugguauacuacuauuaauuacacuccagacuucaccaucauucaccagucuuuacuugucuuuaaugacccugacacuuuauacuucauacuggugaagcaguaaguauaacauccuccauuuggguuugucuaauguuuuuucgugaagagucugagguuauaaauuuagggaaagaauaccaaagaggguaugugccuuucuggucacaucaaaccaggaagcacacagcaucaauaugacuaaugguaauguuauucuuaaacacuugguuaaagugguaucugcuagguuucuucacuaugaaguuauuauuuuuucuuuuccauagucuauucauuagaagagagucacuacuggccuacuuaauuuuaucuuuuuuuuuucuuuuuugccuauuuaauuuuaaauaauuuauuucuagauucuagaaaaagucaaaacaggauguuauuaaaaacaaauuuguaccuuuuuguacacuaaaauauaccaagagaaugcauuuaaaucaucuuuaaaaacaaaacuguuuaccuugaguugcugaaugguucgcuguuucauaucuaauuccugagaacacugguuuuucuuuuucuccaguucauuaauuuuaauccucaguaauuuauccucaucacgcauuacagauaccuacaaaauaauguuuauaaaacaaauggaauauuuuaaaaauacuaacugcuuuuuguuauuuaagauucauggcaacuauguucaaagauucacauccuuuacagccuaaaagaaaaaugacagauuuuaauauacuacaaaucaaacacacuauagcuucaaauuauuagaaaauguuuuaauacucuaaugaagaaugcauaugaaaaacucaauuucuuguuccauuauuuaagaaucucaaacuuuuuaaguucucucaaaaaagaauuaucauaacaucuauacauaauagggaaauaauuaccaaggaaaaaucaauaaagauauucugagagaaaaauacugauucaaauuuccaaaguuuauugaguaauauaauccaggaauacaagaaaaacuuuaaaagcuaauaaugacaugcagggaagaaaauggaacaaucacaaaaucaaaagguacccacgcaagugaaggucaauugauuucugcuguugccgguaaucuaaugccauaaacguagggaaaucgagguacuauggacuaauauauauauuaauuucucacccaaaaaagcuaauauagguacauccuuauacuaguuuccaucauaccaacccccucugaaaccuuucaguacaucuugccaggauuuccagagggaaguuaucuaacuggcagcagagccuucucuucuauucccuuguggagcuuuacugccaaaacuccauuuucacacucgcuagagagcucaaaaacggaaggaaauuaaaugaaaagaugccccauaaaaagcauagagaaggccgggcaugguggcucaugccuguaauaccagcacucugggaggcggaggcaaguggaucacgaggucaggagaucgagaccauccuggcuaacacagugaaaccccaucucuacuaaaaauacaaaaaacauuagccgggcaugguggcacgugccuguagucccagcuacucgggagacugaggcagaagaauugcuugaacccgggagguggagguugcagugagccgagaucacgccacugcacuccagccugggcaacagagugagacuccgcccaaaaaaaaaaaaaaaaaaaggcuugaagaugcccuuauuauaguagcucagagugguaugguuucagaggauucuuacauuguuuuaagcuuuauguuccaauaauacauacaugauaaucacauauucauaauauuugcuaauuuuguuuaaaaaaaugaggcuucaaguaauaaacaccaucuucaucaacuauauaacuaacaauaauagaggcuaugugcugcacaaagaugcauguaaggacugccucgguuuccauucuggcucuagcacuuacuacugagugaacuuagacaagucuuauuaagacuaagacaagugaacuuagacaaggacaaguucccccuuauccacaggggauauguuucaagaucgccaguggauaccugaaacauuggauaguauuucaagauccccaguggacaguauugaacccagacaccaucaaucgaaacacacuucuguuugcauccuccacccacaaauuuaaugcuuuuuccaucuuagcuaagcaauuaucaugaauuguggccauaacuuuugcagugaggugcaccagcaaaacuaacauaaauuucuuuuuucuucuucgcaauuucacagauggaagauuuguucuuaccauagaucuuagcaaccucagauuacaauuuuuuuucuuuauuuauuaaguuaagaacuuuuaccuuuucauuuaaaggaagcccuuuacaacaacauuuuggcuuaucugaauugccagcaucacuacuuuugcauguugagaccauuauuaaguaaaauaaaaguuacuugaacacaaacacugucccugauaccaugacacgugaucugauaauugagaugacuaagugauuaauagguagcacuaacaauguggauaugcuaggcaaagggauaauucuaacuccaggcaggacaggauggcacaagcuuuugacccacuacucagaaugaccugcaauugaacuguuuauuccuggaauuucuauuuaguauuuucagcucaugguuggccacagguaacugaaaccacagaaagcaaaacugccaguaaagggagacuacuguaucccucaaugucuguuuucuuaucaacaaaauggaaguuaaaaacagugucuauacccgauauugugugaggauuaagauaauaugucaacucagcauagcagcuggccuagauuaaauugcuauaauuauuauuauuugcuuuaaaacuacacauuugagaaauagaaaauacuuuuaauacccaucauuagaguaauguuaaauagucaucuauaugaggagggagccucaaccaccuggccacagacaaauacugauccauagcuuguuaggaacugggccacacagcaggaggugagcggcagacaagggagugaagcuucaucuguauuuacagccacuccccaucacucacauuaccgccugagcuccgccuacugucagaucaacagaggcauuagauucucauaggagugcaaacccuauugugaacucugcaugcaaugaaccuagguugugcauuccuuaugagaaucuaaugccugcugaucugccacugucucccaucacccccagaugggaccgucuaguuguaggaaaacaagcucagggcucccacugauucuacauuauggugaauuguauaauugcuucauuauauauuacaauguaauaauaauauaaagugcacaauaacuguaauguguuugaaucauccuuaaagcagccagccccuacccugguccauggaaaaauugucuuccacaaaaccaaucacugguaccaaaaaggcuggggacugcuaucuauacuugaaaagagauaccucuauaaguagcaauaaaaaagacuuuaacaauacaauaaauuuaaaaggagcuagggcaugguggcacaccuguagucucagcuacuagggaggcugagaugggaggaucacuugagcccaggaguucaaaguuacagugagcuaugaucacgccacugcacuccagauugggugacagaguaagacccugucccaaaacaaaauaaauaaacuuagaaaaaagagcccccuuuuaaucacaccugaauuuaugcuaaugaaauagcuuugaguggaggcuccuuugaaauagcuuaaggguagggcuacucaccaaaagaccaaaaaugauuagaguuggaaauuucagucccacccaccaaacucuguggaagagaggaggguuggagauugagucaugagaacuauuguacagugagguucagagagugucccacuuggugagcacacugaggucuuaggagggugguacacccagagagggcacagaagcucugcaccacccucugucccccuuaaucuguccuguguaucccuucuauuugucuguucuugaguuguauccuuuauaauaaaccaguaaauuuuuuuuaaauaaguaaaaauaaaaacuacauacuuuaaaaaaaaaaaaaaaaagacagcacaauuaaaaugaacaaaugacuucaacagagcagaaacugggauagacaaauagaaauaaaaauaugaauagaagcuguacuucauuagcaaucaaaagaaugcaaauuaaaacuaccaugagauaacacuucauauccucuaacacaguaauuccccacuugguauauaaacuuuugcauauguguaccaagagcauauagaagauauuugcauuauggcuaugggcaaaaaauaauaaacaaucuaaauggucaucaacaagagacuaaauaaauugcgcuaagucacacaacagaauacuauacagaggugaaaaugauuaauuacgacuguacaaaaucaaucucagaaauaugaugugaaaaauaaaaguuugagaagaaaauacuguuuagagauuaaaaaauaugguuaaauuauauuuuuuaaaguuuagauaaacacaacauucaguagucacuuuuauagugguagaaacagcauuuguuguauuaauauuugucagaccuuacacauuuaaguauuauuugguaacuaccucaaaguuuaaaaaaaaaaaaaaaagugcuccaaucuuuagagaaggucuaaguacgacagaaaaugaaguggucauacaagaaaaugggaaggagggagaagugcagaaaaagaaagaaauugguaacauuugaugcugugaagguaaacuugacagcucgaaggagugggaaguauuuccuucucauuguauacaucuauuauauuucaaauuuggaauaaugugauugcauucccuuuuaaaaauuaaguuauaauaaaaacuaaaaaaucauacugcacauucuccuaaguacuaucuguaaacaaguugcuuuccacuuuuuuguaaggacuuacauuuagcaauucuuaaagaagaaaaagacuaaucuuucauaagguacauauuucucuuaauguuggacauucuucagcuuguuuaaaucagcuaaauuuucucucgugaaguaacuguucuuguaauuuuaagaaaaauuauaaaguggauaaauguucuauucaauccuaagauuaaugucuaaguuugauauauaaggaaaacaaucuuuaucauaaacuggccacauaacuuuucaaauaaccuaccucuuucuguacuugcuuaaucugcuuuuuggcaucagucaguuucucuuucaggucagcauaaucuucuuccuuccucugaagaucugcuuucagauucuggguacgagcagagcuugcagagaguuccucuuucaaucuaaaaaacauaaaccacuuuucuaugguaaugcaucauuaacugcuuaggaccauacaugugaaaugguaacaaucuuuacaaaauuauaucuuuucacaaauuuggaauauccaaacuaugaaugaguucuucagaaaauauuucauaugauuuuuauaagcugaucuuuucacauaaccuaugguccaaagguuuauauggacaaaguucaaguucuucacucaucauacaugcuacgcuuuaccagauuaaguaugacuaucuaacuuuuuuaaagcugcauagcaaaaugaaugcuuuguguauuuuaaaauauuuugaauaacauuuagcuuacuuuucuguuucuugccuguugguuucuucuucuucuucuuuuaauugaaguaaauguuucauaucuugcaaauuauuuguuaacugugugauuucuucuuucagcuugaguuccuuuacauuuaaaucuuugguguuuuugacagaauccugaagauguucuugaaauuccuucaaauuucuuucuagcuuuaagaugauagauuccuuuuccaaaaugucuuguucuaacuuggcugaaugacuacauucaacuuucugagucucuaaaauuguuucaaguuccuuuauuuuugccuuauagcaaguaacaccuuguguaaguucugaaagcgcucucuuuccuucaacuacaugcuguauuugaacaucaagaguaacauuuuuuucuugcaauucuucuuucagcugcuguauaagaguuucuuuuucuuuuaguaggucaucuugguuuuuaugcuccuucuccuuuagucuauuguuuucauccuuauagccuuuuacuucugccugcaauuuuucaauuuguuguuccaguuccucaaucugaugacuuuuuuuggaagaggccuucacaaucucuuuacauucuucccaaauagcuucaauacuagaguggaaagaauuuucccuauuggguucuugaauucgauauucuuuaacuugcuuacuuaccaaauaaucauuaccuaaaaggucuaacuguguauuuggcaaauuauccuccucagaaccauuugacagaucccugagauugagcaaaucuauguuugaaaucugagaaacugaaucaagaguacguaguucgucuauuuucgugugcauuaauuuuauuugugaaacauuauuuguaaugcuucuuguagcaguuucuaucucauuugacaauuucaugaucuuuuccuccuguucuugauuuuuacuuuucugcacauguaauucagcaauugcaauaucauaauuugacugaauuuguuggaccucuuuacuuaaaguuaaauucuuuuuuucagaaagagaaaguuccugcugaaaaugaacaaucuguuuauuuaauucugcuuuuucuuccuuuucauuuuuaaguucauucucaauagugaguaaaaaugcucucaguccuucauuauuuucuuguaaaacucugaugucuucaauuucugcaauguucggucgcacuucuucacuuuucuuuuggucuucagugauagcugaacuaacauggauagacccuuuaaaaauaagaaaauuguuauuaaucuggcaaaccuuaauaaaaccaaaaagucaccauauaagccaauauucaaacauacaaaacauguaaaaguaaacuucuaauuaaaaaaaaaaaaugaaauaagcuguugagaaaaaaagaaaaaacagguuuuaaaacaugugguaugagcccauuuauguaaaaauuauuauuucacaagguaauacaaaguuagcaaaggaaguacaccaaaaugauggcagcuaccuaccucugaguagcauuaccagcuauuucuaacuuucaguauuauuuaaauuuuguaccacaaaucuuuauugucauuucaauaugggacagagaggaggagaugacgagaaacccuaggcagacauuccauauccuaacgaacaguuuuaagcuacaauuauauuguggcuuuuacuauauuagcaauaggcaaauggaguaucuuaaauuuucauagcuaaaauuagaagggacauguuaaaacuuugggaauucauauaauauagccuuacuagcuguaaccauuaauaaacugcuucauacuacgacuguuuccucaaaugugauauaggaauaauaccaccuaucucaaaguugugaagaucaagaugacaaauggguugacgacacugugcauuggauagauuuaacuauuaauagaaccugaaaaucuguacagaaggauucaacuaauugaaaaugcauaaaaguuugccuuuuucaggcuuaauauguauauugcuagaauaaagauacccuuaccugcccaacuuacucuacagaauaaugcuaagagacuaaaaugaguuaauacguaauguaaguuaaaugacuacauaaauguuguauacauguaagaacuuuagccauuauaaucaguacagaucaaauuauacccagaacagauacacuauuagcuacaauuuaauucauaaguucacucugacaaauaaacucaccccacguaagugcccaguauaaauuauauucuuuuaaacuuuccucauagauuccaugauuaaaucuugaaauauaauuaacaaucuucuagauauauaaauuuauaucuacauaucuuuuuauauuucauacaauuuccauuaagggucagaugagugucucagauccucgaaaccuuacuucaaaacaggccagaaucugacucuucguuuuuagaaauuuuuuccuguuuuguuauacuucaugguuugauguuuauaugauguuugcaaguagacuuuacaacauuguucugguacaauuuuuaugugaauuuucuacacgacuuugcucuaauacaaucaauuccauauguucuucugaccgccauucacucccucacugaccauuucuguuuaauuaaccuguauuuuuaugugauauccucacuauguaagaaucaaauucuucuuguuuaaugaucccagauauaauaugaaguacaaggguuacuaaucuauaagagcagaagacaauuauaauguagguuuggcuugaaauccuucuaguuaagaaaccuacuacuuucuggccgggcacgguggcucacgccuguaaucccagcacuuugggaggcagaggcggguggaucacgaggucaggagaucgagaccauccuggccaacauggugaaacccugucucuacuaaaaacacaaaaaaauuagaugggugugguggugggcgccuguaaucccagcuagucgggaggcugagccaggagaauggcuugaacccaggagacggagguuacagugagccaagaucaugccacugcacuccagccuggugacagaggaagacucugucucaaaaaaaaaaaaaaaaaaaaagacacuuacuacuuuccauugguaucuaauugacucuaaaaaguauaugguacauuuuucuuuuuaaugagucccgaauauuauccuaugcaucucagcucuuuauauuuuauugaaauauguuugucucucucaucuacuagauuuuaagcuccuugauggcagacucccuauaucucacucaucacgaacaauaaaccuaaauagaauaauaauccuaaauguaauauuuuugaaacuuaacuauaccacauauguucuucuuuucuaucucuaagacauaucaugguauagaaaacaaauaaucuuugugauuuuugcaauaauaauuuauucugcuucuagauauauguaaauucaugaaucugacauauuccaguuacauuaauuuuguuacuuuaugguaacuuuauguuuaaaauuuuaauguucucucuuuaacacugaaaaacauuuauuuacacaagagugauuuucuaguuuuauugggaggaauuauccagggaccuuauuaaaaugcagauuccuggcaccaaauaccaaagauagugauuugguaagucugggauguauuuuacaugcaacguuuugagaauuaguguucugggguauuauuuuugaaaauuucuagaaguugacagugacuucuguaauaccuuugggaucuuaacauaucaguuuguuacauuacaaagcccuuaacugacagcacugcugcauguaauuguuccuuaagagccaaacgucaaaccucuuguaguuaugaaauucaaacccauuaaguuuuagccugccucucacaggcucuugugcauccuaguugugagaugauagcccaugggaugcacauguaaugaaucuguucgaugaagaaggcagcacuuuugagaucauuacaaagcucauuaaauugaaaucugccaugccauauacaaaugaguuucuauacucauuuccauauauacuaaucacaguugaaguuaugagcaaaauaaaggaaaagccaaagcauuuaugaaaggucccucagguacuaccauaauguggagaagaaaaaacuuaugugauuguuuguucucaagguuuuuuaauacuaugaccccccaccaccacuuucauuuuuuuagacacaguuucacucuuguugcccuggcuggagugcaauggcgcaaucuuggcucacugcagucuuugccucccagauucaaguaauucuccugccucagcuucccaaguagcugggauuacaggcaugcaccaccacaccaggcuaauuuuuuguaauuuuaguagagaugggguuucaucacguuggucaggcuggucucaaacuccugaccucagggaauccacccaccucggccucccaaagugcuaggauuacaggcaugagccaccacgcccggccuaugaccccuuuugauaaauuaaaauccccuagcucucucaagauacugauuucccccagugagaauaugcccccacccaagaaucacuauauaauaugggaaucuuaccucccugucccaucuagaauuuaucuaguuuugccuucgauacuguauauacaaaaaacaaccuguauuuguuaagucuucauuucucaaaugcaaugcauguucuuuuuuguuucacucaauugucuaaauguucuugggaagcuguaauugugcaauuucauuacaggauuccaagaucucuuuucuucaauacagacuaauuuuaaaagcucaguggacaagguuuuauuauguauaauuuacacuguccagccucaaagaggaagggguaaaauaaggcauuaugccugcuguauuuucuuaaaagcugcugaguuucuuuuugaagcguuucuuauguuugcaauuuacauuuuccuauuuauuuccucaagauuuucaguuuauucuaaagagucuaccuccucuaaaauucaaagguuugcccuucuuuauauuuacaacaaacuugcccaguuacuauuaaagauuuuuuaaaaaauaaucuucaacauguauuaucuuucaucagacugucuccugguaucacaaauacagcuugaauacauuuauuauuaauaauauuuagcucaaagucuuacuguaaaauauccuuuucuccaaaugaauaaagaaugcaaacaaagaaaacaaaauaaugugcugggauuuaggcagaaaauacuauauuuauaaaaucaaaguaaugaguuuuaacuauuauaagcacagaaauuauuacauagacugcgaaagaaauaauaaaagcacaauuucuaaaagcauauuuauuaagauaaaagcuuuaacuaugcccaucccuagaaaauguauaacuuuccagaauaaaaauucaagacguuuagauuuucucaagauuuuuccuuagacaagugaaugccccucuguuugccuuguucuauuuacugguuuagaaauuagcuuucuuaaacgccugcugcuggcagcugaaguaguaccuuucuuugcuggugguucaucuugcugaaguucauuuucauuuacucuuuuucuuucugaacagauuuuagauuugcuguccuuagguacuucaacuguuucauuacaaaucaauuuauuguuuauuauuaaagaagauguaucagccuuguccuaaagcaaaauaaguuaaaaauaauucacauauagaaagcuacaaaaaauguacaaaucacauaaauuacuuucaaugguguaccauaaaaauuuuauuuucaaauuuguugagacauuuucuaaguuauuucuuaaguuucguccuaaaauaacugauggcucuagcaaauaaguaacauuuggggauaacuggagaaucuuaagaagauaaaucucugaagucacaucagaaaugugcuuugaaaagaaaaauaugaacucaacuauuuauuuuguuuuguagccaaagccucuuaaagauuaguauugucuuaaacauuaacaacuccuagaaaaauaguuuugcccuuagcuuuaagucgauauauauucaaagauauacagccuacagacagcuuugaaacugagcuucuagauacgucauuuagacuuuuuuuuuuuuuaaggcagacugccucccuugaaaaggcuaguagcaaccaagcacaggggcuccugccuguaaucccagcacuuugggaggcugaggccggaggauuacucaagcccaggaguuugagaccagccugggccacacagugagaacccgucucuacaaaaaauuaaaauuccagguguugugguccaugccugcagucccagcuacucggaaggcuaaggcaaugggaucucuugagcccagcaguucaaggcugcagugagccauggucacaucacugcacuucagccugggcaacagagugaugagacccuaccucuaaaaagaaagaaagugggggagcugagagagggggggaacuuccaaaaaaaggguauaauauggauuuagaagaaggguaaaacucagcauuuaagcgcaagucuauagaguaaucaaauguauggugaaggcagaaacuuguagcaaucaauuugaaaaaacaaaguguaugauagagugccgcuuaaucagcaaacauuguauuagcaggaaauacagauaaaaauaaccuuuuaaagucauaaaguaauggguuauuuaagaaaaaaggcaaaguuuuucuaguaucucuaaacaaaggaugucauaaagaacaaucuccacgcuuucucacaauuagucccuuagugucacugauaaaugacaaaaucaugggacaggcagaucacaccucugacacagcuccauaacaaguccaaguuguuccuuccccgauccuugguaccuaucagaaugaucccgucauuuuuccccgcuucaaaauauacaauccucaccaaaaaucuauccuucagaaguuauaguuauugaaaggaggguuuucugcucccaggguaugcuuggguagaaaaagcaaagaauucaaacuaaauuuuuucauuauuggaaagaguuugcgcucaagacaagauguggaacagugacccuagaucaacuguuaaucaggacaauuagguaaguuccaaacuacuuuguauauuuguauguauuuaagugaacaauuuaaauuuagcacacuguauuaaguuaguugauaaaacaagaucuagaaucuauaaaguuuauuuacaagcaaggacuaacuaauuuacaaauauugauuuuuuuacuaucacuuccuuaaauauugcuaauauauuaugguaugcaaacacacuacagcaauaaauauaaucccaugugaaauuuccaacuauuuucuuugaaguuguagucaccagaaaugaccugucucugacuuuccuuuuuguuuuuauuuaccaaaucaaagaacagacuuaaaauccagaucaagagaugagagcaaaaagcaugugaugacuaaccaaauaaaaguuucgagagccaggaggcccagcaauuaauuuacugccccaagucucaaaauuuuaacauccccuuacuucacaaaucaauuuccucuuccuuaaucucuacuacuacuaccguaaaucgaaguccucaucaacuauuagcugaacucuuccaagagguagcuaucuggucucucugccuguagucuaauuccaucucaauccuaucuuccaaguuuccaaaaauaucuacucaaaugaaaaacuccucuuugcuauuccucuggugaaaaugacucccccacugacuccccaaacucuuuaaugcaguauucaaggucuuucaucuuauccuauucuacuacuccuagccucauuucucaccucuccuugcuucaaacuuucuuccuaaacaacaaauuguuuguauuuuccugcacucacugaaagauuucucauuuccaugacuuugugcacucugauucugguacauggaaggccaauguaccuucuugucucuccugacuaccacuguccccuuccucuaccuucaaaaggcuaaauuuuacucacccuuuaaggcucaacuuaaucauuuucaucuccacaaaguauuccuaacuccccacccacucacagcuucacacauugacuacgacugcacauuguauuauaacuauauuuauguuguuuuuuucuuauugggggauuguuaggguaguagauuuuauuaaucuguauaauuccaauaaucuagcauaguaccuggcacacguuggacacuccacaaguguuucuugcuccuccaccuuauuaaauacuaauuauuacuaaauaguuuauuauuaacauauuaaauauuaggauauuucucccaguucagguacagaaaaaccagagaaugaaucauguaucuaauaaauaccaaaagaaaggccuacuauaggagauuagacagagugcucuucuagaaugcuccucauuuaccccugugguaucaaaugcccaucuaaaguucagaugaaucagggaauguugguggguauuagaguuugacuaucaagauacaaaggaaacucaacagucacuuuuuauaagauaccacgccugcuucuuuuggucauagaaaagacauaaaaaagcaccuuucaacaaagcaagauguuuggcucuaaguuuacucagcuuacuacauuauuaccauauauuuuaccauuucuaaauaaaagaauaauuugaaggagcuuaccccaaaaaaagaaaaccaaaagccauuuuaaaagacauggauuaaaagacaagcugaucauucuaagcugaacugaauaugaaauuaucuaaauuuguaugaaagacaacccuuuaagucuuuacaugucacaguguauaacuuuuuagaaaaaauauccuugcuauuaagcauauaaacaauagcaacaauacauauaauaaaaacaagcuucuaaggaaaaaccuaauuuuacugaauuucauguuauaguucccugaaacauuauaaucugguuuucuaaguacaccuaaauuccuuucuccucaaagcuccccuuccaacuagcugaggcuuaaacguccaaaggcuacauauucuccuccuuuuuacaugcaaagcacugccagcguaucuuguggaaaaguauguucaaagaagucaaacacccucgucuaaguucucaaaaauucagauuuggaaaacaguaaauugaguucaauguugcauaagcaauucaacauucucaauaaauuagucuuaguugcauaagcuauuuuaaauuauuuccuuucaaccaaaacauaugcuuaucuaauuuauuaauauaacacaagguuaaauucuuacauugcauuuaaauguguuuuccauaugagacuuuagguucugaaauucguugauaguaucuucuuuuugaucaauuauauuuaucaauucuuuaauucuuugauucuguguaauuauuuucuuuggaaagaagaaaaagcaauguuucaugaauauacuuuaggauaacuagaaugcaaauaugauuaauaaugcaaacaguuuuauaauuccuucaaauuuuaaaguuaaauaaagcuaaucaguggcaacacacuaugcacagcaugaucuuauuuuugccuuuaaaaaaauuacauacacacacacacacacacacacacacacacacacacacacacaaagaaaaaagaagcuauauagcauauaagaggaauuuggagccagacugccugggcucaaauccuagcugcuaucccuuuuaauaugucacccugggccaggcacaguggcucaugccuguaaucccagcacuuugggaggccaaauuaccugguggggagauuaccugaagucaggaguuugagaccagccuggccaacaucgugaaagcccgucuccacugaaaaauacaaaaaucagccgggggugguggccaccuguaacccuaacuacuugggaggcugaggcaggagaaucacuugaacccaggaaacguaggcugcagugagccaugccacugcacuccagccugggcaacagagugagacuccauuucaaaaacaauaaauaaauaaaacuaaaaaaacuaugucacccugggcaaguuacaucauaaaguugcucuaacauuuaaaugaguuaauaaaaagcacuugaaggaguaucugguaaaugguaaguguucuauaaauacauacauaaaguaacagucuaaagagcuuccaaacaaguugguuugguuuuguuuuaaauuuaggaagaacauuaugggaaauuuuuuauuuucuauuuauauagcuuaagguaauugguacaacuagugucuacuauuuucauaaguagaaaaaauacaagaaaagauaggaauuguauaaacaguagguguaaugucuucuaaguacauuuuuguucuuuaaauacuggauauuagauaccaagaucuugaauuauuuauaucugaucauauuuuaaaauauucagcuuuuugaaaggauaaauacaaguugaaauaagaagacucaagccaaagaagaacagaaaaaauaacagaauaaaaccaaucccccaugcauaccaagagacuauauuacuguuuaauuauuuuuuaaaauaaacaaaucuagucaucauucauaccccuuuguuaauuaaauaccuuaucaagacaaaauaaaacuuaaagcauuaccuuauuagaugucucaagcucuugaaucaaugaaucugauucugaaaaaauaaagaacauugaaaauaaauaucuaagcaucuaaaaauauguaucacugaauaacuaugaaacauaugcugcucuagugacacuuuacuguuacauucaauaaaaaggauuuugauagcacuagaagcacacccuacucauuaaaaaaaaaucugcuaauucaaccacaacaggguaauguuucagaaaaagccacuucuaaaacucaggauaaaaauagguggcauaugcuaaauaguaaagaacuggcauagcaucagagaagaaaaggagcuagugcuuuuuaaguacauuucauaaugcaaaggcaccacuuacguguuauuuucuacccauuuguuucacacaaaaaagggcagagcaguuauugcaacuaauucuuaaaaugcagauauuacaaacaauucuauuuauguauauaaaaugcccucagcaugguggcacaugucuguaguccaagcuacucaggagacuaagguggaaggaucacuugagcccaggagguggaaaacugcagugagccaugaucaugccucugcgcuccagccugggugacagagugagacccugucuuuaaaaaaaaaagggggggggaagacagaaaaagaaaaugcccuccuaguuagaaugaagcaucaaacuaacaaauuacuuuaaaccacuccacaguagucacucuaucccaacagugaaucuucuauacugcaagaauuuauaaagaauauagaacaaggccaggcacagcacggcucaugccuguaaucccagcacuuugggaggccgaggcaggcaguaucacuugagccuaggaguucaagaccaaucugggcagcauagcaagaucccaucucuacaaaaaagaaaaaaaaaaaaugcagccgcugugguagugcacacuuguggucccaaguauucaggaagcugaggcaagaggaguaauugagcccaggaguagaaggcugcagugagcugugaugccacuacugacuccagccuuggugacagagcgagacgcugucauaaaaaauauauauauauaacaaaauuuacagcuuuacucauaaaguuaacacuuguuuugacuuuuuuuguugagaagcucauuuucuaauaauauuggucuaaaauaaauggaagucaaaaaauauuuuuaguaguaaauuacuacaaagucauacaaaugguaaaauauuaaaauauguuaccuagaugaaagaauuuucuggucacuacgguaaaugagcuacauaaaucucuuauacuuaccaagaguacuuuuuauguguuuacaauaucuaaauaaaaguaaaauguauccacuuaccauuuucucucuuuuuuaacucuucuuugguuuugauuaauucuccuuugguuuuagcuaauucagcuuuaauuugauuaaacuuuaguucuaaacaagcaguagcuuccugggggucaggaagagaugcaauauauaagugagcaauuucagccuguuucuuaauaucagcaacauuaucuugaagagaaucaauaauaucuucaaauccuacauaauuauguguuuccuaaaaauagcaaaaaccacaugccuaauauuaacaguaggguucacccuuuacaugugguaccaucuaauuuagacaguuuuuaaaaaagcaaaaaauucaucacuugaaauucuuuaaaauaaauuauauagaagcaacuccaauuaugaaaaaccuguguuccauuauuuauuuucugcuguauggaccaugaggcauauuuucgcauaaaaacaauguuacaaacugugacaagucauuauagaacaauuaugauuaccuaguucagguauacuuucaauuauauaaugagacuuaaaagguuuuguugggauagugcaugaaacaaaccuacauuuucacaacucagucaaucccaaaccacgucaaggauacauaagguuugcuugacagcagacgucuggacaucacugucacaggcacuugaacugagugauuaaaaaacuaaacaaaaacaaaaaaaaaccaacucccccaaaaaacugaucaauuucagcuucaguggaagcagcagaaaaggauaauuuuucuuauauuacaaguagagaauaagcugagcacaguggcgugcaccuguaaucucagccaccugggaggcugggcaggaggacugcuugaagccaggaauucaagaucagccuggguaacacggcaagacccuaacucuaaaacuauaauaaauaaauaaacaaauaaaauuuuaaaagaguaagaaacgguaguugcccggcaagggcaacccuuuuuauacauaaacauuuuuguuuuaaucagaacagcaaguaaaugacgucuuaggucucuuacaccuuuaaaauucuuuuuauuuaaaaauguuaaguaagacaaaucucaaaaaagaaucuaucugccuacaacacaaugauucaagcaauaccaaaauaagauauauauauauauaacagagguauaaauuuuucaaaaccaaucauuauauuuaaauucuuggugccuuacacuucuaaaaaaacaugccuaauuauaauaaagcuacacacaaagcauuguuuuaauucuaaacuaucuugguguuucucaucauugaugugguacacuaaacccugguaccaaaaccucacuggauauuuuuaaauacuucaauuaacauacuucaguuucaacuuuuguggcacaaaugucuuucgcugcuucuucucgagugucacauuuaccaaccaaauccuugaagauagccaaacgacguucagcauuuucuucuaauaucucucguucuugaagcagagucucccuucaaaauacaaauuaaucccauuaagaaacagaaaacgaacuacuuuguguuuuuguuuuaaacaucuaaguuuaaguauauucuagauuaaaagaaaauuuaguccagguacagugguucacgccuguaaucccagcaauuugggaggcggaggcggguggaucacuucaggccaggaguuugaaaccagccuggccaacacagcaacaccgucucuacuaaaaacacaaaaauuagcugggcgugguggugugugccuguaaucccagcuacucaggaggcuaaggcaggagaggcuaaggcagaagaauugcuugaacccaggaggugcagguugccgugagccaagaucgcaccacucaauaccagccugggugacagcacaagacuccaucucaaaaaauuaaaauuuaaauuuaaaaaagagagaaaauuuaaauaaccaugcaugggauuaguuacagcuauauucuuuuuuuucuucucugagacaagagucucacucugucgcccaggcuggagugcagugacacaaucucagcucacugcaaccuacaccucccagguucaagagauucucgugccucagccuccugaaagcagcugggacuucaggaacaugccaguacgcccagcuaauuuuucuauuuuuaguacagacgagguuucaccauguuggccaggcugaucucgaccuccugaccuucagugauccgccugccuaggccucccaaaaugcugggauuacaggcgugagccaccgcaccagaccaguaacagcuauuuucaagcuuguauaaagagaucagaauucagaagccaccuaauauaaaaaguaaacuaaguaaaaaaaaaaacuaaaaaacuaaauaaaauucucaauuuuuaccuggacaugaaauaaauaacuuacuuaaagucagcuucccguugagcccaauacugaguaaacuccuguguaacuucuucucgaauuuuaaauuccaagguuaauuuuuccuuuuuuucauuuaucaguuuuuuuuucaagucuucuauuaaguccaacaguuucuauuacauguaaaugauaaaauucuuauaaaagaauaaauauaucccaagagaaauaccguccaacuguucaaaaaauaaaacuuuacauuuagucaauuguaauucuguguccuuuuuaauagugauaauguucucacugaaaauuauauguuugcaaagauuuguuaacugaaaaaucagguuggccuuuccacauuuuagaaauagaccuuugguaacucgucucacuguuuagcuauacuaagaaaauaaguaaaguuaauuagugcauuuauuaucuaucaagaacuacucuggggaguuccauauuugcuucauuuaauccacaacuuucugugagcuugguaucauccauauuucacaggugggaagcauaaggaucagaucucugguaaaugcuaaagguugaguuuaaaaguggccuguaaaagucuaaagcccaaggauugcauacaccagagaaguugcuaagaacacccacuuacuaaucugucaaauaaagauguuacauaaacuuauauuaggcuuuuauaacuauccagaugucaacagcaauucuauagccuuugaaacacauacauaaucaugaaaaaugugcaauauauaaauaaagcaauaaauaaaacacuuaacaugaccauuauacauucauaacauaaauuguagcauuaaggaaacagcuacauauucuuuuuaauguuucuauuuaaaguuacucaacaacaaauuaaacaauaaacucuaagcuacagaucuuccaaugucucaacuuuauauuugaaaauaguucuacagcuauccagacuuugaaacucugccuccaagaauuuauacugaaaauaauuauaauauaaccccauguucugguuguaugaaugcugaucacaguguuguuguuuugugaugguaguuguguuuaaauaaugaaaaagugaacccaacucaaccaauguuaaaggauugguuuaauuaugguacuaccauaaacuaccguaaucaaugauaaccuauauuaauaauucauacuuuucacaauuuauuuuuauauaaagaauaccagguuacaaaacaguaauauauaauaaaaauccauuaacauucaugguagauuugagagaucuuuauauuuagauuuucuuuuucacucuacuauaaauacauaauacuauuuuaauaauuuuaaacuacauacuuucugaguaaaacaauaaauaauaacuauugaaggagacaucagaaugaauguggaaaaaccuugggaaguuuguuuauuuuauuuauuuauuuuuuuugagacggagucucacucugucgcccaggcuggagugcaguggcucgaucucggcucacugcaaccuccgccccccagguucacgccauucuccugccucaaccucccgaguagcugggacuacaggcgccagaaaccacgccuggcuaauuuuuuguauuuuuaguagagacaggguuucaccguguuagccaggauggucuuaaucucucaaccucaugauccacccaccuuggccucccaaagugcugggauuacaggcaugagccaccgcgccuggcgggaaguuuaauaguuuucaauaauuagguuuuaucauuguuagcaucugauaaaguuuuugcugaaaaaauuuaggcuggcuauuacagcuaaacgaauuuaaguauauguaugcuaauaccaagguauuuuauaaugguuuuuaaaagucccaauccuuuaauuaaaaugucaagaaagggcugggcacauugacucacaucuguaaucccagcgcuuugcaaggcaggaggauugccugagcccaaggguucaagaucagccugggcaauagagcaaggccucaugucuacaaaacauuuuuaaaaauuaguuaggggugguggcaugcaucuguggucccagcuacucaggagacugaggcaagaggaucacuugagcccaggauuucgaagcugcagugagccauaacuacacuauugcacuccagccuagguaacagagcaagacuuugucucuagaagaaaaaaauaaagcaugccaacaccuaaucauauugauuuuuaaaugucaaauauuagacauuuugaugaauuuccuuaaaauauuuagucaaucuuauaugauaagcauuuauacuauauaauccaucauaaacuauagcauuaaauauuuuucucuaguaauuucagaaauuuuacuaaccaacauuauacaaaaauuucaacuuugaaaugaaaaaaaaaaacuggguuuuuugguuuguuucuuuguuuuuaagacaaggucucacucugucacccaggccagagugcaguagugcagugauggcucacugcugccuagaaauccugggcucaagcaaucuucccacugcagccucccaaguagcugggacuacaccugugcaucaucaugccuaacuaauuuuacuuuuuuguagagauggggucucacuauguugcccaggcuaguuuugaacuccugagcucaagcaauccuccuaccucagcuucccaaagugcucgaauuacaggugugagccacugcaccagccaaacuagacuauuaaaggcuccuuucgucacugaggagguacuauuuaauacauuacagaagcccaaguaacacggucuaaucacauagugaccagauaaagugggacuuguacuacaucugaagcuaucauucuuguuuccaaacauauguucaauaauugcuuucagggacaugaagguaaauuauuaaaaugagaguauuuagccuaauacaucaucguucuacuuauacuucugcaauccagaagaguacugugaugugugaugugucaacaccauuaaagcacacccaugaacacaggucuacuaguguuuguaggacacugguaagaggacuccaucuauacucacggaguuauggccaauuaaagaugggaauagguggccagguaagguggcucaugccuauaaucccagcacuuugggaggccgaggcgggcaaucgcaaggucaggaguucgagaccagccuggccaacauggugaaaccccaucucuacuaaagauacaaaaaaaacuuaacuggguaugguuacgcaugccuauacucccagcuacucaggaggcugaggcaggagaaucgcuugaacccaggaggcagagguugcaguaagccgagaucgugccauugcacucuagccugggcaacagggcaagacccucucucaaaaauaaauaaauaaauaaauaaauacuauaauuggacagaagcuaaaaaaacaaccguuaaaucuuauuuauuuaucauaauaacaagacgacaaacaauuaguguuuuugaagauaugggaucauagguacuugguagauauuuuuaacacuuguacuugagacugcaaaauaaaggucugauggaauacauaaaaucacuuagugaaaggauacucacauggucuauaaguaacaccccacagauaauaugguuuugcaauacagaucugaaauacuguuaucuuaaccaagugagcaaaacuuagcaucucuaagaauggaaaaaucagacaucauguggcucuuggugugaugcaauggaaaauuuacaacuuaaccuacauaaaaagcuucccuaauguauuaaaccuaaaucaugaagaaauaaucaaacaaaucuaaauugcagguauucuaugagaaaacuaggacccacuuuucaaaaaugucagugcuagauuagaaaugauuaaagaaacacaauaaucaaaagcaauguguuaacucuggcuguagacaaaaacaaaguggcuauaaagaacauauuuggaacacuggggaacucucaauacaaacaguauacgagguuauauuaguguaucaauauuaaauuuuuuggguaugaaaauuucauggucuugugaucaugaugaaaaugcccauguucuuagaaaaauauguucaaauauuuagauguaaggugucauuaugucuggaucuuauuuucaaauuguacagaccaaaagauguguauucacauacucauaaaaugguaaguggagaauccaggugaaggauaaaugaguauucauuguacuagucuuucuauagguuugaaauuuuucaaaauauaaaguugaacacaaaaacuucaguguacuguugaaaaaaacugaagagagagagccuuaagauuuaaccuuaacuucagaauaagaagacaagcauagaaguaugaguucuuaauacauacucuuuucuccucguggcuaaugaaagccuuauuuuccucuaauguuuuaucuagaucuucaucaagaaguuuaguuuccacauuuugaguuucuucagcguuuucuagcuccucaaccaaauccucgucuuccaucaaaucuucuagacuauuuucccaugaaaugguggcucuuuuuacauuuaauauuuuacuguuugaauuacugucuagugauacaucuugagaagauuugacagguccaaauaauuucucuugagaggaauuuaaagugucugggacacaaaccuguuaaaauauucaaugugacuuuuaaaacagaaaagacaagaacuguccacuagaaaaugauuauuuuauaaauuuaagucaaaugaacacucaaguguuaaggaaaaacuauucaaacaaacauacaaacaggaaucaccaucccuaaaagaacauucugauaggaaaaaagcuacuuacacauguaaacuagaggaaaaaucuaucuuccugggcuaaguguucaguauuaaucuuagcagaggguuuuccaaucacccagaaguaccaaaugaacaagaugaauggcagagcagacaauucauuccaaaaauacucauuaauuuauaacugauguuuauuacuaauucuuauuacuaaaggucauuuuaauccuagcaugggcaacuuucaauccuuucucaugucuuccuacuugguuaaauauuuaccuuuuuaauuuucaauuauuuccuaggcuuacaguauuaaguaaaaaauauuuauuucaagaaaaacuguuaauauucuaauaauaagaggcuuaauaaaauaaauauuuacuuuuugugcaauggcggagaacuucaauacauugaguguuucaucauaggcuaaauaacauuggcugauauugacaaucauacaaauuuucccuuuaccauuaaaaaaacuuugaaaauagugagucaguuuacuuucccggaaaggcacaugcuguugaaaccuacagaaaaaauuuucagaaaacauuguaaguuaaaaaacaucucaugaaaucagggugcugagacauuuuacaaagaaauaauuaagccaccuaucaugaaauuaaacuuuaggguagugauuaguuucagauguaauaguccuucucaguuuucuuuuuaucuuuucuuguuuguuuuuguuuuuguuucuguuuugagacagggucuagcucgguugcccagacuggaguacaguggcacaaucagagcucacuguagccucaacaucuuaggcucaagcgauccucucgccucugccuccaggguagcagggauuacaggugccugccaccacaccugguuaauuuuuuuauuuuuauuuuuaguagagaugaggcuggucuugaacuccugggcucaagcaauccuccugccucggccuccaaaagugcugggauuacaggcauaagccaccaugccuggcuguuuguuuuaacugcugcuacuuacuaacaauaacccacuauguaaauuauaaagaaaaccacauuuaacuggguuauguucccuaguauagagcaaguauauaagagaugucaugaaacacccuaaauagaaauggugaaggcugauuuauauuuacucagccuaaaaugcuaauuaauguaaaaaucuauugcaucuagaaccacacacaaugcauuaauaagaauaaagugguuuuagauccuaaaccagcauuagaagcuucucauuuacagugucuauugguauagauuugccauggaaaauacugacuuuaccugaugaguuacuggcaucaacugacauuucuaucauugucuuuaauccaagaucucuuaaguacuugaaucacaaucuauacacagucauuacauaagaagcaguuuaaaaaucaaaaaagaacuuucuaaaaacaaaaaaguugaaaguuuaaauauuguaauauuuaauaugcuaauaacacuuucagaaacacuuacuuugacuuuucacuauucuucaagacguuaauacacuuucccagagucaauaaagaaguguugauauucccagucucucuuaaccuuucaccuucauucugugucuucauaguucguucugaaccagcaagaucacauaaagauaaucugaauuaagaaaaaaaaaguacuuuaaaaguucuucaaaacaauuacaaauaauuaaauuuaaagaauauucaacuuacucacugacucgaauuacacgagacauuucagaaucuucaaucuguaauauuuuaacagugaauaugcugugacugaaauacaaagaucaaauguuaucuuaucauuuuuaauuucugcauucuaaauaggagagacaaguauucaaaucaaucuuauuuauacccuaguauaacuacaguccaccauugcauuuuccaauuagcuguuaaauauuucaagccaguguucuacugucacuuacauacccaaaugccuaaaaucaccuuuugccuagcucuaaaucccucaaauuauauccugacaguucaacuucuauuaauaguaucauuuauaauaaagcgacauuuuguuugaaaagauaauauuaguuaaaaugauauuauguacagcuagccaauacucugaauacauaccuaaagcaaagcauacauuugaccuauagauccggaucuuguauugucccaugcccaacugacuacgggaacagggcuccuucucuaagaaaaagccugcuuuaauuaucucacugcuuaaacuuauuuccuuugccucucaucccccaaucccaucaaaacuuccuuccuuaaccccuugagauuauacccucacugaguauauuuauauaguauucaggggauaagugagaaagacccagagaaaaggccaccauuauuaccaacuccaaaaauacugagcuuagauacugacauaaagaaagaguaaaaauaccucagagauuuccuauaaauuaauaaaucuacugucaggacaggaaacaguauugauaaacguguuuaguguuauucuguauaccaaauguuuuuuaugccuuaugaauuuaacacgagagaaccuacugcccacuuuaauguaaaauuagcuguguuuaaauuaacacagaauacuaucggugauucgaguuuacucuuacagaguuuauucuuuaccuucuacuggaagcauuauucaauuuugugaaggcaacacucuggugcuuuauuccuaguuuuaaaagucuauaggcuucuuuggaaucagauacuugaauccauuguagaucuuuaaaaaauaaagaggauauauauuaauuuauugagacaaagaauguguucuacaauguaaucucuuugaaagucuuuuccuagugacauauaaugaaaucuuucuucuaacaacacauccuagcuggagucaacucagcuauuucagguuacaccagagaagauuguaacaauguucuagaauguaaauuacacaaacacacaaaauaaauguuugucaacagagucugccaaacggaaaauugaauacaguaacaauuccuuagaauuagacacucagggaaaaaaagaguggcaaaguacaguacagauuaaaccuguaaaauuaccuagcuauuaaacacugaagauuguaauuuauuagugaaucauaaaaucagauuuauugaaucaugaccaguauuuuaauuuuuauuuauuuauuuauuuauuuauuuauuuuggagacaagguuucacucuguugcccagccuggagugcaaaggcgugaucauggcucucuacagccuugaccuccuaggcucaagugauccuccugccucagccuccugaguagcugggacuacagaugcauacgaucaugccaggcuaauuuuuguauuuuuuguagagauggcguuuugccauguugaccaagcucgucucgaauuccugagcucaagugauccaccugccucagccucccaaagugcugggauuacaggugugagccacugcaucuggccagcauuuuguagaaaugacaaagaauauagaaaauauuacagugcauuccuuguaguaaaaguauaauuaacgaaacuuuugaguuguaaauauuacauaugaauauauauacaugcauguagguacugaaucaugauguuauuaauauguguuuccuacugugaauaauuguuuuaaaagguuagaaaaaccacuccggaagaauaguaacauuucauagcuccaaaauuuggacacuguuacaaagcaggagaauaacgugaacauaaccauacacagcuuuucccaucaccacaaauccaauuaaugauacucaagcaaauacaauaccaaaauagacccuuuuauauucaaguuuaauaaauauaccaaaacauacuuccaaagcacaaaauuaucuucuucucuuaauguuaauaauuagcauuacaauuuucaauuuucuauuuguuuuagucuuacagcuaucacaaagcccaggaagagaacuucagagcaauaagauaaaaauauucauuaguauaccuuuuauaaaagaauagcccuuuacgucuugggaaaggcgcagcaucuuucucuuuuggaauuuagaugauacaggaacaaauaagucauaaauauauucauuguaaauuucaaagaaagaaacccacacagaaaauuuuauacuauuagccauauucaaguuggcuuguucauaaucuuuuauggauucuucaaacucugagauauucaaagaguuaguuaaacuuccuacaaaaaaaagaaaaagaaaaaacaaucacgaaaguaagcaacugacuaaaaacgugacaaaaguacaaaucgauucucacacuugaaaaaccaaguaugcuuaaucuuuugaccaucuauguuaaaaacuuuuuggaacaaaggaagauguaaauaauauguggauuaaccaaaguuagacaacuucuuauaauuccuuucuuuuugaaaauauguuaaugaaccaauagaaauuaaauguaaaggacaaagaaaaacaagugucuuucaaauucaauauuaaaauuguaaccaguaaaagggauaucuguaauauuuaauacaaacgaaacaucacaaugacugacauuucauauaaauauguaucauuuuccagguaucaccgacuaugucauuauagaaauuaaauccuuaguaaccaaagaagaggucuauagaaaaaaaauaaauaaauacaaggugaaaauuuuuuuuuuugagacaguuucacucuguugucaggcuggagugcaguggcgcgaucucggcucacugcaaccuccaccuccugaguucaaggauucuccugcuucagccucccagguagcuaggacuacaggcccgcgccaccacgcccagguaauuuuuuuauuuuuaguagagacgggguuucaucauguuggccaggauggucucaaucucuugaccucaugauccacccaccucagccucccaaagugcugggauuacaggcaugagccaccgcgcccagccuaaaaauuuuuuaauaauaaaaauaaaacauuagaagugauuuaaaaauuaaaagcuuuucaaguguacuucauauaaucgauacaucaaagauaagugagcaacgaaaccuuaccauaaagaguaucaucacuaucauuaugcacaguaaccuaaaaaaaagauuguuuuaaaaaauuaaaaaaacauuuucauuaagguuaaauaaucaagauauuaauuaccuauccaaauaagucacuaccaaaucacaaccuuucaucuacucaauucaaugaauucuuuaauuuuuccuaguuaaauaauauaguuucauggaaaaauacagagaacuaugaaaaagaauauuaucauguauaauccugccacucugguugguuacuauuaauauuuuaaaauauuucccuucuauucuuuuccccacacuuauguuguaagcuuuuucuccccauaauuaaaaauuguuuacaacauuugauggcuauauaaaacaugugaaaugacuuaauuauucccuuauuauuaaacauuuaauuuauucaccaaguuuugccaaacaucuuuacauauuuucuucugcauucuuauuauuuccuuagaaauagaaauaaacccauuuccuuggaguauacaccuaaaagugaauugguggaugaaaagauauaaaauauuuuaauguucucacucuuaacacacuauugccaauuugcuuucuagaaccauuuacaauauaugaaagcacauuaucucauuuuuuuuuaacauuuuaaucauuucauaggcaaaacaguaucauguuuuaacuggauaacuuguuagaauuuuuuuuuuuuuuuuuuugagagagucuugcucugucacccaggcuggaauguaguggcgcaaucucggcucacuguaaccuccaccucccggguucaagcaauucuugugccucagccucccaagcagcugggacuacaggugugagucaccaugcccagcuaauuuuuuguauuuuuaauagagacgggguuucgccauguuggccaggcuagucuccaacuccuggccucaagugaucagccugcuucagucucccaaaguucugagauuacaggcaugaaccaccaugcccagugaaaaauuuuuuucauuauuaaugauuuuaauuuccucuaugaauuggcuauggaguuauccaccaauccccauaaauuuuguuaaaacacuauucuacuuucagagaccauagucacagacucaacuuugaacuccacugguaacacacuuuuuacugccuuaaaacccugguuucuaaauguuuuaaaaaagaaaaauuugcauuaauaauaauaggguaaaaauauuuacaaaaacaauuaguaguuuuuaacagccuugaauagaauaaugucugaaaauauacuacaaaauccagaaggcacaagaggaauaaacagacaaguauaacuucauuuuuaaaaguuuauaugguaccaccuuauauaaaacaauaccuccucacaguauauuacauauuuauuuauugucagucuccaugagggcaguaccauuuguccucaaaacugaaaauauugccuggaaaaaaaacagaugacuuaauaaaauuugcugaauagaugaauacugaaaaacacaaugggccaggcuuggcagcucaaacauguaaucucaacacuuuggaaggccaagggaagaggaucucuugaggccaagaguucaaguccagccuaggcaacauaccaagaccccauuucuacaaaaaaaaucaaaacagccaggagugguggcaugccccuguaguuccagcuauucagaggaggucgaggcaggagaaucacuugugcccaggaguucaagacagcagugagcuaugaucauaccgcuauacuccagccuggaugacaaagcaagauccugucucuaaaaacuaaaaaaaggaagaaaaaaaagaaaaacacaaugggggcaggggagaagcaaacaauaagccagaaaauuugcaacccauacacuaauacauuaauaauguauucauuuuuuuaaauacauuuuaauaaaucaguaaacaagaaaagucauacaauacuagauaaauggacaaagaacaugugacaauucacaggaaaaaauucuaagauguacuaaucaacuaauuuacaauuaaaaaaauauaaaguaggcucaagugagccauuuuucaccuaucaaaccagacauuauuaaauauccaaucuuggccugaguuugggaaaauuagcaccaaauauauuugcaauggaauguuucuuuacugaaacacuguucaaaauaguaaaacacagaaacaauacaaauguccaucaauggagacuuaguuuuaaaagcugauuuaaaauuuaaaaaaacaaguuaaagacauaacagauaaaacgcacaugauuuaagguaggaagagauuuaagauacgcuaaaugaaauaccaagucauagaaugguaagcauaguaagaucucuuuuuuguuuaaaaaaaaaaauuauaucauacauauaaaaacaaagguaugaagauauacacaucauauauaugaccauguuuguguauauacagauagaaagcucuguauauggauuuuauauagagagagaaaagguccaaaaacaauacuucccaaucuauuaauaauuuuuucuuuaggaaugaaauuaaaggaaacuuuuacuuuuuacuucucacauucccuauuuuaaauuuuggguacauauuacuuucacaauuaaaaaacagaauuuuaaaaaaucauuacauaaaaagcacaaugcuggcucuacaacaaucaaaaaagauuucagaaccauuuacauuuguauuguuuaaacauucuugcuguugguauaauauaaauacaaaagaugucuucacacuuuaagcuuuauuuuucucgaaaacauaaauaauaacaaaaaacacuaccaccacaaaccagauuccaauauauggugaaacaaucuaaaggguuuauaagaagucaggaauuauacauauuuuacauacuaaaauauuuccauaccucuuuaauuugccgaagcaaugcacuuuugcuagcaauuucuucuuucucuuguucugaugauaaccuuaaguauucucuggaucuaugugguuuaagguucaucuuuguauacagucuuucuugaagacuaucaaauaauacauucaaaguucgaggcagaaugccaauauuuucuucugucccugcaaaaggaauuuuuguguuauacucucucagucuacuaggaaagaggaaacuuuacuuguuuauuaaagcuccuuuuauacuaccaauaggcaagagucaacaacugaaacggaaaugauagcuaaggauuacucaguuuuccaucacuuuguuauucacaguauuaccaacauuuuauugacuauuauucugauguaaacaugaaacuuuacauucagauaaugcaaccauauuaagauuuguaaccacccauaaucacaaacuauaaaaguaaaaugaaauauaaaauuucuucuggucauuuaugcuuaauucucuguaucacaucaauacuuuuucuggauuuuaaucaucaucuaaaucucuaucaauggguaaaguauuuuuacaaaugaauuaaauaaauuugaauuaaaagccaauagcaaggccaggcaugguggcucuugccuguaauccaagcacuuuggaaggccaaggugggcauaucaccugaggucaggaguucgagacuagccuggccaaaauggugaacccccauuucuacaaaaauauaaaaacuagcuuggcaugguggcgcacgccuguagucccagcuacuugggaagcugagcagcucaggcaggagagucaucugaacccaggaggcagagguuguagugagcugagaucacaccacugcacuccagccugggcaacagagugagacucugucccucccccgccaaaaaaaaaaaaaaacagcaauacguaauaauaugcuaguacuauuaaaaauagagcaaacgcauacuagguaauagcaacauaacuacauguauguauuauaaaaacacugagugauuauuauugcuuccuuauccuuuccaaccaaaauaaaacaauauuuaccuugaaauguauauguuuuuccugaauugguuagcccguaaguaaaaaucagacgacucuguccuuucaagaggucuuuuacugguugcauaaugcaacccugaaagaauuccuucuguguaguugcugggccaaaaaccuaagcaaacauuuuuuaaaaacucuuuuuagaaaauucaaguuaauauuaauaguguguuccaucccaacacuacuguuuaaaaauuuaaaagauucauucuuaaaauaggugccacauccccacucccacaaauacauuugauaguuuuacuaccagaaaguuuucaagauagaaaucuguaccagggaaucaaguauucaccuaaguuuugaaaagaauauuucuuaaaaauauauuaauaauaacuuuaauaaaaauauaguaauaauaacuuuaauaacacuacagugaucucuuuacauccaauuauauauuuccagaccugagauuugagucuuauccuuaaaaucuaaguugcauaagcauaaaauguauaguucauuauauacaauuauauagcaauuuagccuaagccaagucucuuuaucuuuaaaacaaaaaacaaaaacacuucaguuuuaccuuggaaaaacugaauuucugugccaucugcccugagcuuuuuucacuuaaccgaccaaggaugcauugaggcucuuucagcacaacagucugugaauccagaauaugcacacagcccuagaaaacauacccccaauaaauaaaaacuaguauuuugccauuuuaaaugaaaguaaaauauuaaaauucuauuaaauucaacacaaaccucagacucaaguucuuuuucugacuguguaaauggucuuauucgaagacaaaccuggagauaaucuuuagauucgaaacuguuugccuuaaaaaauaaaggagaaaaacauuguguuuuugaaagauacggcuuuucagagaccauuuuuccuuaacauggcuacuuuuuacauaauaaucugagaugauaaagaauuucuaagcagucacuauccugcuuuuaauaauguuagaaaaacucaauaaaucuauuuaaauaaaaacaaaauacaccaaaaaagauccaauuuccuccaucuccuguauuuauacgugaaguuuauaaaaaggcuuuauuccacaaaagccuaauauaauuaaugaggcccuaagucauuggaaaauauaacucuagaauaaaucaaaaguaacuagaauauucuauuauucaaaugcucaauuccaugagguauucagaauuuuuuuacuauguaccauucuccuuguuacuuuuucugaggaagaaaugugcauagaaaauguaauuuuaaagaaauguuuuaauguuuuuuuaaaaaaguaaaaaggaaacaacuugauaaaugcaacuuaaucaaaacagacauaacuagaaaaucugaauaacccaauuucuaugaagcaaacugaauccauuuucaaacaaaauaaugccacaaaaaaaaaaauucaggcccuaguaguuuaacaguaaauucuaucaaacauuuaagaaaaugaucaggccaggagcgguggcucaugccuguaaucccaacacuuugggaggccgaggcggguggaucaccugaggucgggaguucgagaccagccugaccaacauggagaaaccccaucucaacuaaaaauacaaaauuagccaggcaugguggugcaugccuguaaucccagcuacuugggaggcuaaggcaggagaaucgcuugaaccugggaggcagagauugcggugagccaagauggcgccauugcacuccagccugggcaacaagagcagaacuccgucucaaaaaaaaaaaaaauacaaauuguacauaaacucuuuaagaaaauauaggaagagaaaauaccuuaacuaauuuugaguuugacauaagccgaauaacacaauugacaaagauauccucaggaaaaaauuagaaaacaaaauaccacauuaagauauacgcaaaauuucccacacaaaauacuagccaauauauaaaacaggauaauacaucugaccaagaaugguuuauucuaggaauauaaagucuguuuagcauucaaaaaucaauccaggcaauuaaccauauuaaaagaauaaaugaagagaaacuuuuaucucuacagaugggaaaacagcauuugacaaaauccaacguccaucuguaauaaaaauucucagcaaaguguaaugaaugcaaacuuccucauccugauaaagggcacuuacaaaaaaucuaucgcuaacaacaaacuuaacaggaaagacucaaucuaagaugagcagcaaaaugaguaauaagaagaggauuucugcuuccccacuucuaguaacauuguauuaaagguucuagcugguguaauugggugugaagggggaaaggggaugggggaagaaaaaaggagggguaagggaaagaaaaagggaagagaaaaggaaaggaaaaagaaagguaaaagggaagggaagaagggaaagaaagaaguggaggggagaggaggggaaagaaaaggaaaaaaaaaauggaaagaaaaaaaggaaaugaaaagacaaaagucauccaaauugggaaggaagaaauaaaauuuucuuuauuuagaaacaacaugaacauacgcauacaaaauccaacaaaucuacaaaaaauuaauguauacuaacaaaaugcuaaucagagguuacuuggaggugugaugggagggagcacuuacaaggagccucaaggaaacuuuugaggguaaugguuauacucacuaucuugacuguagugacaguuacauaaguguaugcacaugucaaaacuuaucaaacugcguaucuaaaauauaugcaguguuucauuaugccuaaauaaagcaacuaaaaauauuuacaauagcaucaaauaacauaaaauguuuauaaauauauuugacaaaagacacgaaaggccucuacauugacaaguauaaaauacugcuaagacauuaaagaccuaaauaaaaugaagaauacuguguucauggauuaagacucaauauugucaagaugucaauucucuccaaacugauccacagauuuaaugcaaucccagucaaaaucccaagaugcugucuuguagaaacuggcaagcugauucuaaaauuuaugaauaugcaaaggaccuagaaaagccaaaauuuuccuagaaaagcaaaacuggagaauucacacuaccuaauuucaagaaucauuauaaagcuacagaaauagagaguauuguguuggaauaaggacaaauaggucaaaggaagagaauaaaauccagaaauagauccacauauacacagccguuuguaaagcaccaaaacaacagggaaaggaaagucuuuucaauagauaaugcugaaauaacuacuuauguaguuaaaaaaaaaaaaauguauggaagcuaaaaagaaaaagaaaaaaguuaaccugggucccuauaucaacugcacacaaaaacuguucaaaauggaccacagauauaacuacucaaaugaaaacuaaaauuucuagaaaaaguaagacaaaaacuuuggggaaggcgaaaguuucuuaaagagaacacacacacaaaaaaauucaccaaagaagaaaagaaaauguuaaauugaaugucuuuaaauuuuaaaaugucugaucaucaagacacuauuaaucugauaaaggauuuguauacauaaagauuucucacaaaacacuaaugaaacaaccuaauuuaaaugggaaaaagaucugaagagacacuuuacaaagaaaguagaaaaauggccaagaauacuugaaagagugcucauuagaaagggcaaacuaaaaccacaacaggauaccauuacacauccacuagaaauaaaaaguuccauuaucaaguguuagcaaagagguagaagcacuggaaccuacauacauugccacugcugggauagccacuuugaaaaacaguuuaguaguuacuuauaaaguuaaacuuauacaguuuguauuccuagguauuuaccaaagaaaaaugaaaacacaaguucacaaaaaggcuugcacaugaauguucaaagcagcauuauuuauaaugaccucaaacuguaaacuaccuaaauguccaucaaacgacaaauggaaauguggcauaucugcacaacagacaacuauuuagcaauaaaaagggaaaaacuacugauguaugacacacgacaaaucucaaaaacaucaugccaauccaggagucaauaaauuuucucuguaaagagcuagacagcuaauauuuuagguucuagagacccuauagucuccucacaacuacucaacucugccauuauagugccacaacggauguaguaaauaaauaaaccaauaagcacgauugugaugcaauaaaacuuuauggacagugauguuugaaauucauauaauuuuuauguuaugugacauuauuccuauuuugauuuuucuuccacuauuuaaaaauauaaaaacaauucuuagcuuguaucuaaguacaaaaacagguaauacaaaaacaggccauuguuugccaacccuugcauuagaaggaggcaugauaaucaacacaauacuuuucuuguacuuaccucaguauuuggagcaacuaaggaaaauucaugagacagaucaagcuuaaugccaucgaaauuuauuucugaaggccuugcaauugggucagcacuaaaaacauaagauggucgagguacucccucuugauuaaaauuagauuccauucugcaagaauaacagcaacuucuuuaacaaccuuaauaagucagcauguaagccacccacacuuucaaaagucuagcccacuacuucccuccaaauaacuagauuuuagaaaagaaacgcauuacauugcuucauuuauaacacaaugcccuacaggaaagacuaaagaucaaauuauauuuacagacucugauucuaauaauacugaacacagccuacuauuuucauauaauauccauucaaagagguuucgugaguacagguaaucuguaaagaugguauaaaauauuuacucucuccgugaaauccucucaaaacucaaauaguaaggagaucacaggguaaauuauaaccuugugucaucuacuuagugacuccuguagaauguuacuuacagacuuuguuuuagcauuuaaaaguuaaaacucaguuaucugggucuggugcgguggcucacgccuguaaucccagcacuuugggaggccaaggcgggucgaucacgaggccaggaguucaagaccagccuggccaagauggugaaaccccgucucuacuaaaaauacaaaaaaaauuagccaggcguggugccaggcaccuguaaucccagcuacucgggaggcugaagcagaaaauugcuugaacccgggaggcagagguugcagugaaucgcgaucgcgccacugcacucaagccugggugacagagugagauuccgucaaaaaaaaaaaacaaaacaaaacucaguuaucugaaaaauuguuuucaauuucaaauucaaguaaaaaguaaaauaauauauguaaacacauucaaaacaguaccugacacaucacagguuuuaaguuaaauaggaauaaugcaucaguaaacuauuaccauugaauuaaacaucaaaucacuaaacuaaaagguaaacuuaaggauaaccuuaacuaaaaaauacuaacauucuaauauuuacugagaaucuacuagauguacaauaccagagagaggaggaggacucugugcuguuuuuugacaagauuaaaaaauauacagaucagugacucccaaacuaagguuccuagcucaagaaaguaguaacgaccaucacccacagguauuauauaaaaugaaccaaagauggcccuugcauaauagcucuacaguguaaacuucuucacagcugguagggaucuuagcucaaaagcccacuggaucaaggaccaugaauguuuaaaauaaaaauuaaaaagccuacggccgggcgcaguggcucacaccuguaaucccagcacuuugggaggccgagguggguggaucacgaggucaggagaucgagacccuccuggccaacauggugaaaccccgacucuacuaaaaauacaaaaauuagccgggugugguggcaugcgccuguagucccagcuacuaaggaggcugagguaggagaaucgcuugaacccaggaggcagaggcugcagugagccgagacugcgccacugcgcuccagccugaacacagagcaagacugcgucaaaaaaaaaaaaaaaaaagggaaaagccugcuggggcgccaaagucaaauucugaagcauccauuuacuuucaaaauggcccaaaauaagcauauuuuuagccauuuagagccugccagguuugaaugccccaugaaacugcacccaacauuugccagacacauaaaacccgggauuaucaagacccccaagccacugcugcccuugagaguuucuaugauccggagacucuccacugugcaacaucauuuaggcauguaagccccucuaugauucuuuccuccccgacuccccauuccccuugcccucuuuccccucuagaugguggccccucacccuggucuagaaaaggucccaaacugagacggauuuccuuugccuacaauccugucaaaauccuuguuuauuccugccaucuuguugucaaucuuuuuccuugaucaggcugaaauuccuaaacguaucacaagaacauaguugacuuuuuuccccuaaauugcaaaaagacuaaggaaagcacugaucuagaucauggguaagggggugcagaggggggagcaucugcaaaacguuaaaguaccggccugacauuucauaacacagaguucauggaaaugcccagaaaacuaaaaaacaccuguggcuucaaauaauaauuuuugguuuaaagaaaaguguugauaaaucuuuuaaauugcugaauuaaaaagaauauuccuauguacuaaaagcaguuauaauaaaguauuuguucauaugcucauuuuucaaugaacaaacuacuuccuagcauuucuaaaaguguucagacuuacuguaacuucuugcgauuuuagaugacuucuacuuauacguggccuucccaacuaaacuggaaacuucuugauggcaagaaccuugccuuauaccacucuguauccccuauaacaaauucagcgacuuaugcagggauaaagacuaccuaaugacuuaaaauaaugguuauaaagaaaauacuauuccaaaaaaaaaaaaaaaagucgguccuagucuguaauauuaucuuucgugacagcaggcuccaagaccucauuuuucauuucaaaaggcugcucugacuggaaaacugcauauuuacccucucuccaauaagaauccacaauuggagacuuuggugaaaaauagcagaaucuguugcugaaugagguuucugaauguggucuacaacacaaagccucaaaaaaagucuucacaacuaaucgaugaguauuuuauguuauuuuuacaauuuaaaaucuggagucuuggacauguaagauaaauacacuguuacacuaccuaacccauaaggcgugaacuucuguaaacuaguaguuuagcaagaaauauaagagaacugugccagacaugcaucacugaaccagcgagcgaaucgagauggagaaagccuucuaaacuggggaaugacagcagucacugugccacaaacucuucagccuggcacugcaaaacccuagaagggcaagccccaaggaccaguaggaguagucuggaaauaagugcacagaggcuaccacagggcuccccccgcaaaaaggccguguuaccuaccagccgagcaaacugcucaccucagagcuucagaaaacuagguguggcaaaacaggccuguuccucaacaacaacagaagcaacaacaauaauaauauuaauaacugcaaacauuuaguaccuacugugugccagcacuaauaacuuuacacauuaccauuuaaucuucacaaaagccgaaagaaauagacacuucauugcagccuuuuaacugauaagaaaacuaagguacagagagagauuaaaugaauugucuugcgucacucagcuaauuagcaguggaggcgagauuuaaaccguaaccgaauuaguaugacucauuccucgcugcguaccccguguucgcaucgcuccgcaacccaguuccugacaguaaccuccacugggguaugagcccugucggaacauguccacauugccaaagccguuuccccaccuuaggccccauacaugcgcagucacccaccuccuuccccacacauucccgcgggucaccuccucaccugcaaacuucgccugacuagccagacccgcgagcagcacugcgauguuaccguuuucaaauucaaacaau

SEQ ID NO: 192792 - RNA, 56283 nt, Homo sapiens
ucaucuuauaaggaacauuuauuugguaaacuaucucauagaaauagacucuaaaaucaaacaguuucuuaaacaacagagagcauaaucccaaucucuccccaugaaaagccuacuucauaacugaaguaccuaaagcccaugaacugcauuacuagaagaaaggagggaaaaagacauuuacuaaacuuccacaggaagacuguauaaaucuggaagugguuaaguacacaucagccuguauccaagaauacuacucagucucaaaaauuaacugaaaaucuaaacuuaauauggauacuucuuuguucuugguaaggcucagaaaauuaccaucuauuuaaguacgcaugguacuaguuacaugucaacugauauaauaaaaaaggugaaguggacaaucaguauuucaaacccaauacagggaaaucacuagauguaaauaagaacuuuuaaaagcuauucuugagcuccacuuuaaaacaaacauucaggacuggaaucuucagaauuuucuaauaucuugaauauccccaucuucucuuuaauugguccugaagcauucauuugaucuaagggaaaaacauuaaaacagguacauuuuagaaguauaagaagaagaaaucguaaaagaaacauccaauaugauguuaugagaagugagucaucuguccaaaauuauaaaacucacaguaauacagggcacucucuuccuuaaucaccaagauuuaauagcagugaaagcaaaaagguacacuauucuuaauacaacaacuagaaucagacucuugggagcauacaaucuaaagcaucaguuugcuagucaaaaucgcuuuugcugaauuuaagguaagauaaacaagucaaagagcaauaaauaauaucaauuugaaucauguugucagaaacguuuuaaaaagaggcccaaucacgauucguuuaauagcugaaaacacaccacaaaaagcuuaccuugagaaacauuuugaaucaaugacaauauguagucuccuaaauuuuuaucaacaugacagcugugaaaugaaaucugauuuucauuuguauuacugauuucuaaucauccuugucuguucaucagacauuucuuucucucuugguaauagccugcucuuauauuauccguuuucauuaucaacuuuuauuuacuugcauauccuaaacacuuccuguuauauguugcaaauauuauuugugguuugucucuuaucucuuuauggugucaucugucuuauaguagucuuuccuauuaauguaauuaaaaucuaugaaaccuaucauauaauuugugauuucuguauuauaaagaauucuaauucuaaaaucauaaauauauuuucuugucuuuuuagguuaaaauucuaccuuuaauauuuagguuuugaacacguggauuguuaauuuaucugaaguuuguaagugcagugugaggagaggagaaucuaaguuaauuuuuccccuauuaauuacuauuuccccagaucaucuauugauuaauaggaauuuccuaucaguuguuugaaguuccauuucacauuuauuagcuuuucgugaaaguugucuuucuagauucaccauauuguacuucuagccaauauaucacaccaugugcuaauucuaccaucuugauuauuaugacuuuuaaauuuuuaauaagacuuuauaccugguauagaauaucuugugcuucaaaacugucuugguucuggcccuuuauuacucucucauauaaauuuuaacaacagucuguuuuacaaaaagucauucugggauuuuuuuuuuuuuuuuuaagagacagagucucgcucugucacccaggcuggagugcaguggcacaaucuccauucacugcaaccuccaccugccagguucuagcaauucuccugccucagccuucugaguagcugggauuauaggcacaugccuccaugccccgcuaauuuuuucuauuuuaguagagacaggguuucaccguguugcccaggcuggucucuaacuccugagcucaggcaauccaccugccucagccucccaaagugauaggauuauaggcaugagccaccacacccagccaucauucugggauuuuaauuagaagaaaaauucaagaauauaaguuaguuuuggggaccacugacuuacacuuuguaguaaccauucauauccacaaauacagcuaaaucugcauguuuacucagucuuucuauuaacguccuucaauguuucauaauucuguccuuauauaaacauguuaaaaauuguuaaacuuuaauuguaggcauguuaauuuuguagcuguuguaaaaaccuucauuauuaaacaauuauugcuguuacacauauuauuaauaagcaaucuucuuaaauucuauuuuaaaagauucuggauucccuuggacuuccuaugaagauaaucaaaccagaccacuugcaaauaaaagcaguuucgauaaugccagcacuuuaggaggaugaggcagacagaucacuugagcccaggagugugagaccagcuugagcaacauggcaaaccccugucucuacaaaauacacaaaacaaaauuagcaggacauaguaaucacaccugcagucccagcaacuugggaggcugagguguggggauugauugagcccagcagguuaaagcugcagugagccaugaucacaccacugaacuccagccucggugacagaacgagacuuugucucaaauaaaaaaaaauuaugaagaugauuacgauauuauggcaaguugguuuuugguaucuaauuaggugaucaucuaguucuccauuauuuaauugauaugaauuauauuaucagauguuaaacaguccuuacaugccucacauaauguuguuuuuuaauauaguuuagauuugaccaugaugcuguaugucucauauuucucccuaaacuauuucaaaguuaaaacucaaauaaacaugcaaauaauccagaauaucuaaaacaauuuugaaaaagaacaaaacuagagaaaguacacuucccauaaagcuaccuuaauuaaaucagugcgauacuggcauaggaauaccacagagaucaaugggacagaauugagaauacagaaauaaauccuuauauuuaugaucaaauuauuugcaucaaggaugacaaggccauccaauagaaaaaggaucaucuuuuuaacaaauuaauauugacaugcaaaaagaugaaaauucauugaaaauagaucauagaucuaaauguaagagcaaaaacuauaaaacuauuaaaagaaaauaucaacaccuugaauuaggcaaagaguaguuacagaugacauaaaaaucaugagugaacagaaaaaaauuuguuaaaauugaaauucauuaaaauuuaaaacuuuugcucuucagaagauacuaaguaaguaagugaagagacaggccagaguagaagaaaauguuuggaaaauacaucugauuaaaaaaaaaaaaaaaaaaacuuccaaccaauauauuuuauuuugauucaauaagacacagaauugaauuuuaaaaugaacaacauauuugaaaauaagauaucaugacacuguagccagugccacgcagguaaauguuuaacaauugggucucaaaaaaaacaaaaacugaggcacaauggcucaugccuauaaucccagcuuacuccaaaggcugaggcuggaggaucccuugagcccaggacuuuuaggcugcaaugagcuauagucgcacuccugcauucuagccaggaauacaaagcaagacccuuuuuuguuaaaaacaaagacugggguuucuaguuucugccuguauccgugauaugaauguuacugccaucaccaauuucaaaagaccaaaaugucacggaauacaguugggaaaaaaagauuauacaguaucuccaccauacagaugcaacagacaaauaaucaauagccuagacgacaguaauauguuguaaaauaauuaggaaauuaugaaguacaaaauauuauuuuuguuuucaaaauaauucauggucaucacuguaggcaucagaucauaaggugguauucuaaaaacugauaaaaaaaaaaaaaagaagcaauauauccuggcucucuucuaucucagggaaacuguaagggaaaguucuuaaauaacccagcuaauaaaagaaugacagaacaagaaaaaucaccauuuugcaaugauuaaguuaauaaugguucuuaucagccacuuucaagggauacuaaaaaucaccacguuaggcuuggugcaguggcucaugccuguaaucccagugcuuugggaggcuggggugggcacaacaccugaaaucaggaguucaagaccagccuggccaacauggcgaaacccugucucuacuaaagauacaaaaauuagccaggugugguggcaggcgacuguaauacuagcuacuagggaggcugaggcaggagaaucccuugaacccaggaggcugagguugcagugagcugagaucgugucagcgcacuccagccugggcgacagggcaagacucugucuccaaaaaaauaaaauaaaauaaaauaaaucaucguguuaaguaaaggaugaaggcugacaagacacuuuauaacauuaucuugauuaaucuuagcucacuggaaauaagaaauccagauacgaugugccuccugguaugacgaaaaauaugagaacaaagcacugguauucuuaacuaagacaggaacuugaauauauucauuuacaaguguuauuuaccaguuuacagaaaauaucugaauuauggaagaaguuaaagauaaugacauuuaugggcaaaaugucaugucugagauuugauuuuaauacucuaagaagaaaaaugacaauaaaacaagauuggauacauguggcugaaugaauugcacaagggguucauuacauuaugcuaauuaaguguauguuucgaagcuuccauuaaaaaaaagcauaauacuuaccaauaagaucacuucgaucuaacaacaacucuagaucuuuaucacuaaugaccuucucucuugauccuuuuauuucccuauagaaaacaaaauauucaagucuaugugaauaauucaaagcuacaaauuaaaucuuucuaaaauuaaaaacucaccuuucauaaucucuagauuuuaauaauuccauuaauuccuuaggaucuaagaaauucuuagacagauuuaauccagacugaccaccuuugaaaugaucuaaaaaaaaugagaaauuaaaaacauuaaaauuccuuuuaaaacuacaauacaacauauuacaaaccaaucacaauggcuugcauuaagaaggacggcaaaaaaaaguguugauaaaaaauaaaagcaaaugaagcucucaggcuucgcugguaggacuggaaaaugauauguccacuuuggaaaaggcugguaguuuccaguaguuaaacacgcacccucccuaagaucaaggaccaaaaaaugcauuauguccacaaagacuuguacaggaccaacuuauucauaauaaccagaaucuagaaauaauuuaaaugucgaccaacaggagaauggaaaaaacaaacuauucaccaauuaaaagaaaaaaauucuacuaaaaacaacacagaugacucuguguugaaaaaauauauucaacaaaauagcuaaacagaaaaaagacucaucagugugacaaaaaucagaauacuggaugcuuccuagugaugguaaggggagcauaggaauuacuggaaagggugaacaaagaaaauuucuuggaugaugaaaaugcuaccuugaucucgaugauaguuacauaggaguacauaaaucuggucaaacuucauuaaccuguacauuuaagaucugugcauuuugcuguauguauguaauaacucaacugaaaaaugucagcauuuaaaaaaaucccuucaaaauuuucuacaaaauuaaucuacuaaaaaaucgaaaauagggcugagcacaguggcucacaccuauaagcccaacacuugaagaggcuaaggcaggaggaucacuugaguccagguguucgagaacaaccuggguaaaaaaguuaaauggucucuuaaaaaaaaauuaugcuuuuuccccaaugcaaguuccaauuacaaucuaaauguuucaccaaauuaauuuugucuaaaccuuaauacacucuuaccucaaaacccagagaaaguauuuacaaguggaaaaggaguauaaaauaaauuauuagugauuuccaacauuacuuuucacauuaacauuaucauguucccauuucucuagggcuugaugauuuacauaaaugauuuucaacauuucuucagguagcuaucaagccauuuauucaaagaaaauuuuauggugaauggauagaaguauaacuucucuaaggaaucucaggaacaaaacuuuuucaccuaugucaguuccccaccuccucagaauuuuuucuagauuaaaaagcauuguugagacccaucugguuaugauaaggaaaugaaaaaggaaaaaaaaguguccaaaacuauaaaaagggcauucugcagugaaauauucugugaaacaguggguucaauaaauaaauagauuuuuuauaacacuuaaauacacuuaauauuuuaauacauggaacuugcaaaauauuuaucuuaaaacuuuuagcaagccaaucucuuaucaggaacauguaguuauccuugaccccuuuucucugcccaucugcucuucaucuacauaucuacauacucgcuaacauucuuucuuuuaugucuauggugaccaacuuaguuuaggcucccaaauuccccacugcuuauuuaaauccugucauaucaggcuguuaauauuuuuuuuuuugagacagagucuuguucuguuacccaggcuagagugcaguggcacgaucucggcucacugcaaccuccuccucccggguucaagcgauucuccugccucagcuuccugaguagcugggauuacaggcgcccgccaccgagcccagcuaauuuuuguauuguuaguagagacgcgguuucaccaucuuggccagccuggucucgaacuccugaccucgugauccacucaccuuggcaucccaaaguacuaggauuacaggugugagacacagaacucggcccaggcuguaauauuuuauaaacaaaauaaaaacaaaauccacaacacacaaugcacaauuuaaacaauaaagcacuacauaaguguuauuuacuuuuauggaugaucaacuuuuccaguuuccuuuuagcagcugcucuuuccacaauuuucugaucgauaguauuugcuguaacaaggcgauaaacaacaacuggcuuugucugaccaauucuaugacaucuauccugggccugaagauccgacuggggguucuuaaaguuaaaaagaaaaauaauauuuaacgguauuagguuaaaauuaacauaaacucauguggauaaagucaacaugaaugaucuagccaggaacuuuuaaauaguggugucuuaauuuaaacuuccagaguggcuucauagacaaaauuaucauuccacagauccuugacaauauuaacaaaaaaguuuaaauacccuaaagaaaacauuucaggaugggcacgaugacucacuccuauaaucucagcauuuugggaagccaaggcaggaggaucauaugaggauacaagaccagcgugggcaaacagugagacguggucucacuaauuuuuacauuuuuugugggcaugguagcacacccauagacccagcuacuugagagaaugaggugggaggaucacuugaauccaaaaggucaaggcuacugagccgugauggugccacugcacucaagccugggugauagugagacccugucacuaaaaacaaaaguaaaaaaaaauuuucaauuuuuacuugcaaaaaacuuuaugaagaaauaacucuuagcugaaaauggguaucuuuucaaaauagauaaguaaauuuguaacauguaccauuaaaaauuaaaaauucagaauggccgggcgcgguggcucaugcugguaaucccagcacuuaaucccagccugggcaacaagagcaaaacuccuucucaaaaaaaaaaaaaaaaaaaaauucagaauggaggcugggugugguggcucaagccuguaaugccagcacuuugggaggccgaggugggcggaucaccugaggucaggauucaagagagccuggccaacauggcaaaaccccgucucuacuaaaaacacaaaaauuagccaggcauugugguguacaccuauagucacagcuacucagggggcugaggcaagagaaucacuugaacccaggaggugaagguugcagugagccgagaucgugccacugcacuccagccugggcaacagagugagacuccauuucaaaaaaaaaaaaaaauucaaaauggaaauauaaucagcauauuccuugcuauacuuccaacuuacccaaucacuaucauaaaugauaacuguaucugcugcagucagauuaaugcccaggccaccagcucguguacucacuaagaagauaaacaccucuggauccguguugaagcugugcaucuaaaagcaaaaaggauguaaauacaacagauuaaaauaaauuaaccaacaagacugaaggagaaaaauguuuucaauuacaacuauuaaagacuuaaacaaaggaggccaaacaaaucauucagaucuauaaaacaauuauguuaacaaaaccugugcuguuagcuuuaucguccaagcaccuauauuaaagagaucuuaauuuuguuaaaaaccauguaucacaacaauguuuaaauaagaaaagcuaauaucaaaaaaugaugaaaaaauuguaguugucuaaacacauggggugggugcaggggagaauugacuagaagggggcacaggaaacuuucugggcugaugguaacauucuauaucuuaauagggguuagguauaaauuuacauaugcauuugucagaaagauucagcaaauguauacauuauuugcuucaguauguguaaauuuuaccccaaaagauaaaauaugcugaagucauuacggaaaaggguaguaucaucuauauuuuauuuuuaaaugcaccaaaaaaccaggauuaaaugcugaauggauacagcaaggcugcuauuacaggaaauguguuuuuaaaaagguauagucaaauguuaacagcagauuguaggcggauuuacaguugcuuuuuuuuuuucaacuuugccauauaguugauauuuucauaauagaaaguugaggacagggcaaaaaggcaaaaaauuuccugcuaucccaauauucuuacagugaugguuaaguaggauauuauuaauaagauugugccagaagauauauauauuugugaaucaaaaauuaagacuucuuaguacuaaaucaaaauguuuguuuuugauaaaaccacaggguuucuggucauuucuaucuuuuuaucaauuugugggucuauuuggaauauuacuucagaaaucaagauaggaauuauaaaagaauaguuugguauguaugacauaaguagucuuacguuuuuuucucucucugaguaagacauggacccaucaagccugcugaaguugaaaucucugagauggcaguaauccaucaaaauguccaacaugcuugucauuugugaaaaaagcagcaccugaaauuaaacauaucuuaauauuucuaaugauugauaaaaaaauaauugaacaauccaaaauuccaaucaaaaguaccaccuugugaccucuuuuuuuuaguucuggcagcauucgauccaaaaucaagaacuucccagaauuuguuaccaauucuucaucgaucuuaaggaggggcaaaggaagaaaaaauagagagaaaacuguuauuugcuuuguuaaaacaaaagccauuuggaaaguucaauuuucaaagccaagucacuuaaaaaacuuaaaaacugaccuguuauucaaucuuuguaaaaucagaagauaguuauuacucaaagacauacucuagaauguaaaaccagcaauuucacaaaaacaaaguacaaauauaacuuugaucuaaccucaacacuccucucucaaagucauugugaaagaaaacaauuaugucaaacuuaauggguacauacucaggcuuauucuuuauaagugaguuauuuccaacuaaauguauauguaaacuacugcuagaauucuuaccagaaauuaagagaaaauacaggagcugauaaguaaucuaaauauuguggacaaagacuuuuucaccuucuggugaaauucccucaugagagagcuacuuucauuugagugggaaaguuuugucuuccuucuuacucuaauaaagauguaaagcagugccucucaaauggggacaauuuugcccuccaccuauccccaggguauauuuggcagcggcagcaaacuuuuuaguugucauaacugagggaagugaauacuaguggcaucuaauggguagaagacagggaugcugcuaaauguccuaagugcacagaacauuaccuccuaagaaagaauuaucuggcccaaaaugucaauauugccaggaguggaaaagccuauuguaaacuaccuugaaacaacugugauugaggguuacuaagaauuuauuucuauugauauuaugcuaucauucuaucaacuacccaagaaagcaacuucauuuacuuaauuugaaaaccuccaaaucaaaacugguuuuauucuauggcuaccuguugaucuuuaagcaaugagcaaccaggcugauuuugauaagccaaauauuaaugauaaaagaaauagugaaaagaugaccacucucucuaaaauauaacaaguaaacaugcagaguacaaaucaauuacuaaauuuagaauucuuaguuguucacauaaaauauguaaauaaaaauauaaguugcauagaggccaagcgugguggcucuugccuguaauccuagcacucugggaagcugaggcaggauugccugagaaaccaggaaguuugagaccagccugagaaacauagcaagacccugucucuauaaaaaauaaaaaaauuuaaaaaacuaguugcucauagaaagugaccauuuuucuaacccugauaagguucucugaaauuucggaaagaagacugucucagcuuacugaaggauuacaaucuucaugacaaauagcaccauacuuauuuuuaauaauuauaaucaaaaaaaguaacacuuuccaccaauauaaaaguaauggaaaucaaaacaguaaauuagaauuaaacaguauucaccuuaaauucuuguguaacagggucuauaggauauucaaucaaauauggaugauuacaacauuuacgaaguagcaucauuauauucugcagcuucagauuaacuucagauucuacagggauauucacuuccacaacagcucuaccaaaacaaauaaugcauauaugggaaaugcaaaaaauggucacaguuuaaagaauacuuaaauucacuuuugaauucaaaccuuucucgguccaccucuggcuguauuugacugaucaguuuuuccaauucauuagggaaaucaucuauuuugcuguaauuuauugauuuucuaguucgucguuuuggucgaccaguaggacuuaacucaauuguuucuuucuaaaagggaacgaauuaaaagaaauucaguuuauaaagcuauguccuuagguucuaaauguaaacaaaauaaggcauauuuuauguacaaaaugacaaucuauagacaaauacaaauguugugggaaauuaguuuaauuuuaacauggacaacaauaucugaaaguaagaggaagggccuucauaucucaauagguaaaaaugaaggguguauaaaacuacuuugaacuuacacaaaaggauuuaauaccuuaaaguugaaauauggcuccggaaauuugcaguacagaggauauuucuucagacugguguaacacugcaugaaacugcucauuaugaaauugcucauuaacagacaaauaauguaaauuuguaaacggcuagacccuuccuuuaauuauaauuaauuauuaaaaagggagaagaggccggguacgguggcucacgccuguaaacccagcacuuucggaggccgaggcgggcagaucacaaggucagaagaucgagaccauccuggcuaccauggugaaaccccgucucuacucaaaaauagaaaaaauuagccaagcgugguggcgggcgacuguagucccagcuacucgggaggcugaggcaggagaauggcaugaacccgggaggcggagcuugcaguaagccaagaucaugccacuacacuccagccugggcaacacagcgagacucugucucaaaaaaaaaaaaaaaaaaaaaaaagucggggggagaagagucuggugguccuauuguuuaaaaaugcaucacaauaaauauuuugaaaagaaaauacguagguuuauaguguacaauaaaaaaccuggaaaguuaaacaaaacuuaagggucuccuucaguuacaugauaauaacaucccaccucuaucuccuauaauauggugggugaugaauaaucaucaucaaauugauuauuaaucuuuuugguuaucaauaaccuucuguaaggaaacuguacagguagaacaucccuaacgggaaaauacaaaugcuccaauaagcauuuccuuucaguuucauaucagcacucaaaguuucaaauuuuggagcaacucagauuuuggaugcucaaucuguauaucuggagauuagucuaguugccaaguccuuaguacagggauucucaaauaccuaccugugugcuuguuaaaaaugcauuuccaaguucaucuccagaaagcaugauuagaguuaaucuguacggaaauauacauuuuuuuuuuauuuauuuuuuuugagacggaguuucgcucuugcugcccaggcuggagugcaaaggcacaaucuuggcucaccacaaccuccgucucccggguucaagugauucuccugccucagccuuccugaguagcuaggauuacaggcaugcgccaccacgccuagcuaauuuuguguuuuuaguagagacaggguuuucuccauguuggucagacuggucucaaauucccgaccucaggugauccacccgccucggccucucaaagugcugggauaacaggcaugagccaccgugccuggccuaaauuuuuaguaaguauuccagaugacuguaaagcaauuaauacaaagauuaucacuuaacauuuuagcaggacuccagauacuaggaaacaacuuuugccacuaagccuuaugccuuauaccccaguuagaaauucacccaaguccuaaaaaugaacaaggggaccuuaaaacuggaauuuaggccaggcacaauugcuaaaaccuggaaucccagcacuuugggaggccaagguggguggacugcuuaagcccaggagucugagaccaaccugggaaacauggcgaaaugccagucucuacaaaaaaauacaaaaaauuuagccaggcagguaaaggcugcagugagcagugauugugccacugcaccacagccugggugacagagcgacaccuucucucaaaaaaaaagggaaaaaagagaaauuuuauaugucaaguuucauuuacaguacauuucaaaaccacuauaccucacuggauccaaacauguuugcaauuguacgguucacaauggcuguauaaaagaucuccugcuucuuugaaaguggagcauaaacgacuacuucucguuuaggaggaacuucaagagcaacaucagacuucagucuucucaauaagaaagguguuaaaaucuaaaauuaaaacaugaacagaaaaauaugaguauuaaacauucuuguuuuucaaggaauacuguccccauauacuccuuuaccuuaucuuuugacuuccuauauaaauaaugccaaaucucaaaaggugaaaauaucuugagauuuucccagaccagaccaaaugauaaacucacaguuguccgcagcauuucagaauuuauuuucuuuuaaaaacuguaagaaucuaucucaaauaauuuuaaaaguaaaaauauaaagguagcauuuguauuucuuaggguugaaguuucaguuauagcccacaacuuuuagaaugagauguuaucagcaccauacaaaaggggaaauaauaaaaaugaauaaaaauuaaaaauauuugaaauaaugaguacaaaaaguagaaauaauaagaccuaauauuugguagcacaacagggugacuacagucaauaauaauuuaacuuuuacauuuuaaaauauaaagaagaguauaacuagaggccaggugcgguggcucacacuuguaaucacagcacuuugggaggccaagacgggugaaucaccugggucaagaguuugagaccagccuggugaacauggugaaaccccaucuccacuaaaaauacaaaaauuagcugggugugcuggcggguaccuguaaucccagcuacucaagaggcugaggcaggagaauuguuugaaccuggaaggcagagguugcagugaaccaggauugugccacugcacuccagccugggugacagagcaagacucugucuccacacacacacacacacaaaaguguauaacuggaucauuuguaacacaaaggguaacaaaugcuugaagggauggauaccccauucuccaugauaugauuauuaugcauugcauuucuguaucaauaucaaaacauauaccucauaaauauauacaucuacuauguacccaaaaaacuaaaaguuuuuuuaaaaauuaaaaauuuuuuaauagaaugagguuuuaagacucaguaaaaagccagcugaccuagggaugcagacauacaaguuuccuucuauaaguucuaaaguuucaggcuuaaaauuauucucuuucauuagcuggggugguuacaaaugauuaucacauuuauaaagagaacacagaagcaacagacaauaauuaugcauuaaaauauucgggucacuaaaagagcacaaauacuagauuaaaaucauuguauacucuaggucggacgcaguagcucacaccuguaaucccagcaguuugggaagccgaggcgagcagaucaccugaggucagaaguuugagacuagccuggccaacauggugaaaucccgucucuacuaaaaaaacaaaaaaauuuagucaggcgugguggcgggauuacagaaucccagcuacucggaaggcugaggcaggagaauggcuugaacuugggagacagagguugcagugagccaagaucuugccacugcacccuagccugggcgacagagacguugacucaaaaaaaauacuacuacuacuacuaauaauaauaaacaaauaauuguauacucuuuauaccccugccauuaaauacugacaaugguuuacauauaguaaucauauauaauaaagcucauuuucaggacucuggacuuaaauacccaacagguauagagcuaaucauagacagacuauuaccaaagauaguaaacacauuaccaguguugguaucuaccaacccaaaaacaaauaugccgacaggcaaucaggaaaaauauguaaauguuucauaaacauguuaaaacauguccggccgggcgcgguggcucacgccuguaaucccagcacuuugggaggccaaggcaggcggaucacgaggucaggagaucgagaccaucccggcuaacacagugaaacuccgucucuacuaaaaaauagaaaaaauuagccaggcguaguggcaggcgccuguagucccagcuacucgggaggcugaggcaggagaauagcgugaacccgggaggugcagcuugcagugagccgagauugcaccacggcacuccagccugggcaauagagcaagauucugucucaaaaaaauaaaaauaaauaaauaaaauuaaaaaaaacauguccaugucuguaaggaaaacaugaaauaaccagauauuuuucuaccacaugcacugacaaaugcuauaguuugauguuaacugaaauggcaaauauguggaagaagaggcacacuauaccgcugaaacacauguauaaaaaagguauuuauauauguuuuuccuaguauacaagcuuucaaagcagacaaaaacaagacuuauacaagacccaucuaccaaaaauuagcuggaccugguggcaugcaccuuugguuccagcaacucagaaggcugaggcaggaggaucacuugaacccaggaguaugaguuggaggcugcagauaacaacccaauaaccaacgauggcaccacuacucuccugccuggaugucauaguaggacauugucucuaaaaaaaaaaaaaaaaaucuguuggccaggugcaguggcucacaccuguaaucccagcacuuugggaggccaaggcgggcagaucacuugaggucaggaguuuaagaccagccuggccaacauggugaaaccucgucuccacuaaaaauacaaaaaaauuagccaggugugguggcacacgccuguaaucccagcugcucaggaggcuaaggcaggaaaaucgcuugaaccugggaggcagacgcucacugcacuccaggccugggcaacagagugagacucugucucaaaaaaaaaaaaccaaaaaaacaaaaaaaaaaacaaaaacaaacaaaaaaaaaaaacaaaacaaaaaaacuauuaguuauacuuuggagauaagaaaggaagugcagaaggaaaacagaaauuuuuacuucuuacuuuuuaauuucuaaauguuuauaacauuuaaaaauaucuuaccguguacgcauaauuuuaaaauaaaaaauuuuaaauaauuaauuuguaaagguuauacugcuuuuggccuucaauaugggguggaaauagaaaaguagcaagcuuagagaacuuuaaacggaaaguaaaaaaaauuuuuuuuacuaugcaagguuuauguaaacauugcauaaaaaaaggaaaggaauucuuucauauagaaaauaguuaagaaaauauacuagcgauuuaaaacuaucuccaccuaaucugaauucauuuugaaugaaaacuuuuuccuguaguaaugcauuaaaacauaauuaggacaaagcguaaaaguaauauaaacucaaauuuaagcacaguauuacagagaauauucuuauugcuagaacauucaaaacugccccuauuuuugauaaaacuguugaauuuggauauaauaaaaguucauuaucauaucuuaauauuaauggaaaucugaaguuaucuauaguaaaacaauuccagugagcccucuuauggaauuaucaacuaugacaauuacuacaaauguucaaucaaaaggcagaugaucauuucuaaggaauaucuaucuaccuguauacacugugagguaacguguaagugacaaauucuauaaauauucauugucuugacucuaauuaaauuuccuaagaacagaaacuuaauccuuugcuacacuauauggauguauacacuacugaugaggaugugauauccaaacacaucucuuccuaaauaagucauuuacuccaauaauucagacugggacauuuaaaagcuucuauaacuauuggugcauugaaauuucugucauugcccagagucacagugggaaaaaaagaaaauuuuaaauauaaacacacacgcuugugcacaugaacacacacaaagauaccauaaacaaaguuuaucccaaaaagugaggggaaagaaauuauuugcaacauuaacuuauuuuuaacauauaguuauuauaaaccauuaauaaauaaauauuccaacacauguuggaauauggccacaaggaacuaccaauagucaauaaacaucucaauucagcaauaaucauccuuuuuaaucucugcaacacugaaaaggacuucuaaccucaaaauugguaugaagcuugaguaaauaaguauuuucauauggacguauaucauauaaaucuuuucuggagggcaauuugccuucaaagaagcccucaucuguaaacucugacacauacauucuaggaauucuuuccuaaggaaauagccagaaaugggcaaagguguaguuuuaaauacagauacuacaaccuuguuuauauuguugaaaauuuugaaaagaggaagagauagauauuauuaauuauaguagaacaagacaaugggauaauaagcagcuauuaaaaacugauuuaaaucuacauguaguaaaaggaaaauaauuuucugauaacuguuuaaaagacuaucuuaaggaacaauuuuauuuuuaaaguccuuuucuucauaaaauauagauaaaacacacguguuuacacaaagacagaaaagaguuuggauugucauauaacacaacauaaucauuccacaugcacugcuaggaaauacaauuuuaagaggaagugauauuuuuacuuuucacuucucuccugcuucacguuuuucucaugaacauguauaaacuuuaauaucagaaaaaacgauaaagacuuugaauaaaauugcuaaaccacaacugagaagcuuuucaggcccauaugacuagauuacccuugaaagauaauguuucucuaaauuaaagauagguaggaugggguaggaauuacaggaagcaauaaaaauagauuagacagcagccaugcaaggauguaaauuauaaaaguauuauuggcaagcauuccauaaaaaccacauacuucuguuuugugcuugacaaacuuaucaguaaccauuagggguaaaaugaguauacuaucugaaaaggacaaaacuuagguaagcacuugaguucugucauaaaaccaugugaccucugggagaagaaaggacaaaggagucauuuaaauguaggaggaucuucauuuuucaaaucucuacuacaaaggguuagacaggugaucuccagaguuccuuuuauacucuaucgagccuaugguuaagcagaauaagaaaacauggaaaaccuggugcagcauaugcaauacauucuguucucuuucuuuagcaauaauaucuucagcaguuucagaaagacuagugaugucaaaccaagacucaaagcuggaagagaaaaauguuuaaguuaaccaucacauaaauucaauuaugucaacaugauacaugauuuaucauuuacaguaauaaucugauaaugaaacgugguauuguugcaucaaauccuuaggugcaauuuuuaaaauuuauaauggaagagaacacauuccaacaacaaagauaaauugguugcauuuuugaaccaucaagaacugugagcuuaaagggaacacuuuucugauuuauaaauagauuaacaauuguacaguaguauaaaaaucaaaaauaagauuaagguauauauuuauaauuuuacauuacaaaagugagaacuaucucugaaaaccaaagccauaugauuuuucuccaucagucuaaguauggcccacuacaauaaauauuuuaaaauucaacauauacauaacuugacaauaauauacaugcuuauuccuucccaauguugaaaauauauauauuacaaugagcaauuaaguaugagcaugcagauuaauaauauagaauagguaacauuauacccaauucuggaaaaugcuaguaacauuuaugcaguagacuagaaguucccaaacuuggaucaccagaagcauguucaaaaaacucagauucucaacuccuaccuugacacuguaacucaguaugucugcacaggaccuggaauucuugucuuucaauaaaagcgcccagagucacaauaagguagccugccuugagccaccauucgguaaccagauuugaaauaaauucccaaaauuuaaaauuauuuuuccacacccaauuagcuuacuuccuucacugaugccaaaacaaguauaaauuauuuuuugcccaaguuauauuuccguuguaaucaguuuuaaauuaugucaacauuaccuccuccuccauucugaagcuacuaauuacuuucugaaaacuacuuuuaugucugauuuuauuauauaagcuaagauucaaacaguuuccagaauuaaaacacuguguuuacauugggagaccuugguuuuaacuuuggcucuggugcuaacuaacuagucuuaucuuguaacaacuuuacaccuagguuuucuuuuaugugagauaggaaauaauuuaacaacucuauugucccugguuguuuaaugaggauauaguaagaaaaauccaucuuaaaauguuuuacaaagguaacacauaaaagaaccuuauuauaaaaauauuaucuuaaaguugcauucagcagucuuccuuuaaucaaugcaaguaaguuuuaaauaaucuuuucuuaaucugcucucacauaauuuguggcaggaguagaacauacaauauacaccacaaagaacuugccaaauauuuggcauuuuaauucagucacugaaaagaaaguaauuuuaacuaacagcacagauuuuugagguuaaaucauuaaauaacuggcuuacccaccuuuucaagucaucaaauacaucuggcaacaaaaaguuuagcaaugaccaaaguucugauaaauuguuuugcaagggaguaccagucaaaagaaguuuguuaucagcauugaaucguuuuaacucccugauuagacggcacuucauauucuuaauccuguguccuucaucuacuauuaaguauuuccaauagcaaugcuagaaaacgaauugaggaaaaagauuuuuaaacaaugaucucacaauuuuucuaacaagaauucuaaaaauaaaaccucuauuaugagggauggauguugaauuuuaucaaauguaauuucaguaacuacugaaaugaucauguuuucauuugauccacuuacaaggauuccuaaaacugauagauauuucuguuccuggaagagaccuacuaaaauaugcaauaaaguuugaacuccaccuauuuugaauuuaagauuucccuauucacaccuuagucaacgcaguuguagcuuucuuuucuaauauuuucccaaguuuugauauuaauguuacacuagacuacuaaaaauugagcuuuuauuaguuccauaugugcugaaacaucaaauagcacuagaauuuucccuuauuuaagcaauuuauauuuucacagaaagucacccacucacuuucauaaaguuaucaaggaaauuguuuuaacuuucucauuuuaauaucugugauuucucauauaucuuaaucaggaaaauuuauaauuaaucuaauuuauauuaacauacagaaauaugaaguauuucuggaaauauaaauaacaaucugaaaaauauaacuauccuuaaaaaaugggacugacaaauugaggaaagaguauagagaacguuuugcauuuugcuuuauacaucccaaaagaaugaaaaaaguuuauaguacuguaucuucuuuauuaaaauaaccaagaaaggauuuauuuuccuggcaauauguuaaaccaaaaaaccugaauuaucucucacuguaagacagcuaucuaaaaauccagauaaaaauauaaaauauccuuggccgggcgcaguggcucaggccuguaaucccagcacuuugggaggccgaggcagacgcauuaccugaggucaggaguuugagaccagccuggccaacuuggugaaaccccgucucuacuaaaaauacaaaaauuagcuggacguaguggcacaugccuguaaucccagcuacucaggaggcgaggcaggagaauugcuugagcccgggagacagguugcaguaagccgagaucgugccacugcacuccagccugggugacagagugagacugucucaaaaaaaaaaaaaaaaaaauguguguguguguguguguguguauauauauauauauauauauauauauauauauauauauauauauacuuuuauaauggguaugugagagaaaagaaaacaaggaaauaaaugaugaggaaucugaaagccaaauuagcaagugaacucagucacuuccacucgcacucagcaacaaaagcccuggaaccucacacuccguuaccagaguaagcuaagauccuugaaaugauaauauaagcucacuuaaauggaaaaagucaaaaguuucuagccacuggcaaaggaaauggacaaggaagcuuaacuauuucauuacaggaagggucuucauguuauacuacugaguagaaaacacaaguugcaaaagugaaugcaggcuggaagugguggcucacaccuguacucccagcacuuugggaggccuagacaguuggauggcuugagacacccuguuccuacaaaaaaauacaagaaucagucaggugugaugacggacgccuguagucccggcuacucaggagacagagguaggagaaucacuugagcccaggagauucaggcuacagugagcugagaucgugccacaggacuccagccugggugacaaagugagacccugucucggaccaaaaaaaaaaaaauugaauguauaguaugaucauauguguaaauuauaccuacauguuagcuauaauuauuuaguauaaaaguaguaguucucugggaggcugaggcgggcggaucacgagggcaggagaucgagaccauccuggcuaacacagagaaaccccaucucuacuagaaauacaaaaaaauuagccgggcaugguugugggcaccuguagucccaacuacucggcaggcugaggcaggagaauggugugaaccugggagguggagcuugcagugagcuaagaucgcgccacugaacuccagccugggcaacagagcaagacucugccucaaaaaaaaaaaaaaaaagaaaaaaguaguaguucucagguagaauuacaggugcuuuuacaucuuccuguacacuacccuuuaaaaaaaauugguauauauuacuuuuacuguaaagaaaugcuuuaaaucagggguccccaacccccaggucacagaccuguagggguccauggcauguuaggaaccaggccacacagcaggagguaagcagcugugagcgagggaagccucgucuguauuuacagaaaagggaagcuucaucuguauuuacagccacuccccacugcucacauuauggccugagcucugccucccgucagaucaggagacauuauauucucauaggagcaugaacacuauugugaacugcacauccaagggaucuggguugucuggguugugcgcuccuuauaaaaaucuaaugguggaugauuugucacugucucccaucaucccuagauggaaaacaagcucagggcuaccacugauucuacguuauguugaguuguaaaauuauuauuauuuugagacacagucucacuugguugcccagccaaccaagcggcaugaucucggcucacugcaacauccgccucccggguucaagcaauuauccugccucagccucccaaggagcuaggccacuaugcccagguaauuuuuguauuuuuguagagaugugguuucaccauguuggccaccaucuuggccaggauggucucaaacuccucaccucaagugaucugcccgccuaagcuucccaaagugcugggauuacaggggugagccacuacggccagcccuauuauuucauuauauaugacaauuuuauaauaauaaaaauaaagugcacaauaauuauaaugcauuugaaucauucugaaaccaucccccacccaugguccauggaaaacuugucuuccacaaaaccgguuccuggugccaaaagguuggggacuacugguuuaaauuuuuuuuucuuuuugagacagacucucacuguagcacaggcuagagugcaguggcgcaaucacagcucacugcaaccuccaccuccuggguuuaagcaauccuugugccauuaaacaugugcaccaucacacccagcuaauuuuuguauuuuuuuuuuuuuuuuuuuuuuuuuuugagacggagucucgcucugucggcccaggccggacugcggacugcaguggcgcaaucucggcucacugcaagcuccgcuucccggguucacgccauucuccugccucagccucccgaguagcugggacuacaggcgcccgccaccgcgcccggcuaauuuuuuuguaauuuuuaguagagacgggguuucaccuuguuagccaggauggucucgauauccugaccucaugauccacccgccucggccucccaaagugcugggauuacaggcgugagccaccgcguccggccuaauuuuuguauuuuuaguggagacaggguuucgucauguuggccaggcuggucuggaacuccuggccucaagggaucugcccaccucagacucccaagugcuggaauuacuggcauaagccuucaugcccggccugguuuaaauacuuuuuaaugcuguacacauucauaaacuuugcuaaacuccugaacugagauuucugcaaaucauauuccaaaguuuuaccagcagacacauaaaaccugacaauacuggucauaauuaugcaagucauaauuauucuauuuaugacuuauguguuuugauuuuauguugaaaccauuaaauacuuuccuauuuccaagcaagcaagauaaaccuaaggggacugcacuaagaggguucucacauggccagagaaaggaaaaaaaaagcagucaagaauuauaaaugaaugagguagagcagugaggaagaaguucaaaacaccaauaaaugaaaacagaaggcaugaaagaaaaaaggucaaucuuucaauucuguuaugcuaacuggaaauuauuuaaauaaguagcuagaacaucaagaaaauagaaacgaaaaugcuaccaaauaguccaauaagauacucuaaaaauaacuugucuucaaauacucuuauuugauuaaaauacgauaaguaaauuccauauauucaaaguaccugucacaaauauaucuguaauacauuccgagauuaggucuauuucuggaugauucuaagccauagguuaaacugccauaagcuuuaauuauauuguuacaaaugauggccuucaucccaaucauucuguuaauaaaaguuuccagcuucuacagguauaugcacaauauaaucuauuauuucgacaacaaaaaaaaauuagacaaaugcucccagauggugagaaagugauauaaaugaagaaaagcauguuuuauguauuacaaagaaaccaaugaagaucauuuguaccuguaacgcauuucggucucucauggcuauuucaaaugacgugauuaccacaggaugaaucugcaaagucccuuuccguuuguaaauauuucuuaccaauuuuugacguuccuccuggguuccaugauauaacauuguagggaucugaaaaauuuuauauugauuuuuaucagacuuaagaacaaaauguaaauauugacuauuuagaaaauauaaaucauucugagggaaaaaauauaauuuuaaaaaauuuuauuucuauuuuucuauagcaaaauaagccaagcaauucuaacaaaucauugaacuauuaugggagaaaaugaaaaaaaaacaaacaaaaaaacaaagucaggcccagcacaauggcucacaccuauaaucucaacacuuugggaagccaaggcaagccgaucucuaaaguccaguaguucgagaucaaccugagcaacauggagaaaucccaucucuacaaaaaauacaaaaauuagcugguguggugguacgcacccguagugccagcuacucacccaguggagugagaugggagguucacaugagcuacucaggcgugugagauagcaggcucacaugagccugggaggugaaggccacagugagccagaaugacgccacugcacuccagccugagcaacagagcaacauccugucugaagacaaaaaaaaaggcauaaaaacaaauagacgggccaggugggauggcucauaccuguaauccccagcacuuugggaagcugaggcgggcagaccaccugaggucgggaguuccagaccagccugaccaacauggagaaaccccgucacuacuaaaaauacaaaauuagccaggcgugguggcgcacgcccguaaucccagcuaccugggaggcugagacaggagaaucgcuugaacccgggaggcggagguugcacugagccgagaucgugccauugcacuccagccugggcaacaacagugaaacucugucauacacacacacacacacacacacacacacacacacacacacacaaacacaaccccccccccaacaaaaaaccuacaaauacauaaaacacauauaggcugggcgcaguggcucacaccuguaaucccaccacugugggaggccaaggugggcggaucacaaggucaggagauagaggccaucuuggccaacauggugaaauccugucucuaccaaaauacaaaaaauuagccuggccuuguggugugcgccuguagucccagcuacuacacuccagcauggugacagagacagacuccauuucaaaauaaauaaauaaauaauauauauauaaauauauaaaaugagacagauggugauacuacgucuagaauauauauauuucucauaaggcaaaaaugugcagaagggcugggcccgggagguacaguggcucacgucuauaaucccaguacuuugagaggccaaagugggcagaucucuucaggccaggaguucaagaccagccuggccaacauggcaagacaucgucucuacuaaaaacauaaaauuagcugggcaugguggcacaugcuuguaaucccagcuacuccgguggcucaggcacaagaauugcuucaucaugggaggcagagauugcagugaaccaagacugcaucacugcccuccagccuggguaacagagacuccauuucaaaaaaaaaaaaaaaaaaaaaaauugcagaagguaacaaguacagaaaaaacagaaaacucucuucuuagccuuuuggcaaagaucaagugaagaacaagcagaauuuuuaauaaaaucucuaccuaagucugucucagucgaaucaaauuaccaaugcacugaaaaucauucaggaauauuuuaggaaagaugucagggauuuccaaaaccuauacuauauaaauuuaaauuaggguauugugcagauugaguaagucaaaucagacaaaauauuuauacagaaaccaauauaauuauaagaguucuacaauuuaauuccuacuacaacaaagcauaagaaaacauguaaaauuauaauuuuaacauaaggaagcaugucuuacaucugguguaaaucuuuugaauucagccauccaguuaggaaguguagacaaagggccacagacaagaaaagguccugguacuccucucugaaucaucaaugcaauaguagcaaugcacugaacugucuuacccaaucccauuucaucugcuaaaaugccauuaauuccauuuucccaaagcaucuggacaaaauaauagauacuguauuuaaacuuggauauaaacaacuacaggauuacaauauuuuauuucuucucuuuaaaaaaucacacccaaagaugagaauuauguuaaagcugauauauucacaccauaaauuauaacaacacuggaaaguccuuuaucaaagccauaaaagugcuggaagccauuaacaagguaauuucuacuucuaaaaauucaggguaaagaaaucagaaagcaaguauccacauacaaauguauaauagugaaacaugauagaaaugacucaaguugugguaccucaaaucauuaggcuacuauagaaauaaaaccaguaucuuguauuaaaaauuccaauucauuacccuaagccauuccaugccuucuacuugguaccaucgcaucacuccuccagugaagugcuuugguuguugaaaagguacuggcugaccauuacacuuccggacugggucaaaaaagaauuuaguauucugccuaaccguuucagacaaucuaucuuuaauuauacuauucgaaucuuuauuuuucugaagaucuuccacacagagauuaguagaggaggaguuuucauccuguagagaaaaaaaguuuaauaagauguguuauacaaaaugcugcuguaugccaccauuuaucagaaaaugcaacuaacaaaaucuacugaguccuauaaucauuaaguauagaagacuaagaucacaccuggauuaaaaaacuggagacaucgccaucccucuacaaaugaaaagcuacuaaaaaaaaaaauaacaggcugccacaguggcuaauccuacaaucacagcacuuugggaagcugaggcaggaggaucaccugaguccagguauccaagacaacccuggacaacauggcgaaacccugugucuacuaaaaauacaaaaaauuagcugggugugguugcacgcaacugccuguaucccagcuacucgggaggcugaggaucacuuaaacccaggaagucaaggcugcagugagccaugaacacagccacugcacuccagccugggugacagaagacuccaucucaaaaaauaaaauaaaauaaaauaaaauaaaauauaaaaaucugagaauaacccuuacaaauuaaaaucaggcacauacuuuugaaaagaucauuagaauuguaucucucuuccaaacuucuaauauugugauacucaauaauuuauuaaacuguuacacagaaaauacaguacgcauaaauaagacgggcaaaagauauuaacagauacuuuacaaaagaaaacauacaggccgggcaugguggcucacgccuguaaucccagcauuuugggaggccaaggcaggcagaucaugaggucaagugaucaaaaccauccuggccaaaauggugacacacugucucuacuaaaaauacaaaaauuagcugaacaugguggcaugagccuguugucccagcuacuugggaggcugaggcaggagaaucgcuugaaccugggaggcagaguuuacagugagccgagaucgugccauugcacuccagccugggcgacagagugacacuccaucucaaaaaagaaaaaaaaagaaagaaaacauaguuaucaaagaacauaaaaauauacucuacuucaguaguaauuaggaaaaugcaaguuaaaaaccacacaaguuaccauuucucaucuaauaaaauggcugaaauuaaaaagacuaucaaaugcugacaauaauguaagcuggaguuuucaaacauugcuggcgagagaauaaaaugauguguuuacuuugggggggaaaaucuguacuuucuuaugaacacacauuugccacguaacacaacaauaccauucccagguacacaggcagaaaguaugaaaacaugucuacacauggacuugugugcaaauuaucauagcaaccuuacucauaaaagucacaaacugcaaacaacccaaaugcccaucaauaaggggauggaugagaaaauuguaacauucauucaacagaauacuagucaauaagaagaaaccgguuacuaauaugcucaacaacauaaaugaguaucacagacauguugaguggaaaggaaauaauaagccauccuauaaaagguguaaaaaguggccuccucuggguuuggggguggaaagacauagaagagaucccuuuacaauggaaauguucuauaccuugauuuggauggugguuacacaaguguaugcaagugucgaaauucauuaaaauaccauacuuaacaacuauuucuuacugacuguaaguuauaaaaugaagccaaaaucccauaguaaauuacagaagauuacaucuagacuuuaucuuaaaaauccaacuaaauguuuaucuaacuaaaucuuuaaaaauccaacuaaacugcacccauaaaccaguccuuaauaacuuaacaaagaauaaaaaccaagacacuuuuacaauauaaauuuuggacaaaauuauaugaccaaauagauuaucucucauuuuauaaacauaacauuaauuucccaaaggccuaaaaaucuuuaauauguaaauuaacuaccugaaguucauauccauucaugaauauuuucaugucaugauuauuuugcuucccuaggcaaccuuguaauuuuaaguacuugaacaauaaaaagucagauaacaaggaaccucucuacaugaaaugggcuaagugaagagguggcucggaaaucaagccuucucaaacagaacuuuuaagaaacuuaaaaaaucuuuaaggucugaagcaagauuaaggcaucccucacagcuuccauaagaugauucacgguuuauauccacaugguuacgagcacuuguaucacugccagauucacaaguuaaaagcaacauugcuagacccauaaauuaacauuuauacaucaagaaucaugcaauaaaacaacuaacuaaaguugauacauaaaaaagaagaauguuggauauggaagaagugaauacauagguauuuuuuuuuaaagcaaagaaacaggauaauagugagaagaacguauacugcugauuaaagaaaaaggacuaguaacugaggaguaaauaugacuucuaaacuuaaucuuacauuauaaauuucuuaccucauucuccuuuuuauuuuuuuuagccacagacaaaauuuccuaguaguuugagaaaacaaaaacaaauuaauaauguaugaaguucauuuauuuauuuauucaacaagcauuuauucugugcucauuuugccaggaaaugaggaugagauucucaagauaaaacuaguagccuucaggcagaaauaagccuauagacauuacuggcucauaauauuucauaacauucuaggcuaauuugggaacacuuauacaaugggauauuucaucaaauacagugauuuuccagcuuuucuuucuuuuaaucugaguagauuaaguacaaauucacacauggcaacaaaccucuaguccuggggucagcaaacuacagccuguagaccaacuccagcuaagcgaauacacagguauuuuuuuaaaagcaaagaaaugggauaaauuggaacaaagucagccucacuuguuuacgguuugucuauggcugcuuucaagcaacaacagcagaguacaggguugaguaguugcccacaaaacuacucaaaagcuaaaaauauuuacuaucuggcuauuuacagaaaaaguuugccaaaccauguuacagcccacuuuaggccucuguggauagacaucugaguuugcauuccuggguaagaggcaaagacagaaaaaauuaaaaauacagaauaaagugcucugauuuugaaguaccuacuagaugcugcugguagggagacaaacaauacccgaguaugucacuggaugacuuagcaaauaauuaucuuacauaaaauuaucuaaaaaguugucaccaggcuucaucauucaagauagugaggguagauuucaagcagagagaauauagaaggcauaggggaugaaguagauucaaaacagcaauaucaaauuuaagauucauagaagaguaacaggacauguaaguggcugacacacacacauauauauacaugggaauauauguauaucguguguguaugaaguauuauguauguauagauauucauauuauaaggcugaggcuaaaaggauuuuauaccaggaacugauaaaagcuguccuguaaaaugacuagauaaaaugaaacuuuugaaagaacaauuuggaaauaaaucaaaaucuauaaauaccaccaaugaaguauucuuauuaaaaaucaagcaugggcaacauggugagaucccaucucuacaaaaaauauaaauguuggcugggcuuggugguacacgccuguagucccagcuacucaggaggaugaggugggaggauugcuugagcccagcaaucagagguucaaugagccgagauggcaccacugcacuccacccugggcaacagagaaagaucuugucucccaaaaaaaaauaaaaauaaaaaaaaaaauaaaaaaacaccuuaaucacaaacuuccguauuuaacuuauaguuacuauaguuaacaggaaacacaagaggcagagaaaucauggggauacaaucaguaaagucuagaauguggggaauuauacagaauuacucauuuucuucaacaaauaauguuucuuaaaaaagaugagagacacucuagaucuaaaagagacccaagauacgcauuaaucaaacacaauuuauguaacuuuuucggauccugauuugaaccaacuauuuuuuuaaaauguaugagcuaagcagaucacagcgguaagugccuauagucccugcacuacuacucgggacacugaggcaggaggaucaugugagcccagguguuugagguguagucacuaugacaauacucaggaauagccacugcacuccagucucgucaauacagcaagcccccaucccuaaaaauaaaaauuagccuauugagaaauuuaaauauuaaggaauucccaucgacuuucaaaagugugguaacuguauugugguuaugguucuaaaaaauagucuuggccgggcaugguggcucaagccuguaaucccagcacuuugggaggccaagucaggcaaaucacaaggucaggaguuugagaccagccuggccaacauggugaaacccugucucuacuaaaaauacaaaaaauuagcugggcgugguggugggcacuuguaaucccagcuacuugggaggcugagacaggagacucacuugaacccaagaggcaaagguuguagugagccgagaucaugccacugcacuccagcccaggugacagugcgagacuccaccuuaagaaaaaaaaaaagucuugcugagcuuuuuguuaaaauaucccagaauuaaaaagcgauuggcugggcgugguggcuuaugccucuaaucccagcacuuugggaggccgaggcgggcgggucaccugaggucaggaguucaagaccagccugaccaacauggagaaaccccaucucugauaaaacuaaaaauuagccgagcaugauggcacaugccuguaaucccagcuacucgggaggaugaggcaggagaaucgcuugaaccugagaggcggauguugcugugagccaagaucaugccacugcacuccagccugggcaacaagagugaaacucuaucucaaaaaaaaaaaaagugauaaagguggacauucaauuuacuauccucuaaacauuuguaauuuuugagauuuuccguaauacaaagaaaaagaacauacauauaccaaaauguuagugauuaucugugugacagcuuuucaggugauuuccuuguauuuuguuuauucucaaauuuuucuacaagaaaaugcaauuccuugugaaaccauaaaaaguaauggagguuaugaguaauuauauuugaguuucagaaaaaccaaucugguacucuugacaaugagagcuagacuaggauuauaaaaaucaauuaagaaacuacuauaaauagggcacaguaagggcauaaacaccagaguagcagcaaaugaaaugacucacagaaaucgauaaaaaucuagauauauaaggaaauucagauaaccuccuaaauuguuuuagaugacacaguagauacugguucugauauuaacaccaaaaaaagagaaaacaaaagagcaagauucggaagagaggaaaagauaaauuguuugcuuugugcuagguaucaauuucaaagauaccaauaaauucaacugguaggcguaaaacugcucaacugcauaauguguaaggaaauaugcacaggcuacucuuuaaaaaaaaaaaaaaaagggccaggcgcgguggcucacgccuguaaucccagcccuuugggaggccaaggcagauggaucacaaggucaagagaucuagaccauccaggccaaaauggugaaacuccaucucuacuaaaaauacaaaaauuagcugggcguggugacgugugccuguagucccagcuacucaggaugcugaggcaggagaaucacuugaacccgggaggcggagguugcagugagucaagaucgcagcacugcauuccagccuggcgacagagcgagacucucucuccaaaaaaaaaaaaaaaaaaaaaaccaggguuucauucucuugcccaugcugcagugcaguggcgcaaucucaccucacugcagccuucaccuccccaggcucaggugauccucucaccucagccuccuguguagcugggaccaaagucaugcaccaccacaccuggcuauuucuguauuucuuuuuguagagacaggauuucgccauguugcccaaacuagucuuaaacuccugggcuuaagugauccucucacccuggccucccaaagugcugggauaacaggugucaggcaucauguccaguccagccuacucuuaaaaagcuuggaaauaggccggugcaguggcucaugccuguaaucucagcacuuugggggccaagguggguggaucaccugagaucgggaguucgagaccagccugaccaacauggagaaaccccgucucuacuaaaaauacaaaauuugccaggcgugguggcacaugccuguaauccuagcuacucggaaggcugaggcaggagaaucgcuugaaccugggagccggagguugcaaugagccgagauggcgccauugcacuccagccugggcaacaagagcaaaacugugucucaaaaaaaaccuuggaaauaaagaauaaaaaacagggcaaucuagaaagacuggaucaaaaauuuuuguucugcagacaggaaaacacaauguaucuauaauugaaaggcaaagacccagugaggaaggaaaaggugaagaaacagaagggauaacuuggaggagcaggguccacaguggcagaacacucaauuggguuauaccccuccaaaugcauucacagauuuagagauucuucagcaaguaaggugagaaugaaacaauggaaagaauuuaguuaggcgaagaggaaaagagagcaggaaauucaguaaauauacagaagaaagaaguaacaguaaaugaaagaauaacugguaugggaccaggcaugguggcucacaccuguaaucccagcacuuuggaaggcagaggcaagcagaucacuucgggucaggaguuugagaccagccuggccaagauggugaaaccaccucucuaugaaaaaauacaaaaacagccaggcgugguggcacgugccuguagucccaggcgcuggacuacucagggagcugaggugaaagaauugcuugaacugggagacggagguugcagugagccgagaucaccacugcacuccagccugggccacacagugaaacucugucuuaaaaaaaaaaaaagaaaagaaaaagaaagaaagaaaaacuacuaugcccacagaucucugaauaaacuagccaagugauuuaccaaaauggaaauuugcuuaaaaucuuucaauagcuuccuacuuuacuuauggcagccuuaaacuccugaccaugcuuacaucgacagcuucauccuuccuucaucacucuuuucacuuauauacaaauuggaggcaaauauaauuuacuucaaguuuuuugaaacugccagucucucuugacccuggauauuuguucaaugcuauuauuucuuccuaaaacaccucccccacuaucuuaccuguacuuuacucuuucccuauuaaucccaccuuuaaauaauuuaacuuuuauccuucaagucacaacacagauaucauuuccuuuucauagaugaaaagguucaggaacugcaugccagagugaagagccccucuaauaugguguauaaacauccaauucccaaccggacacaguggcucagaccuguaaucccaguacucugggaggccgaggcaggagcccaaaaauucgaggccagccuagacaacaugacaaaaccccaucucuacaaaaaauacaaaaaucagccaggccugguggcacaggcauguagucccugcuacuggggagugugagauacgaggaucacuugagucugggagguugaggcugcagugagcugagauugugccagcugcauucgagccaggguaauagaaacacugucucaaaaaaaaaaaaauucaauuucauugacuacuuacuccuauaucucucucuguaugcaggcuaaggugaagacagcauuuaccuuucuuuacuaauggauuucauccaccuaugacaaaguuugcccaaaaccgauauuccacaaccauuuaacaaauuaaauaaacagcuguaugacuggcuaaacuucaguauggcauauuaaaagugguuuuucuuuuuugagauggaauuucacucuuguugcccaggcuggagugcaauggugccaucucagcucacugcaaccuccgccuccgggguucaagcaauucuccugccucagccugcccaaguagcuggaauuacaggcaugugccaccaagcccagcuaauuuuguauuuuuaguagagaugggguuucuccaugcuggucaggcuggccucgaacucuugacaucaggugauccucccaccuuggccucccaaagcgccgggguuuacagguaugagccaccacgcccagccuaaaaguguuuuaaacugcaaguugaauagauaccauaaugaauuucaguggacccuaacuuuguuuuuuuugagacagagucuugcucugcugcccaggcuggagugcaguggcaucaucucagcucacugcaaccucugccucccagguucgugauucuccugccucagccuccugaguagcuaggacuacaggcgcaagccaccauucccagcuaauuuuuauauuuuuaguagagacgggguuucaccauguuggccagacagguuucgaacuccuggccucacgggauccacccgccucagccucccaaaaugcugggauuacaggcgugagccacugcucccggcccccugacgauuauuuuucagugaaaaacuaucauugcaucccuagagaaaaggaaaacuauuauguaaauuuuucuucugaagagcuagaguuugaacuucagguaaaagaacaacaguagacaauagaguugugcuuuuuuuuuuaaauauaagaauguggccaggaguggugccucaugccuguaaucgcagcacuuugggagauaaaggcgugaggaucaccugaggucaguaguucaagaccauccuggccaacauggcaaaacccugucucuacuaaaaauacaaauagguaccuguaaucccagcuucucagaagcugagacauaagaaucgcuugaauaugggagguggagcuuguagcagugagccgagaucgcgccacugcacuccagccugagggacagagcaagacugucuccaagaaaaaaaaaggaagaaugugacacauuaaaaacaugcuaaggaacugguuugucagaacugaagaugcucuaauucauucauauuuuuaaguaaaaagugagaaaugaaaaaaagaagcugguuuuagaaaagagcauaugauuucaguuucguaaaagucuucaacaaaaaacaagaauaaaguucuuaagacaagguuagggguuacaaaaaguuaaauuauagugacaauuucugacuaggccaggcucagacucguuuaacaaagagcugguaccaucuuuuucccugaaauacuuaucugcucuggucagacagugucuuuacuacccuacccuuuccccccaacucuccgcaacauauauguaauuuuaagcucuaugcccaugccuguuguuuccacaguuccuugcaaaaugcuauacaaguccacuagguacuuaacaagcacaagauaauagguagagucaaagcuauuacuguuaucuguaauaacccaaauaagaaaaccagcaaaggccgggugcaguggcucacgccuguaaucccagcacuuuuggaggccaaggcggguggauccccugaggucaggaguucaagaucagccugggcaacacacugaaaccccaucuccacuaaaaauacaaaauuagccgggugugguggcacaugccuguaaucccagcuacucaggaggcugaggcaggagaauugcuugaaccugggaagcggaggaugcgguaagccuagaucgcaccauugcauuccagccugggcagcaaggguaaaucuccgucucaucaaaaaaaaaaaaaaaagaaaagaaaaccaacaaaaagcugggcacacuggcucacacuuguacucucagcaguuugggaggcugaagcaaaaagaucauuugaacccaggaguucaagagcagccuaggcaacauaugacaucucauugcuacaaaaaauuuaaaaauuagccagcugugcauggugucacacaccuguagucccagcuacucagggggcugagguaggaggaucacuugagcccaugaggucgaggcugcagugagccaugauugugccacugcacuccagcuugagucacagagugauacccugccucaaaaaaagaaaagaagaaaaaaaagaaggaagcuagaaaggaaggaaacgaaagaaagaaaagaaaaccagaacaaccuaaagguguaagccuauuugccacuuaagugaggaugggcgcaauggcucacgccuguaauguggcauuuuaggagaccgaggcgggcggaucaccuuaagucaggaguucaagaccagccuggccaacauggugaaaccccaucucuacugaaaauacaaaaauuggccaggcguggugguuggcaccuguuaucccagcuacuugggaggcugagacaggagaaucgcuugaacccgcgagguggagguugcagugagcagauauagugacacugcaaggcagcauggaccacagagcuccaucucaaaaaaaaaaaaaagucuaugaaggucagaugacauuaguuucagauuagucucaagucuacuguagguugguagauagcuucaaacauuuuggcagcuucaccuauaaaugauauauaauauuaaauucaaaacauauuucaugugauauugaauauucaaucuuuacagauuuaaggugguuuaaaaccuacauuuuacucaacaucaaauguuaggugcccucucccuuuuauuuuuaccucuuuugacaugaccucugaaauauuguaugauucaucuucucuuccucuuuuuuuccucauaacuauaaaaaaaaauuuuauuuuugauagcaauuaaaauagaaauauaaacgcauauucuucaaaacuagaauaaggauauuuaccuggcuucucuucacuugcaucaauugaauuuuuacccuacaaaacaaggauucagaauauugauuuuauuaaggaccuucauaguauuauacguuaaaaggcacugauuaacuugagaaaaaauauguuuccugcaauugagccacauccacaauuuuucacuauuauacuuaccuacauguaauauuuuucuguauuucccuacuauaacuuguucauaaucucugcuuuuucccaagggcucuacuucuguccauuuuuuuccauuuagaagagaaauuucaaaauuaaacauaguuggcauuucguuuguuuguuuuuuggagacggaguuucacucuugucgcccaggauagugugcacugguacaaucucggcucauugcaaccuccgccugccagguucaagagauuccccugcuucagccuccagaguaguggggauuacaggcaccugccaccacgcccggcuaauuuuuguauuuuuaguagagaugggguuucaccacguuggccagcuagucuugaauuucugaccucaggugauccgcccgccuaggccuccccaagugcugggauuacaggcguugagccacugcacccagcccauaguuggcauuuuuauuuagaaauaccauguacaucuuggccgggcgcgguggcucaagccuguaaucccagcacuuugggaggcagaggcgggcagaucaugaggucaggagaucacgaccauccuggcuaacauggugaaacccugucucuacuaaaaauacaaaaauagguauuuuuguaggguaggguauugaaggaauacccuucaauagguaggguauugaaggaauauucauugugaaugaaauucauacauuaaauauaacccaaagcagaaauaaaagagaauacuaauggaaaauuauuagugaggaagguaagagaaaugagauguuaagaaacaguuucuggccaggugcaguggcucacaccuauaaucccagcacuuuaggaggacuagguaguaggauugcuugaagccaggaguacaagaccagcuugggcaacaaagcaagauccccaccucuauaaaaaaugcgaaaauuagcugagcaugguggugugcaccuguagucucagcuacucaggaggcugaggugggaagauggcuugaccccaggaguucaaagcuguagugagcuacuauggugcuacuggacucuagccugggcuacugagacaucaccucuaaaaaaauuuuuuaaguuucaaaauaguugacgcccuuaugaaaaaagcagaggggaaaaaaaucaaaacccugguauaaaaaguuagguggaauaaagugaaggauauauuaaauuaacagguuaaagagcagggaauaaaugacuaagccaguaaaauugucauauaaauaaaaacauguucuucaaaaccccuagguaaggccaguugugcuagcucaugccuguaaucccagcacuuucagaggccaagguaugggugugggugugggggauagcuuaagccaagggguucgagaccagccugggcaacauagugaagcucugucucuaugaaaauaaaaaucugaaaagcccuagguaagucucugaaauuagcaagugagucaaggaucagaggguuuuuuuuuuguuuuuuuguuuuuuuuuuugagacagagucuugcucugucacccaggcuggaguccaguagcaugaucucagcucacugcaaccucggccuccuagguucaagcaauucuccugugucagccucccgaguagcugggauuacagguacccgccaucaugccuggcuaauuuuuguauuuuuaguagagacuggguuucaccauguuggccagguuggucuccagcucuugaccucagaugaucggcccaccuuggccucccaaagugcugggauugcaggcgugagccaccgugccuggcccauuuuuauuuuuuaauacucucucucucagugacucaguauuaccaguuuuauguauuuauuuauuuauuuauuuaggaacagagucucccucuguggcccagacuagagugcggugaugcaaucuuggcccacugcaaccucugccuaccgugguucaaguaauacucgugccucaaccucccaagcagcugggacuacaggcacacaccaccacgcccagcuaauuuuuuguauuuuuagcagagacagggucucaucauguugaccaggcuggucucgaacuccuugccucaaggaauccaucugccucagccucccaaaguguugggauuauaggcgugagccaccacaccuagcaguauuaccaguuuuaaauaauggguuuuguugcaaaacagucugcaaaauacuuuaucaggcauuuuaacaucaccauuaacuagucuaagaaucaaauaacuggacuuaaucucagcacuuuggguggccaaggcaaguggaucacaagaucaggaguucaagaccagccuggccaagauggugaaacccugucucuucuaaaaauacaaaaauuagccgggugugcuggcaggugcuuguaaucccagcuacuugggaggcugaggcagagaauugcuucaacccaggagacagagguugcagugagccgaaaucacgccacugcaucccagccugggugacagaacgagacuccgucucaaaaaaaaaauaaauaaauaaaaggcaguuuagcacagaagcuaaguagaagcucuuaaacuaauccuggguucaaauccguaauuuucagcaaauuagagucagcucucauuaucugcaguacuugugguucgauaaaaucacuaugacuauugacuuauugccccuaggaaaaauacaagcuugggucucugacucugguuaugacauuuucaaccaaacgauacacaacccuguuuuauuuguguuucuguuuuuaaagauaucuuauuuaauauauauguugauuaauauugaacucagggccagcugggugcaguggcucucgccuguaauccuagcacuuugggaggcugaggcggguggaucaugaggucaggaauucgaaaccagcccacccaauauggugaaacccugucucuacuaaaaauacaaaaauuagccaggcaugguggcgcgcaccuguagucccagcuacucgggaggcugaggcagaagaauugcuugaacccaggagguggagguagcagugagcuaagauugcaccacugcacuccagccugggcgacagagcaagacucugucucaaaaaaauaaaauaaaauaaaauaaaauaaauaaauaaauaucgaacucagggccaacagcacuguaccucaugccucaaugaagcuuacccaagacauacuuucuccauauggcacagccuuuuuguacuuagaaacacuagacagcacuuugguacaauaguugggggccauuuuaacagcaaaaucaccaugaaaaagcacaaaaaaacgcaaaaguuauggugcuaaauaaagaccaugaaaaggauauaugcuugacauacauaugguagcagaaaacaaagaacagcaacccauguuugagcugagcuuggaacauauguauuggaggacuaaaauucuuugcugcucugaacauaagcauauccaaaaaugaccaugacggugucaggaaucuugacucugggguuacaaauaaauguaagugaguaggcgaauucacaaauauagaauccuugaauaugauuguucuuuaucuccuugcaucagccuauuuauguaaaaugggggaaaaaaguaccucuaccuaaaaagaacuguugugagaguaagggaaaacaggcugggcgugguggcucaugccuguaaucugagcacuuugggaggccgaggugggcagaucacaaggucaggagauggagaccaucguggcuaacacaguaaaacucugucucuacugaaaauacaaaaaauuagccaggcaugguggcgggcgccuguagucccagcuacucgggaggcugagacaggagaauggcgugaacccgggaggcagagcuugcagugagccgagauugcgccacugcacuccagccugggugacagagcgaguccccgucucaaaaaagaaaaaaaaaauagaguaagagaagacaugauagcacaccugacccacaguauguauucaauaaauuauuucucuuuucacuagcaaaacuucauuacagguuucaaagaagguggccacuuacaaaaugccuugaaguuuaaauuugcagauucuuuccaauuaagaaagucaaauuuugccaacguccaaaauaauccauagaauaagaaacuaaaguggaccauacuuuggcucuuucuccauuucuuaaauagugaggaacagauuuuacauguuucugcauugcuuguaacaaaguuagguuuaucacuaaagaaacuuaaaauuaaacagaugaucaaaaaagucagaagaauacaaaaguauuucuucaauauuuaaaugacauaaaaaauauuccggcuggcuauauuaccuuuuuaacuuuuaaagacuccuuuuuucucuccaauuuuucuuucuucuucuguuccuguaagacaauuuuuucuuaugucacaaguggaaagugcaacauuuaaaaaaaaaacgcauaucaauucucaaauaacuuauguuuacaaugagaaacuaaggucuaucauaauuaaaaaccagggaggaacuuguacuucaagccuuuauggacuaaugggacagauuuagccuccugccuuaaacaacuaaaauccagauaaaauuuauuaaacaaugguuuucagacaacaugcaguaacggacuguaaacacugacaaaacggaaacaagguuaaucuucugacugcccagcuuacugccugauacaauuuuaaaguacaaauaauggagaaaaauccaaacagagcccaacagucucuuuguguugaggagacagaauccaaaacuuaagagcaguagcauucccagggucaaguaccagagaggacaaagcugcacaaaggcagcuguuaucucucucucaggcugaguacugguaagugcaugguaaccaaggccaggagaagagucaccagaaagaagcagguggaaccucucauguuccaaggggucaggcauaauaagguauaccucacauucucucagccaaaguagaaaguccucuuaauauaaagggcaucaaguagagugcucagaaaagggaucaacuuauuccuagacuaaaagcuauucuagacauacucuuacaaauuuuuuaaagacaccaaaaauucaaaccauuuccaagaggugaugaaagggguagaugcuguguaacucauuaaguugaauauuuguuuuuccauuuguuuuacuuuaccauaaaaaaguaauaaaaggguuucaaacaaaggaaaaaggagauuugacaaauacagcaaaauuuaaauugauaauuuuuaaaugugggugauggggacaccgggacuuacuguauucucucaauuugcacaaguuuuuaaaucuucauaacagucuaguggaaagacaaacaauaaauacaauaaaugauguauaucagaugaaaagugcaaugggaagaacagaacaagguaaagagaaucagguguguuagcaacuuucuuaaaauugugagggcaggucucaucuagaaaccauuuaagucagggcuugaagaugaaguuaagccaugcaguuauuuagaggaagaagguuccaggcauaaaauagcaagggcaaaagcccaagacaggaaacacaucuggagacaggucugaaagguaaugggauugagggaggcagucaaauugcuuacagacauauagacauuaucaggacuuucacuuuucagaaacaacauaagcuaggagacagugaaacaucuuuaaaguacuccaagaaauaaaguacuaaagaaaaaaaauucuuuacccaguaaaaacguauuucaaaaaugaagguaagugaagacauucagacauaugaaagcuaaaagaacccaucaccaacagaaaaugcaaaugaaccuauaauaacagaaaacagaucaauuggcuaucuguggauagaacaugggguagggacgggcgagaagaauuauaaauaagcagaaagaauuuuuuggaaucaguggguauguccacuaucaugauuguuaugucuucacaaguauauccauauaucaaacuuagggaauuguacauuuuaaauaugugcaguuuaguguaugucaauuacaccccaauaacgacauuucuuaauggaauccuucucaggaauaaaaaaaauaaccuacagaaaaacaugacaugaaugaaucucaaaaauacacugagcaaaaguaacaagacaaagagugcauaugugcaagaauauugagaaaaaaacaaacucaguuucucccuacacacucaacaaucaacacaaaagacuucugugacccaauguguggggguuuucccuauacaccaaacaagcauuucugcagugacaccagcuggguguccucuauuguaauucaauucugacacuaucuacggggugaaagcaccauaccccauagguugaggguucaguccccaagacuuuuaacuaccaguuccagaugccaaucgcaaggcccaagucgccuuaccugugcuucuuacugaauagcuauaaaucaggguucccacaagccccucuuuggguuugacuaauuugcuagaggagcuuacagaacucaaagaaacauuaaaguuuauugguuuauuauaaagaauaugacaguccaggcgcaguggcucaccccuguaaucccagcacuuugggaggccaggguaagcagaucacuugagcccaggaguuccagacaagccucggcaacauggcaaaacugucucuacaaaaaauacaaaaauaagacagacauaauggugugcuccuguagucccagcuacucgggaggccgaggugggagggcugcuugaacccaggagucagagguugcagugagcugagauggugcacugcacaccagccugggcaacagaguaagacucugucuccaaaaaaaagaaagaaagaaagaaagauuacaacauauucagaggaacaccagagaaagagauguauagaacaagguauggagaaagaagcgcagagcuuccaugccuuuucuggaugcgccauccucuccaggaaccuccauguguucagcuauccagaaguucuccaaacccuguccccuuuugggguuuuuuuuauuuauuuauuuuugaggcagggucucacucugucauccaggcuggaguccaggggugcaaucucggcucacugcaaccuccgccuccuggguucaagcgauccuccugccucagccuucugaguagcugggcuuacaggcacacaccaccaugaccggcuaauuuuuauauuuuugguagagacggguuuucacuauguuacucaggcuggugucgaacuccugggcucaagugaucugucugccuuggccucccaaagugcugggauuacaggcgugagccacugcgcccagccuguuuuauuuuugagacagggucuugcucugucacccaggcuagaaugcaguggugccaucacaguucacugcagccucaaucuccuuggcucaagccaaccuccugccucagccucccaaguagcugggacuagaggcacaugccaccuuaccuagcuaauuuuucuauuagagauaggguuuugccauauuacccagccuggucucaaacuucugggcucaagcaauccacccaccuaggcuccccaaagugcugggauuacagaugugagccacacccagcccuuuuggguuuuuaaugaagaccucauaacauagacgugauugauucaaucgugaccacuggugaacaaguuaacuuucagucucuuuuccucaaaguugagggugaggcuaaaucccaacccucuaauccagguuuugucuuucuuaggcucccauccugaagcuaccuaagggcagcuagccauugaucauuagcauuaaaaaaaaaaaaacaaaaaaaaaaacacuauuacuuugaagauuccaaggauuucaagaguuguauaccaggaaauggugaugaagaccaacuauuuacucacuagcacaauaccaugauuucauuuauacaauuuucuaggaaaaaacaauacuggucuauagugacagaaagcaaaucaguaguugcuggacaccagccauggggauuacugucagcacaagacaauuuuuuggaguucauggaagugcacuguaucuugauugugcuggugguuacacagaucuauauauuuacuagucaaaacucagcaaaccguacacuuaaaaucuguccauuuuacuguauauaauauacacuucaauaaagcuauuuuuaaauuuuuuuaagcuuucacuuguagucaguuacauauacauaccucuaauuguugcuguuccauuuucgucaauaaaaauuuggaguauauauugcuuuuuucaagcaaauguugaagucuacgguaccgaauuucugucgacucucuaucccaagacaugcgagccuauccaaagagaaaauuuccauaauuaugaacacuuucugacauaccuuaauuuuuuuggcauaaaguuuaauaaaaauggcuaaaauaacauuuuuuaaaccaaacacuuucaaaccaaaaacuggaacaaauaacuguuaaaaaaaaaauaguuuuuggguuuaacaggcaaucugauagaugcaauucguauaucaaaauauuauaauuucaaauauugaacacaugguuucuggcacuacugaguuggaagguccauuuaaaaaacaauugaaggccgggugcggugacucacaccuguaaucccagcacuuugggaggccaaagcaggcggaucaccugaggucggggguucgagaccagccggaccaacauggagaaaccccaucucuacuaaaaauacaaaauuagccaggcgugguggugcaugccuguaaucccagcuacuugggaggcugaggcaggagaaucgcuugaacccgggggaggcagaggcugcagugagccgagaucaugccacugcacuccaaacaagagcaaaacuccguaccaaaaaaaaaaaaaaaaaaauuggggccaggcacgguggcucacgccuguaaucccagcacuuugggaggccgaggaggguggaucaccugaggucaggaguuugagaccauccuggccaaaauggugaaaccccaucucuacuaaaacuauaaaaauuagcaggacgugguggcgcaugccuguagucccagcuacucaggaggcugaggcaggagaauugcuuaaacccgggaagcggagguugcagugagcugagauggcaccacugcacuccagccugggugacagagugagacuccguccggaaaaaaaaaaaaagguauguguaauuugcuaaaacauugauguugugguuccguguuauuauauuaccuuguuauguacagauaaggaaaauuuuugauuaauuuugcacuugacccucauaaaaagugauugccuaggugacacuagagaauucuaagacaaguuuucagagucucucccuauuugagauuaauaaacaaguugauuuggauagaacauuuuagaaaaauacuaccaacacaauucauccuaacaaucaaaacagacaucuagccaagauuaacacccccaccccguuuuuuaaggcauggucucaugcuguaauuggugcaauuguggcuuacugcagccuccaaaucccgggcucaaaccacccucccaccucagccucccaaguagcugggacucuaggcagaugccaccaugcccuguuaauuuuuuguauuuuuuuuuuuuguaaagacaggguuucaccauauugcuaaggcaggucuccaacuccuaaacucaagagauucgucugccuuguccucccaaaguacugggauuacaggcaugugccaccaugcccaaccaagauuaccaauucuguaacaugaauccagccuaguaaaucaacaaacauguacugcaacaauuauauaaauuauguaacugguagaagacagaaagucugauuuauacuacagaugagacauuaguguaauaucugaaaacaacaaguauuaaagacauauacauagcaguaaacuguacaguacuaucuaaauccugaaaaauuguaagaauuacuaaaacuggagaagucagauuucaggaaauagaugacaucugaggggucugaaggauggauaaaugagagcagaaaaacucaaguuuugucaauuacuguagaaguuccugcuuuaagcaacacuggccucagcaacagcacuaaaaaucacacuuaaguuaacuuuagaauuaaaaagauucuaaauuuuauagauuagauaguagauauguuucauuuuauacaaacucuugacuuaaaaagucuaguggcagauuuuuuaguauuuuguuuucucaacuaaaccaauuccucuacuuuucaacaaggauuaguaaaaacacaaagucaaccaauaaaaucuaacugccccuuuccccaguaauuggugguuucaacuuaagaggaaaguaauugagcauuguuuacagcguguuugaaaugggggauaugaggcugggcgcgguggcucacgccuguaaucccagcacuuugggaggcugaggcgggcggaucccgaggucaggagauugagacuguccuggcuaacacggugaaacccugucucuacuaaaaauacaaaaaauuagccgcgugugguugcaggcgccuguagucccagcuacuugggaggcugaggcaggagaauggcgugaacccggaaggcagagcuugcagugagccgagaucgcgccacugcacuucagccugggcaacagagcgagacuccaucucaaaaaaaaaaaagaaaagaaauggggguaugaauucauuuuuauacucuaaauaaugcccuagcacuuggguaguuuugcugcuccagcuuaucaauaucucuaagauaucauuuuauauugccuuacauuuuccuagcuauuacaucaucacuauagcuuucuuucaaaauauauuucuuuuucuuuuuugagauggagucucacucuguugcccaggcuggagugcaguggcacaauccuggcucaccucugccuccgccucccggguucaagcaauuaccugccucagccuccccaguauagcugggacuagaggcaccugccaccacaccccgcuaauuuuuguauuuuuaguagagacgggcuuucaccaucuuggccaggcugcucuugaacugaccucgugguccaccugccucagccucccaaagugcugggauuauaggugugagccaccguacccggcaucaaaauauauuucuauuauaaaaucagugacuacaguaagauucuaagaauggaccuaacaaaaguaaugcauacucauuacagaaaaacuaaaugucaaaaaauauauaaaucacccauaaucccaccuacacagauaauucuuaauaucuugaacucaauuuucaguucuuuuaggacagaauuucuuuuacuauuaccaguauacuacugugguuacaauacgcaacuacugaggugaauaugaaaacagggagaugaaaauuacuuacacaauauauggauucuuaaauuuuuaacuuuuaaaauuuaaguucaguuaaaauaacguggguuuaacuuagauauaguugauaccuuaaauccuguacagaauuagcacuuuuucuuuuuucugagacagggucucgcucuaucacccaggcuggagugcaguggugagaucucggcucaaugcaaccugcgccucccaggcucaagcgauaauccuccugccucacccucuugaguagcuaggacuauaggcgcgugccaccaugccggcuaguuuuuuaauuuuuuguagagaugggguuucacccuguuacccaggcuggucuuaaccccugggcucaagcgaucugccccgccucagccucccaaagugcugggauuacaggcaugagccaccgcgccuggccagcacauauuuuuaaaacaacuaaauacagccaggcaugguggcucacgccuguaauccuggcacuuugggaggucgaggaaggcagaucacgaugucaggaguuugagaccaggccggccaauauguugaaaccccgucuuuacuaaaaauacaaaaaaaauuagcugggcgugguggcacgcgccuguaguccuagcuacuugggaggcugaggcagaagaaucgcuuaaacccggcaggugaaggucgcagugagccaagaucacgccacugcacuccagccugggugacagagggagacuccgucucaaaacaaacaaacaagcaaaaaaaaccuaaauacuugccuggugcuccuggaaaaauuuuuccuaaaaaaaaaaaucagcugggcaugguggcuaaugccuguaaucccagcacuuuaggaggucaagacgggcggaucaccugagguugggaguucgagaccagccugaccaacauggagaaaccccaucucuacuaaaaauacaaaauuagccaggcuuggcggcacaugccuguaaucccaacuacucaggaggcugaggcaggagaauugcuugaaccccggaggcagagguugcagugagccgagacugcgccauugcacucuagccugggcaacaagagugaaacucugucucaaaaaaauaaaaauaaaaauaaaaaucacuaaagcuuuaagaugccaucauggaaaaaaauaauauacaauuaauauuaaaauaauaccauguaagugguuaauccuuaaaccuggucuucuguauuucaaaucuuccuaucacuguuuuuucuuuauuuaucaauuucaugauuauauuacgguaaauugcaacuccaucuauuaaaagcacugagugccuggcaggaaacaacucuggguaacuacaguacagaguaugccaauggacaccgagggcagaaauuccucauuaucuaccccauuaucucucccaacaccaaucccagauuuuuuauuggggggugggaggaguucuauuuuagccuacacauaucaugauccuuuuaccucuccaagaaaucuccugacuccaacuauucccccuccuccacuucacaggcacuaucaguacucaaaucuccuagacuaacaaugacuucuuuuaaagggaaauacaugugaaaagucaaagaaaauaacuguagccaaugaaugucaaagucauuuucuagguuccucacaaaccuuaggauuuccuaaagccaaaugcuucucauuaaggaacuuaagcuagcucuuccucuguuaaguacuucuaaauacaugcccauacagacuguauucucccaaaagaaaaggaaucucuaccugugcauaguuaauuguuuggccuccaaagacauguuuauuaaucucaaguagguagagacucugaaaacuuuucuuagaauuuucuagugucaucuaggcaaucacuuuuuaugaggguccagugcaaaaaauaaucaaaaacuuuccuuaucuguacauaacaagacaauguaauacgaaaccacaacacuaauguuuuagcaaauuacacacuuauauuaagauugaaaacggcuacauacuuuuuuuuuugagacggaaucuugcucugucacccaggcuggagugcagugaugccaucucggcucacugcaaccucugccuccuggguucaagcaauucuccugccucagccuccugaguaguugggacugcagguaugcgccaccacaucuggcuaauuuuuauauuuuuaguagagacgggguuucaccauguuggccaaacuggucucgaacuccugaccucaggugauccacccgccucggccucccaaagugcugggauuacaagcgugagccaccaugccaggccaugaaaacagccauauacuuuuuuaauggaaggauuaaaaauuacucuuuagguucuaugaugcauaauuauuaaauuuaggacuaacugcaaaauguuuguucauaagcuuaaaaaugucauuaaaaguagcaggucauuugaccucagcaaauauauaaaauacuacauauuugacuuaucuuuuuuaaaugugaaguguuucuuccuugaaugaauaauaccuucugaaaauguacuguugucauaucucaggcauaucuuucuuuaaaugcuauuucccuacccaacacucauaauggguauaugaagaaacaagauaaaacugaagauacauuacucaagacaaaauuaucacaucccucuuagacuucuucaguugauuccauucugggcacuugccccagaauuuauacuuuauaauucaucugguuauauagcuaauaaguauauuuaguauauguauauaaucuuguauauuauaaaauaccauuuuaucaucguuagcuauucaauaagcacuuacugauugccuacuaugugccaggugcaaagccuacaaaaacaaaacagcaagugaugcacccucaagaaacaaagugagaaagaaucaaaaaguaguaugaaguauuuaucauuacuuauuuggucaugguaaauucuguguaauaaaguacuaugaaaauucaaagaaugagaaaaggugguucaggucagaccucucaauucuguuaauucacaucuacccugaagcaaaaaguauugauguuacuuaaagaaaauuuguuaauauauuaccuuaacugguuauagucaaccagagaucaucaguaauaacggaaggaguauuacuggaguggaacuauagcaugguaguuaaaaaaugugcauucuagaaccacauggccuacacuggaauguuagcucugccauuuaccaacuguggcacccaaacaaccucuaugugccucaguuuccucaucuguaaaauaagaugacuaauaaaaccuauuugguuguguaguucaauaauagcaauuguuuauacuaguaauuaaacuaguaaguuuaauagcaguaauaguaauaaugaacaucuacuuuacagaauaguugaggauucaaugaguaaauacauauaaagcauucaaaacaaugcaugacuccuaauaaauguucaagaaguauuaacaaugcugacaaaaaaauuauuguugacauaacagggaaccaacggccucauuacucguuuuuggaaugcauuauuuuccaacuuaaguaguuuuauaaucaugaguuaauucacuauuauuaaggacagaaauucugcaggcagccugaguugaaauuugacuucaacacuuacuaugugcccuucucccucaguuucuucauuuguaaaugaaaauaacaaaaaauaaccuauaucauaauaucgguagaguuuaauaaauuaauaaagcacaagaaaaccacguacuaggcaguacuuaagagucaacgaucauucuuuuucuugcauaugaaucaagcagcaggguggggcuuuagaauaaacaagaauuuuucagguuaaaaacuguuuuuaguaacuuacaaaaugcucucuacaagaaaacuacagcaacuugucauugaaaaaguacggcacauuuuuagcuaaagaaucuuauguagcaauacacaggccaugaaaccaaaagaaaaacaaacagcaaguugaucacuuagguggaaaacagcacuacaguauaaggaaaucauuagacuuggauuccagcccagccuuugauugaugcuaacuucuccugcccucagucuaguacauuacuucugcagguuuuagcgauuccuguuugccaugagacauacauuuaagguaauuuuuaaaggaaauaaggaugacaaacgaaaaaacucacuauggacuuugaaagacuuuucauggcuaaacaagcaaucugaaaugcucauuuaaaagugaugggacuaccaagacuacaucucauagaaacacaccauucaaagcacuugcgaaaggauucucaaaggcaauaucuguaaacauacaaaaaagacaaguaauaaagcuguuuucuuucaguuauuaaaaagcccacuaaauaggaaagcaaagaacacaaaccacaccuccggguuaaagccgagguuaccacaggcuuucacgacgacgaaccugaugccuaaauuaccuuuuccagcaucuuccgcucucucucuaguccagcagcuucaagcuguucuuccucuucuagcauggccgggguaaucacagcaguguccaguuguucaaccauugcuggagccuccgagccugacgggggagaaagcuuucaaauugcaguuuuaaaaaaauuaccaacuacucaacuccaacaagaaacagccuuucucccacccgagaugcacuggagcaaaagcugaagaccgaggggacgccagcaucaccucucagaagacaccguaagucuucacaaugucuacaagucgccuggaccacaguuuacaacucgggaugcucgggaaaaugcaguugccuaugugaaaucuucaccggcaugcuaauacgugcgauuccgggguguccuccacucaccguugcaguuucccaacccuccuuuccuccucagucccugcccggggucggcucccuccccgaaacuccgccgcagccuccaugcuugcccaccucagccccgcaggcugccacccgcgcccaaaagguuuuccucacucaccgccgcugcccgcgggccguuccgcuggcaugccuggacacucacccgggaaccggguccccuccucucagagccugcaaugccgcgagcuaacuccucacaaccgcugccggcccagccuucuagccaaaucccc

SEQ ID NO: 192793 - RNA, 165488 nt, Homo sapiens
uauauuucagaagaaguuuauuaagagguuuuaggcuuuaagcauaugugaaaagcaaaaauuacauuuuaaaguauauaauuugcauuuuccaccuucucaaugccaaugaaauauucuaggagacucuauaagauaaccaauugauuuucuacuacucccaaauuuuaacuuuguaauuuaaagaggaauaggcaaauagagcugcugugguucugguucucccugcaggaugaagggggccugcaaaaugucuccuacuuccauucuagucauucagcaaggugccuuccucuggaugcacugucuguauacuuuugccauguugcaucacauaaugauucugcccaccuucaccauuugacugucaguaaaagaauguaugugcucauuucuucuuuuauuauagcgcagugcucuucaugaagucugaaucuuguuucauuugugauuguaauuagcacuugcuucuucaagacuggcuaaaugaugauaaucagugaaguucugugaugggcacauggauguguauuauauuuuucuacuuugguuaauauuugaauauuccaauaaguuuuaaaauaacuuguuuguuucuguuauuagaauggccuguccagaagacagccaaauacauccuucaaacagacuucacugcaggagacagaguggauucauccuguauucuccauguagacuuccaucuucaugaguacuccaagaagaugguucaguugacuauugcaaagguaaaaauccaagagauacagauacagaauaggacagagagacauauuuuuaagcuauugauuacaauuaugguaugccuauagauugcagaaccgaggagaaagggaacauuaugauuuaccaucaagaaaaacuuagaauuggugcugaguaguucauucuaagaauuaccauuuaucuguauuugcccccauuuucauuguuacuaggccaaaagucauuucauaauuaauaaguuggaugucaaaaucaacuuguguuauuauaaaauuagcaaucuacauuauguguuucuuuacauuuuuauaggaguauuuauaaauauaccuaagaaaacugacaauguggaguacaaauguugcauuuucaaaacugggaaucuguuuauugaggcucuauuuuuaguuauguaugauaauagacugcauuucagguuucaaaccuuguaaaaauaauuuccuuaugauauguuuacucauuuugcaaauaauuauugugucauauagcaagagauuguacuuccauucagcugguuaaaguacaaaaucauugauaugguuuggcuguguccccacccaaaucucaacuugaauuguaccuuccagaauucccacaggacccagggggagguaauugaaucaagggggcuggucuuucccaugcuauucuugugauagugaauaagucucacgagaucugaugguuuuaucagggguuucugcuuuugcugcuucuucauuuuucucuugcugcugccguguaagaaaugccuuucaccuccugccaugauucugaggccuccccagccagguggaacuauaaguccaauuaaaccucuuuuuguucccagucucagguaugucuuuaucagcagcaugaaaauggacuaauaguaccaguagaguggggcauugcugaaaagauacccgaaaauguggaagcaacuuuggaacuggguguugaaauaaucuggagggcucagaagaagauaggaaaauguaggaaaguuuggaaccuccuagagacugugaauggcauugacaaaaauacugauagugauaugaacaauaagguccaggcugagguggucucagauggagaugaagaccuuguugggaacugaaguaaaggugacccuuguuauguuuuagcaaggagacuggcagcauuucacccuugcccuagagauuuguggaacuuagagcuugagagagaugacuuaggguaucugguggaauaaauuucuaagcagcaaagcauucaaaaggugacuugggugcuguuaaaaacauucuguuuuaaaagggaaacaagagcauaaauguggaaaaucugcagccugaugaugcaguagaaaagaaaaacccauuuuuuuuaaggagaaauucaagcuggcugcagaaauuugcauaagcagcaaggagccuaauguuaauccccaagaccauggggaaaaugucuccaggucaugucagagaccuucauggcagccccucccaucacaggcccagaggcccaggaggaaaaagugguuuugugggcugggcccagggucucugugcugugugcagccuagggacuuggugcccugugucccagcugcuccagccauggcugaaaggagccaacauagagcuugggcuguggcuucagaggguagaggccccaagcauuggcagcuuccaugugauguugagccugugggugcagagaugucaagaauugagauuugggaaccucugccuagauuucagaauauauauggaaacaccuggauguccaggcaaaaguuugcugcaggggcagagcccucauggggaaccucuccuagggcaguguggaagggaaauguggggcagagcccccacacagagucccuguuggggcacugccuaguggagcugugagaagaaggccacagucccagaacgguagaccccagaaugguagaccccagaaugguagaucaaccaccaacuugcaucuugugccuggaaaagcuacagacacucaacaucagccugagaaagcagccaggagggaggcuguacucugcaaagccacaggggcggagcugcacaagaccaugggaaccuaucucuugcaucagcaugaccugaaugugagacauggagucaaaggagaucauuauggagcuuuaaaauuugacugccccacuggauuucagacuugcauggacccuguaaccccuuuguuuuggccaauuucucucauuuggaacagcuguauuuacccaauaccuguaccccccauuguaucuaggagguaacuagcuugcuuuuacaggcuuguaaguggaagggacuugccuugucucagaugagacuuuggacuguggacuuuuggguuaaugcugaaaugaguuaagacuuuggggaacuguugggaaggaaugauugguuuugaaaugugaggauuaugaaauuuggaggagcccagggaggaaugauaugguuuggcuguguccccacccaaaucucaacuugaauuguaucucccagaauucccacauguugugggagggacgcagugggagguaauugaaucauggaggccagucuuuucugugcuauucucgugauaauaagucccacaagaucugguggguuuaugaagaguuucugcuuuugcuucuuccucauuuugcucuugaugccaccacguaagaaguaccuuuugccucccaccugauuuugaggccuccccagccauguggaacuguaaguccaauuaaacccuuuuuguuuccagucucagauaugucuuuaucagcagcauggaaacgaacuaauacaaucauaguuuuuaaaaaccaaucuaaauguaacuauugaacaugauuagcuguuucaucccuaguagagugacagaaggaaacauccauagacaggaguaauaagaaaccagcuaaacuucuaaaccauuuuuaaaggaugcgugugagcuggcauaaccuaccuacucuuuccuaugggccucuacugagagcauggagguaauacaucuaauacacugaagaccagggcaagagagcuggaagaaaucccucuuaagcacuccaggccuucacugaguaugaggugcuggucuccaaaggcagagggcaaggcaaggcagagagggaucuccuggggcacagacaacugacaaaagaaacacuuggauuguuguauaagaggagugagcuuuguaaauaccacguuagcuggccugcuguggaacagaaugccugugaaugacaguagucagguaguggaugaacacugaucugagagccuguaaaagaaacucuuuggaaugauaaugucaucuagaccuuugauacgcaaagugugauuccuggacagauguauuggcuuuaccuggcagcuuguuggaaauguaaaaccucaggccucaccccagaccuacugaauuauuuauauuaauuaaaauuaaauaauuuuuauuucaacaaaaucccuggguaauuuguauguacauuaaauuuugagaugcaugaucuuuuaagguucauucuaauccuuaaaauucuguuuuaauaauguguacaaugaagugcugcauggcaaacuacacagaaacuaaaggcauguuccaaaaaggaaaaguuccauguggcuaggggaauaaaagcuucaucagggaaccaggaguugggcugguucuuaaaaccuggagaaagaagaugguuacaucaagagauaaauagagugaagcagaacuaguggugcggaccagcucgccagcaacagaaggguuuguagucggccuggcaguggacagggagguuggcuagaacuauuaccuuagguccgugauaauaucccugaauccaacuuuucagaaagaaauagguaacauauuuuucaccaggaagcuucacccagacacugaacagaauggucucagugcacuaauggaggcucaguuaaaggguugugguagcacaaggaagagacauucugacuuggaaauuuggagaaggcuucacaaaugaaggggcauuugaaaugagcuuugaaggugcaagaguauuccaaguugagaagacaaccugagugguguugggugaacagucauucuaccuggcuguaguguaguauaguguaguguaguguaggaaacaucagaggaguggagugggauaugagccuggagagagcuggcggccauggaucauugaaagccuugaaugucugauggggagguugacuuuauuuuguaggcaauggaaagccaccagugguuuuaguugagcagcaaugaaauuaagccugugcuuugcaaagauuaaucuagcagcaacagauuggaagcaacaccaccauuccugguaucaguccagguaaaauauauuacagcucuuuacuggagcaauaacaguaauauuagaaggagaaauaaaaaagaaaaauauugcacaggcagaauggggaggucccagugauggagcugaucuugguucauugaggcagggguggcauuaaucauguaaaacacaggaggaggaacuggguuaggaguaaugguagaguucaguuuagguaauugcaaauacacacuauucccugacuagcucccaagacuuuuucuucccucucuucuuagaacuucauuagaagaggugauguuauuucuuagaugagaguaucuuacuuaccauugacuaauacauguucucugaugaacuuugcuauucaacauacaugcaaagggguuauaaaaacaagucaacucuagugcugaugagggugaucaucaucacugaucauggugucaguugauuauagugucaauuuauaacuuaauuuauguaaaauagagcaaugcaaaagacauagcaaucuucacuucaaaugaagagucuugaaugccacuuuucuaaagagaaggcucauggaggcaccuccucacuauugaaaaauccauuauaccugugauaaaacugauuguguucaguuguauuagauuuguaugcaaauaaaaaguuggguaauuagcuauacauuguccuaaacguauaaaauaagaaaaauacauagauguaugguuuccuaggacaucuaccaguuuagaaugcgaggcuaaugugggagcugccacagcauccugauuaaggcuauggaaagaaguugcagacugaugaugucuuagaaguaaugacauuuuuuaaagauaauauuucuuuggugagauaaacagauuauauuuuacaguaaacacauuuuauauuucaguuaauaagacauuguauauuaaauaaucgcauuuaaugcuuuacuuuuuuccuguguuaaaauuaaucacucauggccuuggccauaugacuuugccauuccucccacuguuuaucugacuuguuuauauuuuauugagcuugcucauaugacuuacaauagccugugacagaagugacaggagaccccauccugaccaagaccuuaagaggcauccuaguuuccucucacuuucacgagccucugcgggguucaucaugagaacauaucccuagaaaccacuggacaaggagaacaagagguauauggaauaggucugauccacccuuaccaccugaaguagagcugcccagcuggcuugcagacucacaaacaugaaaaucaauguuuacugcagcaauucaugaaacuuugaggcuguuauaaaaaguaaaggaccuaauacaaauggaaagaaacaugguuaguaagcaaagcuaguuaugagcagcugucauguucuaacaguuggaauuugaaucagagcaacuauugguauuugaaucagagaggggccagaccaguuugggugaaacucaguucaucuuuuaaacugacaauaaagggaauauauuuucauaguaauuuuaucauuauguggcaaacuuuguucugugagcuauuaaaauauucaucuuggccaggugcaguggcuuacgccuguaaucucaacacuuugggaggccaaggcaggaggauugcuugagggcaggaguucgagaccagccuggacaacauaggaaaacccugucucuacagaaaaaaaaauagcuagacaugguggugcacaccuguaguccuagcuacuuaggugcacaccuguagccuugcuugagcuugggaggucgaggcugcagugagccaugaucaugccacugcauuccagccugggcaacagagcaagacuagcuccaaaaaaaaaaucaucuuuauuuuaauauucaaauuuacauuuugaguauggaauguaagcaucaagaauuaaucuuuaaauccagaugaaacuuucccaaggucucuugucaugcaucuuggacugaauaacaggcaucccugccuucacaucuucaugggaaggcaacaaaaccugaggaauacaaccuaggaucucaaaagcuuuuuuaggaauaaugucauauauaauaaauaauagcaagaauguuacagcaucuauagcucuuuaaacuaccucccaagggaaagacaaugagggcuuaguuccugugucuuuuaaacuuuaacuuuacguguauuuuuuuggacaugugcuguccaguaugguagcuacaagccacaugugaggugaacacacagcuaguccuaauuaagaugugcuguaaauguaauagacacaaaauauuuugaaaauuuaguaugagaaaaauauuaacaauuuuuauauugauuccuugauaguauuuuggauuuaguugcuuucugaaaacucuccuguguuacccaguuugaguguaccauaccauccaucucuugcagggaccuugacugauacaacauuaaaaugaaguguaauuuuaaaaaauuuuauuuacauauuucuuauuaagaauuggaugaauugaaacuucuuuauuuucuuucucuuucuugucacacagaaagccugauuaaguagcauuauucuuuugucuacagaaguaaccacuucuggccaggcaugguggcucacuccuguaaucccagcacuuugggagcccgaggcaauaggaucaccugagauugggaguuggagaccagccuggccaacauggugaaacccugucuuuacuaaaaauacaaaaauuagccgggugugguggugggcaccugcaaucccagcuacucgggaggcugaggcaggagaauugcuugaacccaggaggcggagguugcagugagccgagauagcaccacugcacuccagccugggcaauggagugagacucucucucaaaaaaaaaaaaaaaaaaaaaaaaaaguaaugacuucugcugaucuuuuuucuccccuauagguucauagaaaaaaaacucccaccuuauaaaggaaucuuuaaaagguuccucauaaaggaacaggguuagcagaaccaaguuuugaguccugggugaaaauccaggggagaaugguaaucagugauaaccaauggccaauccaauauuaaaauuaguuaacagugaccaaucuuauuucaccuaccccacccagaguggcccaaagcagauugcuggaucugccucuaaaccaaccuuccugccaaaauaauugggguuagguugugucugcugauugucuccauaauuugagauuuuaacaaguugaguuuggcucccaaauaccuuaaaggauuuuuuuuuuggcaucucuggggagggggagauuggacguaggcaaccaaacaggaauggaauaagaaaagauuuguguucucugaaggagacuugugaagucuaauuccaacuugcugagggaaaguguuuagaaaagaaaaagcaauaggcuucaaccagaagacaugaguuggaguaucugcucugccauguaguaguuugugugauccucauuuguaaaauggaaauacuauuuacacccuuauggguuguugugagggucagaauagauugugugcaugacagugcuuuguauacgcagacagaaggaaaaaagcggcuguuauuggcucaacuuauuugaccuuuauuuucaucaucaucggccacuauuugaugucaaucuacuaugcugugagcaaacauuaaaauuaggaagccagggguaugggaaccacugauuagcaucauaugccagaugugcuuccauccaaagcacaugaacagaaugauauuaaauuacaagccuaucaggaacagaccagcuuucugccucccuuucuaugaauaccaagucccaugaaccuuguauucauguggaguuuuaagugcaugcuuggaaguuaugaggagacagccugguauguucgggaaagaaaauaaagguuagguacaugguaggcuuuggcucagccauuugggcaaaugacuuaaccucucugaaccucaguuucuguuucuaugaagugggaauuguaauaccuaccuucuucagauuguugugaggauuaaaugagaagaugaauguaauacccuugagcacacagcgugguacaccacaaaugcucaaccaacagcagcgaugacaguauaggcaacuaccacaagaaagaauuugaacaugucccaauucgaauuuugauuccuaaucaagaucuagugaauuuaaccuaaguagcagaaaagaagauuaagaguuccuuuccacagcuuuauuaaguuuuuauauucaccuggauguugucaaaagugacuugaucauucaagagauaggggacauuuggcuuccgguuugugugagagcuuuucuuuccccaucagcucaacagucaguccccagaucuagagauggagagcuugggacaaggucagaaugaaacaucaccagucaauccugcucaacagguaacucuugcagcaauccuuaaggaaaggggugcagggucucuucauguuuccaugguaaggucuauagcugcugcuucauggaauaagcaaacaaagcccauguugugugacggguggcaacacuuucagacuuggauccugcacauucugauguguaaauuccacgauagggcaaaagcaugccacuccacacuaaugcugcccucucacuaaauuaaaccuuggaaaaauaagauguggcuuggcuuuaaaacucagugaacuaucuuuaugguacaguugguuuccauagcuguaaacacaaaagaucuaugguuucugccuacccaggauagucuugucucuagacaauguauugaugaugcaaauguucuggaacuaaauaguggugaugguggcacaacacugugaauguacuaaaugucacugauuuguacguauuuaauaugaauuaaauguuaaaauggugaauuauauuuauguauauuuuaccauaauaaaaauaugcauuggaagaugcauuuuuugugacccugaguuguaacuguauuuuuauuugugacauguauauaccaccuaccucauaguaagcccugauguuugaaugcauauauuuacaucugcuuuuugcaaaucucaggucugaguguuccacucuguagcauuuggguaucaccuaggaauaugugauuuauugacauaccugcuuugggugggauugagaacuguauugacugcaugagcacauauauuuccuuauaaaacucuuuggcuuuagcacauauuugccuacuguagaaaauucuccuacccacagagcaggcugggaauggaaugugugucugccuucuccaaaggcaucauauggcuuucuuaauggauggcaaacaggagagagaaagggguucuuaaagaguacaacugaaccaguuccugagauucuucuuucagccagcucagccuccuaucacaggacucaagacucucaguucuucuagacaaagucaauauuguucuuuuauaaagcaaagauuaugaaaggugucaggucuuuaaaaccuauacaagcacaaaguacaaaggagaaagguguagcugggaaaaacucaugaaagagacaguaucugccgaaguccuugaggcaaaggauauugaauaccuccaaaagaaaggcuucaguaaaagccaaggaagcuucacacucgucaagacuggcccuggcagacagggaaggauggccuugaacacugcgauggaggaaaaugcucccuggacgauuuuuuuccucacuccagccagcauauuucagcugcuuuugcuauaccauaucuuuccagaaauaugaaggcuugugaaagauaagcaagccuaugauggccacugugaaaaggaccagggagaauagaaccaugaggaagacauagguggagugggagagagguguggacaaugguugcucagcugggaucauguuggucagguucagcauguagcccaaaguccagccggcgucgcugcccuggaucugcaaacaguggggaaagucuguuugugguuggaggaguuagaagaguuaucaccuagggcuuagaauuauuggaucaugcauuggaagaguucaaacaauauaaaucacuggcugggcacaguggcucaugccuguaaucucagcacuuugggaggccaaggagggaggaucacuugaggccaggaguuugagacuagccugggcaacauagugagacccugucucucuaaaaaauaaaauuagcugggcacgguggaacaugucuguagucucagcuauuugggagccuggguggggaggaucauuuaaucccaggaguuugaggcuucagugagcugugaucauaccacugcacuccagccugggugacagcgugagaccaugucucuuaaaaaaaaaguauauacacacacauacaucaugacuaccucgugugucaguccuaaauuugacauagguauaaucuuucaaacaaaauaaacugcuggaauuaaaggaagucuggaauauuauaacaaggaaaagauuuaaguuugaauuagcaagaucagcacugacaagaguguaaggacacuguuauccucaggccugcuacagcccucugucucaaugcuuuguuuugcuugaaaucaccauauuuaauacaggggguaaaauguuuuccccacuagugagcaugggcuuaaaaagguagagacacacugcucuggguauuuuuggucaagcaugagucgcucagcuggguucucuauuccuggauaccugcagguggugcuaugguaaagcacagcauugagguugcuucuuccggacucaggcuaagccuggcuucuaaacaacggucucaucauucacagccacucaguccccuucuucacacagagcuuucagauuggucaaccuugaaguaauaaccaacaaggaugaugaaaccaugaucauacuuucccagcuuauggaaggggccuuucagagggcugcugaagucagcacacagagucacuguagcugcugaaaugcuguuacuuuaauauaucucguuuuguguuuuguuuuguaaggaauuagucacuguuaugugggaaggugcaacugaaaaugcaaguagcuguccuuagcgaggaugcucacagugggccaacagacccaggagggcuugacacagaaugccaggguuugaagcagaauggcagaacaggacaucaagccaaagcuacaccaugcugacuccccccuuuuucaagccccaaacugcuucagucacuaccaccgaaccccaaccuccccccagcccaacaggcccccaaauuaccuugccaaugaaauggaugugcucccaggaaucagcugugaaaugauagccuugcagaaggagggagagaauguagguaccagaaaagcaguauucacucagguacuucuccuuuacuccagcguaagauguuuuuaucuagaagugaagugagggggagaucauacucguaugauaggcaccucucuguggcccucuuuuucucuacuagcccugaugaagagaggggaaagccccagcuccagugcaccugaagguuggccucuuccagaggguuuuggggguggugcugcacuccuucagugggagcaggguuuuauaguuuagggucucuuaaggaagcuuuuccugcacaggcuucuaugagauaauaacagguccuccaggaaaaaaguaguuccuguggucuaguagguucugaaacacuaaauuucaguaccucuguucaugcccuagacuuuguuuaaucugaguuuucuauaugcucuugaccagagccuuuggcccacagccauaaaaagccuuaccacucacuuuagucccuggacuggcagcaucagcaucacuugggagcugguuaguccucaccuuaaaacuaccaauucagaaucugcaucccaauaugauucccaggugauucacgugcacaguaaaguuugagaaacacagcuguggacacaguuuaggcagcauuuugcugaggacugcuagcacugccaacaucucaccuucuaucuucugucuuaaugucuuuuuuugcaucugagucaugcaaagugguuguuuccuugaguccuuccuauguuuacucauccuacucccuacuaaaaauauuaagagcugcuugccaucccuugcccuuaccuagccuagcuguugugaauauacacccagauacccacagccugcucugcaacucuccugcccucaauuugaggacaacaggccaggaccucucuaguucagccuggacuucugucugcugccccauuccucagcccuucagauaggcauucccuccuggauacccucggcagagagagaacauuuguuaugcaugcaucauguaccaucuggaacuaugccagauguuuuauauguaguaucuccuugaugccuaaaccacaccccucuuuucccagauuucucucccuuccguggguccuaacccauaugcaaauccuaaccgcuggcuggggucuguuucucacuugguucuugccuguccccaguuucuggaaggauaaguccauaacuagacugccuugucuugcucugaugaaauucucagaaugacccagcuuggagcuugucuuuucagcacaguucuggaaauuauccuuugauugauuccucugcaugugacauccucuugagaccuugguguggacaucaguuggcauugccuguccagguuccuaccccuuccuuucagucacugcauucugcuuucccuuugugaaaagaccuccuccccuauugaaguagucuugggccugucaauugaaggaugccuaugggacacaaaaucccaagaaucuacuuagguccaacuugaaagugcugagccccuguagguccuugaaggcuggccuaucccuuguggggggcugggagaugccauuuuggccuaauuucccugaauucuuuaauacuccuauuccccuccuccuucuggaaaucuguacauuggcuaugcagucuggccuccugaagguuaugauaguagccaaaaauauagaagccaaaaaggcauccaccuucuucaucaauccagaauugaucaugcucaugccuguggguggaucacuaugugcucuccaaauugggaggggaagucuacucuccucucuccucucucucccaccuuccccucucucuucucuccuuucuauucccagggcaguggaacaugaugagguucuuuucucuucauggauauccucuuucugcccuccacauaaaggggcauugauggaucuucaagaaugggaugccuuucccuagaaaggcuaaauauucaugaggcugaaugugaggauccagaguacacugaaauauaacuggucaucaguacacauagaaucugaucacauuguucacuugggcugaccagaucuuggaugaccagauuuucagaguagaaaauuggcuguguucuggcugcugaaagauucuacuagcccucuaaugaagcugccagaagacaaccauggagucucccuuccacucacucuccuggucccuccacuucagagacccaauggcuucagguaccugacugagugucagcaggugugguuugcauuuuauuucccuugccaaagcaggggaaggcagcaugauaggauaugcauaaagcacagcaagcaaauguccaccacugucaacacauaguacaugcuuaaacauuguuaauuaucucucuaccaaagguguuuaggaggaacauucccaaacacaagccauacuggaguagcaguccaugaugaaguuaggagggaaagaagaaagagucaccuucuaacaauguacuugacaaaacuaugcuuucuaccuggguggacgaugcagcuugggaaagugaacccugggucauaacauccaccucaaugcuguaggcucugggugaagacaggggucuaacccugcaaccccuuccccaaaugcuucaggaauucucccaaaugcaggcccuucuuagcuuacuuccagggccucugaacaacuccccacaugacuuaccugagcagaacuacaggucuaaauauaagcauucccagccuaacauagucuuaugaaguaaaacaugagauguggauaagagaggaaaccugacagaacuuuuuuuuuuuuuuuaauuuuugagauggaguccugcucugucacccaggcuggagugcaguggcacaaucucagcucacugcaagcuccgccuccuggguucaugccauucuccugcuucagccucccaaguagcugggacuacaggugcccaccaccaugcccggcuaauuuuuuuuguauuuuuaguagagacgggguuucaccauguuagccaggaugagaacuuuuaaucuaaaccagaaguaauuuuuuuucaaagagcagccuaaaucugcuuccucagcagccacauguaggccuggucucaaauugccuccacucuaacaugcuuaucuuccuccacagaucaccgccagaugcaaaaaaccaccgcuaagcauuuuguaaaaugcugagacauauuugagcaacucuugaugaaggcccugaccacauuucuuucauguucuagacaaaauaccuggagagaauggcaagcuuccaggcucuugcucagccuuucuucccccuugucagugcagucagggauaagcaucuauuuuuaauuaauaguauuucuuaagaaugaaaacaccauucacuuuugcaacugucaacuuaaguacagcugcuguuuugagcuaugucuuuuauaaucggaguggauuccauaccucucaucccuggauuuucaucuuguggcacuggauguugaauggcucagugccucugauaagaaaaaaauugugcuucaaguuuaugaauaaguaggagauaucuuggaccugggaaauggagaggauuuuaccacaauugugucugugucagacucugcaaauugccugcuuucuugcuaacagaacucugauuuggggacugaaggaggagagugggccacaaugugcccagcucgaggcaguggcucauuauaggucuaagcucuaagcuggucacaaaauucugcaccugguuuucccagucaauccuggccauugagauauaaggggaagacugcugagucugggauagcuuuugcuuuccuguaaaaaggaacagauguaucugguucgaccccuuuucugaccuuucugaacauggcugugaugccugaagccacagccaccaucuuguguccaugaagaaacaggcacaacagcagagcugaagaagcaauggcugagauagagcagagcugcugaccccaugccagcagcugccuacugccagacuuuguauuaggugagaaaaaaauaagaucuuauuuaagccacuggaugucaaguuaucaaggaaugcugauaaauucauuccugaguccaccaucuggucuucucuaacacauuugcuggaucuuggucaaaccagcaggaguuucagagcagacucacauccucugcaucagcaacgacacagggcacucaugcuguuagagcugcugugccuagucacuuaccuccucccaaggcugagcacagaacuuuuucaucaucucagucaccuuuuccugagagacuuucucugaugucaaguuuaaaaacuucaucacaaaguaaaaagcugaaaaugccuacaagagaaaaucgcaguuuuaggcuguguuccacacagagggaugccaacuugcucuccuaaaggccgcaucccuugugcaggugccuggaaaguucugcugaguaaauuaacacacaaagugauauugcaggcccaagagcuguuuccuuccuggaagaggagccacuuugcugcugacacacauuucuaagccaccuggcaguuacuuuucuccauaauuguaauagaagagucagggagaaagaaaaauggggaaagagaauaagaaaagagagagaaagggguugcaaaaaucccauuuaaaaauacuauguacuacauaugaauguuuaauaaauauaaacaacuggaaaauucuauacaacacuauugaguuaucucugaguagcgaaauugguuuuuuccccuugugcuuauuuuuugccuauuuucuauaaugaauauguacugcuuuccuuuaaaaaauccaucuuuauucaacaaauauuuauuacaggucuacuaugggcuagguacuauuuuagacacaacugaaauuuuuuaaaaaucauuaucaucaucaaacauaagaacuauaaaaaaaguuaaaaguucaaaucaguaaaacaaaaaaaaauucuauuaaaaugaccucuaaauucuacuacuuagugacaacugcuauucaauauaguauauaggcuucuagcaucuuucucauucuaugauacauauaaaauguuuauuauacuucauaccacccuauaacugccuuuuuacucuuuuaauagagcauaauuuaaaggggaaaaaauaauugagcagagcuugcuagaugaggcaauucaaaccccaacuccagugcuuuuccucuuuccuacccaaaaaggugccaguuuuuagggggaaaucauguuggauauuaaaggagcacaucauuuguucauucagcaaacacacugagcucuguuugcuagacacugugcugagucauaguuuacugagauuauuugaggggggcauaaaguuuucccuguggcaaacacgguuagauuggggauuauaauuugccuucuguaaaauuacuuaacuagaagugaauguagaaagcaaaugugauucccaaaguguaauucgcauaggcaaagaaacagaguuuugguaggcaaagaaacaggagguagcagagaucccauugggggcucacugugacucagagaugaggaaaaauauccuccaccaggcaauuuccugcugcaaacaggccguaugccucaguuccaauugacauaaacccagugccagcuucuuaaaaguugcauuuuucaauauucuuauacauauauaucuaauaacauaagugugagcauauuaguccuuuuuaauaaauuuuccuuuuuuuggcuugauuuuuuucuuccacuuucagucccaacaggaguucauacuaacaacuuaauaugaagccuuccauuuuucccaugcuccuauaaucauauacaaacacacacauauaaaggguuuguuuuagaaaugaaauuuuaaacagauucuucaucuugcuuuucuuaacaauccuuuauagaaaucccuccaagucagcuggggccacucuaauggccacauaagagucuacgguguagauguaucuuaauuuauucaacaacucucuacugguagauauucuccugauuuccagcaauuuccccuaugagcaaugguauaaauacauuuagccucugaacugguaugcucauuccucuaggaagucgagcucugcagaaacuggagagccuccauaugcccugaacucaggaauuccagcacuuccauuaucauuguaucccaggugcagaaaaagaucgugguaugguccuauuucugcccucuuaacccaagccacuaucaucucguguggauacugcaauggccucuuaauuagucuccacauuagcuuucugguucuaguccaacccauccuacaaacagcagucacaggaaucuuuuaaaaacaaaucugaucauaucacuccccugcuuaaaaccuuugguggcuccuaauuauacuuagaauaaaaaucaaauccuacaaggucgcugaaaaccaggcauguucuagcccugcccccaugcccaccauacccagcacccuggcuuucaauccccgccaagccuuuccuccccuagaaccuguacacuugcuauucccucugcuggaauucccuggacuuccacuuccccuccuuagaggggucucuaggacccucuguuaucugcuuucacaggacugucucuuuccucccagcaguuacuuuuuuuuuuuuuuuugagauggagucuugcucugucgcccaggcuggagugcaguggcgcgaucucggcucacugcaagcucugcguccggguucacgccauucuccugccucagccucccgaguagcugggauuacaggcgccugccaccacgcccggcuaauuuguauuuuuaguagagacgggguuucaccgcauuagccaggauggucucaaucuccuaaccucgugauccgcccgcgucggccucccaaagugcugggauuacaggcguaagccaccgcgaccugccccagcaguuccuuuugauuugcagcagucggauuugccuuuguuuguguuucuggucucaugucugccugcuuucuagaaugccaacucugugauggcaggcgcggaauuucccuuguucuugguugaaucugcccucacuaacauggcacuuggcauaugugagugcuccguaaauaaguggcagaaaacugcucucucucuaguuccuaaggcacaacaaucucuguuaaaucuggauaaauuuauauaugcuuggauucgcauagcuaaugccuggaaaaguucuuccuguuuauuacaacuauuccucauuuuuccucuagugaacugaugguggggugagagggagaagagaccuuuuagucuuuacuuuaagcuuuuuguacaguuuuuuuauaaugagcauguaauaaagcacuaauaaauauuuccuuaaauuguuacauuucaaaagacuuucugaaauuaauccuagagcuuauucuauuagcaaaagucucaaugagguaagcaucuagaaacucucuugcuuuugcuaaguagugacauuugcuuuauaaaguaaguacaaauuauaaaaaacagaucaacaaacaacaaauuucuaugagguagauuuagcaacauauugagccuucaguaggauacauagcgaucaagucagcagggccuccugguccaugccaccuccaaccccccaagacacuacaugccaucggcucuugaaaaauuucccaugaccuucagaagccucccucuggcaucucagaaucuugcucuuauuuauuucucaaaacaugaaguuucccuauucauuucuuuuccuucaaaauagaaaugucuuuaaaaugcuggcuuauuaaaaaaaaacacguuuauuauauagaauuuaaauaauacaaguuaaaaauggaagucccuccuuaaucuaaccauccucuagagauguacacuuuuuaacaauuuacuguuuaauaucuauagcaaauagauauguaauagaaaauagugaauacauauuuauauaauuauauauguguauauguauauauauaaccuaaauaugaugauacuagacaaauuuuuuauaauacugcuuuguuuuacuuaauacaucauguguccuugcugcaaaugccaugauuucauuccuuuuuauggcugaguaguauuccauaguguguguauauacauuuauguguguguauauauauauauauauauaugcauacauauauauauuuaccacauuuucuuuguccacuuguugauugaugggcauuuggacugguuccauauuuuugcaacugcgaauuguguugcugugaacaugugugugcaagugucuuuuucauacaaugacuuauuuuccucuggguagauauccaguagugggauugcuggaucaaacaguaguucuacuuuuaguuccuuaaggagucucuauacuguuuuccauagugguuguacugguuuacauucccaccagcagugcaaaaguguucccuuuacaccacauccaugccaacaucuauuauuuuuugauuuuuaaauuaugaccauucuugcaggagaguaagguagugucucacugugguuuuaauuugcauuucccugauaauuagugauguugagcauuuuuucauguuuguuggccauuuguauaucuucuuuuaagaauggucuagcgaaaugaaugaauugaagugagaagggaaguuuagagaaaaaagaauaaagagaaacggacaaagccucccagaaauaugggauuaugugaaaagaccaaaucuacgucugauugguguaccugaaagugacggggagaauggaaccaaguuggaaaacacucugcgggauauuauccaggagaacuuccccaaucuagcaaggcaagccaacauucaaauuaaggaaauacagagaacgccacaaagauacuccucgagaagagcaacuccaagacacauaauuaucagauucaccaaaguugaaaugaaggaaaaaauguuaagggcagccagagagaaaggucggguuacccacaaagggaagcccaucagacuaacagcagaccuuuuggcagaaacucuauaagccagaagagagugguagccaauauucaacauucuuaaagaaaagaauuuucaacccagaauuucauguccagccaaccuaagcuucauaagugaaggagaaauaaaauacuuuacagacaagcaaacacugagagauucugucaccaccaggccugcccuaaaagagcuccugaaggaagcacuaaacauggaaaggaacaacugguaccagccacugcaaaaacaugccaaauuguaaagaccaucaaggcuaggaagaaacugcaucaacuaacgagcaaaauaaccagcuaacaucauaaugacaggaucaaauucacacauaacaauauuaaccuuaaauguaaaugggcuaaaugcuccaauuaaaagacacagacuggcaaauuggauaaagagucaagacccaucagugugcuguauucaggaaacccaucucgugugcagagacacacauaggcuuaaauaaagggauggaggaagaucuaucaagcaaauagaaaacaaaaaaaggcagggguugcaauccuagucucagauaaaacagacuuuaaaccaacaaagaucaaaagagacaaagaaggccauuacauaaugguaaagggaucaauucaacaagaagagcuaacuauccuaaauauauaugcacccaauacaggagcacccaaauucauaaagcaaguccuuagugacccacaaagagacuuagacucccacacaauaauaaugggagacuuuaacaccccacugucaacauuagacagaucaaugagacagaaaguuaacaaggauauccaggaauugaacucagcucugcaccaaguggaccuaauagauagacaucuacagaacucuccaccccuaaucaacagaauauacauucuuuucagcgccacaccacacuuauuccaaaauugaccacauaguuggaaguaaagcacuccucagcaaauguaaaagaacagaaauuauaacaaacugucucucagaccacagugcaaucaaacuagaacucaggauuaagaaacucacacaaaacugcucaacuacauggaaacugaacaaccugcuccugaaugacuacuggguacguaacgaaaugaaggcagaaauaaagauguucuuugaaaccaacgagaacaaagacacaacauaccagaaucucugggacacauucaaagcaguauguagagggaaauuuauggcacuaaaugcccacaagagaaagcaggaaagaucuaaaauugacaaccuaacaucacaauuaaaagaacuagagaagcaagagcaaacauauucaaaagcuagcagaaggcaagaaauaacuaagaucacagcagaacugaaggaaauagagacacaaaaagcccuucaacaaaucagugaauccaggagcugguuuuuugaaaagaucaacaaaauugauagacugcuagcaagacuaauaaagaagaaaacagggaagaaucaaacagaugcaauaaaaaaugguaaaggggauaucaccaccgaucccacagaaauacaaacuaccaucagagaauacuauaaacaccucuaugcaaauaaacuagaaaaucuagaagaaauagauaaauuccucgacacacacacccucccaagacuaaacgaggaagaaguugaaucucugaauagaccaauaacaggcucugaaauugaggcaauaauuaauagcuuaccaaccaaaaaaaguccaggaccagauggauucacagccgaauucuaccagagauacaaggagaagcugguaccauuccuucugaaacuauuccaaucaauagaaaaagagggaaucugcccuaacucauuuuaugaggccagcaucauccugauaccaaagcuuggcagagacacaacaaaaaaagagaauuuuagaccaauauccuugaugaacauugaugcaaaaauccucaauaaaauacuggcaaaccgaauccagcagcacaucaaaaagcuuauccaccaugaugaagugggcuucaucccugggauggaaggcuggaucaacauacgaaaaucaauaaacguaauccagcauauaaacagaaccaaagacaaaagccacaugauuaucucaauagaugcagaaaaggccuuugacaaaauucaacaacucuucaugcuaaaaacucucaauaaauuagguaaugaugggacauaucucaaaauaauaagagcuaucuaugacaaacccacagccaauaucauacugaaugggcaaaaacuggaagcauucccuuugaaaacuggcacaagacagggcuacccucucucaccacuccuauucaacauaguguuggaaguucuggccagggcaaucaggcaggagaaggaaauaaagggcauucaauuaggaaaagaggaagucaaauugucccuguuugcagaugacaugauuguaugucuagaaaaccccaucaucucagcccaaaaucuccuuaagcugauaaacaacuucagcaaagucucaggauacaaaaucaaugugcaaaaaccacaagcguucuuauacaccaauaacagacaaacagagagccaaauuaugagugaacucccauucacaauugcuucaaagagaauaaaauaccugggaguccaacuuacaagggaugugaaggaccucuucaaggagaacuacaaaccacugcucaaugaaauaaaagaggauacaaacaaauggaagaacauuucaugcucauggguaggaagaaucaaugucaugaaaauggccauacugcccaagguaauuuauagauucaaugccauccccaucaagcuaccaauaacuuucuucacagaauuggaaaaaaauacuuuaaaguucauauggaaccaaaaaagagccugcauugccaagucaauccuaagccaaaagaacaaagcugaaggcaucacgcuaccugacuucaaacuauacuacaaggcuacaguaaccaaaacagcaugauacugguaccaaaacagagauacagaccaauggaacagaacagagcccucagaaauaaugccacauaucuacaacuauccgaucuuugacaaaccugacaaaaacaaacaauggggaaaggauucccuauuuaauaaauggugcugggaaaacuggcuagccauacguagaaagcugaaacuggaucccuuccuuacaccuuagacaaaaauuaauucaagauggauuaaagacuuacauguuagacccaaaaccauaaaaacccuagaagaaaaccuaggcaauacuauucaggacaugggcaugggcaaagacuucaugucuaauacaccaaaagcaauggcaacaaaagccaaaauugacaaaugggaucuaauuaaacuaaagagcuucugcacagcaaaagaaacuaccaucagagugaacaggcaaccuacagaaugggagaaaauuuuugcaaccuaaucaucugacaaagggcuaauauccagaaucuaaaaugaacucaaacaaauuuacaagaaaaaaacaaacaaccccaucacaaagugggcgaaggaccugaauagacacuucucaaaagaagacauuuuugcagccaacagauacaugaaaaaaugcucaucaucacuggccaucagagaaaugcaaaucaaaaccacaaugagauaccaucucacaccaguuagaauggcaaucauuaaaaagucaggaaacgacaggugcuggagaggauguggagaaauaggaacacuuuuacacuguuggugggacuguaaacuaguucaaccauuauggaagacaguguggcgauuccucaaggaucuagaacuagaaauaccauuugacccagccaucccauuacuggguauauacccaaaggauuauaaaucaugcugcuauaaagacacaugcacacguauguuuacugcggcacuauucacaauagcaaagacuuggaaccaacccaaaugucaaucaaugauagacuggauuaagaaaauguggcacauauacaccauggaauacuaugcagccauaaaaaaugaugaguucauguccuuugcagggacauggauggagcuggaaaccaucauucucagcaaacuaucgcagggacaaaaaaacaaacacugcauguucucacucauaggugggaauugaacaaugagaacacauggacacaggaaggggaacaucacacaccggggacugucgugggguggggggaggggggagggauagcauuaggagauauaccuaauguaaaugacgaguuaaugggugcagcacaccaacauggcguauguauacauaucuaacaaaccugcauguuguguacauguacccuagaacuuaaaguauaauuaaaaaaaaaagaucauccaaccuagauuaauguauuguuaaguuuuuggggauuuuauugguguuauuuucucuccuuuguugaacuugugaauauuuauauauuuaguacuuuucaaaaaaaauuaaaaaaauaaaauucauggucugaaaccacaauuacuuuuguaccaacaaaaauauaaauauaaauaaauauaaauauaaauauacacacauuuauguauacauauguaaacaaauguguuuuuaauguucuuuaauuccaguuuccuauugaacuuguuucuucccuuucuuauuuauauaaacagcacaaugugaucuuuaaaaauaauuucuaaauuaccucauaaguaauucccuacagauguucccucuuucuuguuaguguuucuaauuugcccacaacauuggauucuguuuagcaaccaaggcuacaguguagccagacugacuaaagcaaugacaauuuuuaauaccauauuuaccaacuaagaaucagaucaucagugcugaaugcaacuguggcaaaaacucccuccccaacaaauucucuguggcuugagaacacccaggcuaacuaguucuggaaagaaugggaaugaaacuggauuucuguguugcacauagcuaugcuucaagaggcaggacucgauaacaggaacucccugcaggaaggacagcauagaaugaagacugcuaggauaaagaccuaaccuuuuuaaggguggugcugggguaugcccgcuuuuugcuauuuacaguggugugcuggagcugacucuuucuuauguacucacaagagcugauucuuaaaauuuccagauuuuugugagccaguugauauguugauauagcuugaaauaggcugugguagaacuacuuacaccauggaaacugguaagugcuacaaaucagcuccccauuccccgagaguugguuguuggacauuucccagaccaucacugcuugucugacucacaacuaucaaugagguagauauuacuguccccauuguacagaugaggaaacagacaaaaaaacuuuaggucuuagggauacauuacagagggcauaaaacaaaacaaaacaaaaaacaucaaaaaucugaagcagaaugaaacugccaaugcagaaaucgggacaggacaguccugacccugagggcuguaucuagaggagaaagauccuacauagaggcaggcaaugcgauagucucaggaacugccaaacugagguucagaaggcugggagaacaaucucaaugaggaacuaagggaucaaauagaaaagccuccagggggaguucaagacuccuccacccuuuuccagccccuaucucucccugcuuugguuggaugaaucacauucaaaggcaagaaauuucaguccccuaaggaggaaagguuugcucaagcuugaaggcaggaauuggccauguuucccaggaagugaaacuuucugagaaguuacaaacucaagacacaaggguauguucauugacuuuagauuuacauccucgcagugacuggaaugaaaaaggcccuuggccaagguggcacccuccuuccucuucaaggaguucaaucuaaggcaagggcccuggcccaaaaaaaaguccaaggugaagagccagugccagcucagccacagggcauucaagugagguucaguuucuucugaauuuggguuugcagccaacuaauaaccaaauauuacucugccagucauugucuugucauguauuucccucaggaaccuugaggggaggguagacugugguuuggaccaugguuaagguaagucuggaucuauggcauuaccuauuguuuucucagagaccaagaaaaugaagagcucauacaguucauaagaagccagaaguagaaucagaucugauuacgacagugccuauguucucuucuagagcuuugucuugggccaagccaggugaccuuaggagaaacucucuugcugggguccuggaggggaggagcugaaccucccuucuuacaugcugaucuguuuucugaaaagggagaaagcaugaaggcaggcaaaagccuuguuucuuugaauaucuugaaugaauaaaugagauaauauacauauagugcauagucaauaauuggcauuugacagaugguagcuaauuuuucaauaugcuacuaaacuaugauuauaauaaugcucagccucugggaccaaaauaagaaauuugaagacugagucaauuaagagccaucucuucugccucugcucaaauauuuuaucuuauucuggaguuauuaagaaaauaaggaauuuggagcuaggauucaaauaaucccccaacucuucaaaacauaaugacaaugauguuaucuucaauguuucuuugggauuuccugaguuucuacuuccuaaaugucuuuauagaggaaaacccucagcugugucaucuaacugcugcuccuccuccuucuaacauuugagaagccaccuauggcaaacucuaacaggcacauaccccauagcuagcccccuucuuccucgcuuaugaaguccugauuuuacccaaguagaggaaagcaauauccucaaaaacgacuccucaggugauaaacaauaauuagucuaaacuaacuauauuaauccauuucucuuuaucacagauugguuuagaguauauauuucaccaaguucuggccagcaggaucugaaaagaugucaguuggcacuucugcaaaaugugugugcaagagaugugugcaaggaaaaccuuaaacaucuuuccugcuuuggcuuugcaugugaaagaaaauaugaugcuuggaugucugauuccaaaauggcggcauggaagcaagcuggcuucaugccccccaaccacagacaaccagaaacaaauguacagcacugagauuaucaccagcaauaucccagaaaucaaauaugaagaugagacaguuccuggggccacaaagaagugaaaaaacuccaagcagacgggaagauaaucaaacuuccacauccaugucaccucucccccgauucugccugacaccaagcuuguggaaaauuucccccaaacucacaauuuguacacuggaaaaagugagaucaagguggacaaucagcuuccccaucauccuggguucccuagcaggaaaccugucuuugucuuaacccacaguaagcaucgugacauccugaagggagauaucccuggggacaggcagagacaaggaagaggcagauuuagcauccccagcccugggaagucugcucugucacuuggccaaaggagaugccaaaucagaguggcuguucuauggcuguaggaggucugucccacaagguccccugggcacaacccccuagucaguuuucccacacugcuggggcuaaccucuuugggaccucccccauuccggaaaggcaguacucuuauuguugacuagaaaggagaugaaccugggcuuaaggugcugccuagagccaaaaaggaggcagugaccuagugauauggugcuuggagcaguaacauaccuuagcacaaaaagaucacaacgauaguggaaaaaacugaucccaaguucugacauaguugagcugaagaaccaaccccuaaucaucuaccucaagacauuauguaagagaaaaaugcauccuauuauuuaaaucuuuuguaggcacauauucuauaacuuguaaacaagacauccuauaccucaucauuucacaaacuuaccccaaaaucccccuggagugguggcaagaaaaucccauugaaggcacacugggaguaagggcaguaacugguguugaagagcuccaggaugcuuugauggcauuguugauaguuuccaauacccuggauuucaaacugcuggaauggaagagucaucucaaaucucuuggugcagggggucuuguaaaggucacuuacguucacuaccuucuuauauccaggaugaaagcaugggucccugagaauuucauuacuugcaaccugaauggaaaaaucacuugaaagcaucaugugugaacgcuuuggauacaaaagguacagucugacuuaaucaauauguaggcacuguacaacaucccaccacuugguauuggaaucaauauguccugcccugccuuuuuacccuuaggaauaaauaugaaaaauggauuuguguaacaggcaccagaagugguaucagauauaaauguauuuggcuagucaaagaaugcugauguaguuaaaacugggcccagaaaugccauuaguuugaaaugucccugagugcuuaguccuaaucaucuaggucaggagcaaauucacaaggaaacucucaagguugucaaaaauuugggccugggaguaguucuccaggagccuacauaauuuaaaaauuauuaaaaaaauuuuuuuucuucuucaagcauucuccuauccaagaaaaauaauuuuuuuuuuugagauggagucuugcucugucgcccaggcuggaguaaaauggcgcaaucucagcucacugcaaccucagccucccagguucaagcgauucuccugccucagacuccuuaguagcuggaauuacaggugugugccaccacacccggcuaauuuuuuguauuuuuaguagagacggggugucgccauguuggucaggcuggucucgaacuccggaccucaagugauccacccgccucggccucccaaagugcugggauuacaggugugagccaccacgccuggcccaaaaaaaaguaauuucuaacccacaaccuacuagggaagaaaggaggcugcuguggauaagaagguuaguggagcuuugaggcucaguggaugucucucagcgcccccuacucccaggaccaucuuauugguagugguuuugaaaaccagagagaaugcuuuggaggagagcagagaacuuguuauccuuucaguggagacagggaacagcuggauaugacauccuggcuuuguguuugcuugucagggugugccugguacucacaugauguugaguauguuuaacuuuuguuuucuuuuucuuuuucuuuucuuuuuuuucuuuuugagauggagucucgcucuguggcccaggcuggaguguaguggcacaaucucggcucacugcaaccuccaccucccaguucaagugauucuccuuucucagccucccaaguagcugggauuacagguaugugccaccaugcccagcuaauuuuuuuucuuuuuuuguauuuuuaguagagaugggguuucaccauguuggccaggcuggucuccaacuccugaccucaagugauccacccaccucagccucccaaaguguguuuaacuuuucuugucuucaaaaugcagaaggcaucuggggacaagaugacaagauuugaagugucaauugauacauuuuguguuucuccugaaguguuuuuuuuuuuuuccuucuccucuccaggucauuucuaacaacucuguuuuuuuguaguuuguaggaaagggagcuuuaaaaaguggucuaaaagagcuuauaaauugcaauucccccuccaacaaacaauauucuaccacauaauuuucauuaucaaccccacgagggggagaaauuauuuccugagagaagaucucaguugugucuguggagauaacgcaguaaacaaacaugggaggggaugucugacugaaacaauuuauaggggucaaccagauguaguucaauauccugccuaaaaagguuuggaaaguacaauaaccaaguucagacaaacuacugaauuugaaacagaaaacaacaggaugugggggcuggaggugcagaugugaagggggcaggucuggauugaguuauacuugccugaauguccuuggccaguuucugccagagugccugauccuucccauagcacaagaagcuauguguguagacauuguaguccuugccauagaggcgaaauugcagagcauuaucuggggacucgauagucugguuuugggguacaaaagugacuuguguagaggcucccccaagguccaaagcuccaaagguuuccugauuauugguuucauaugggacuaugcugaaccaccuuguuuucugaaagacaguacaguuaccagugcuagaagucucuggacacccugcuuuucauaguaucuauuggagucagggauuuccuaaggcaaagaaacaggggcauaaaggugaggcaaagcucacuagaggcuccugaucuacaacagauuaucagcaagaaaagaggggcuucaaagacauagcucagacugccggacauagaagcaguguaacugguguuuaaaaacaagaggucugaggccagacacauucaaguucaaauucucacucagucgcuuguuagcuguacagccaugggcagacuaauuacccucucuaggcaucgauauggggcucuaaaauggggaugauguaguaccucauaguguuguucuaaggauaaaaucagagaaaacaugaaaagugcugagcacagcgggagacacauagcagaaggcaaauguuagcuauucuaauuuuuaaugauaaauuuuuaauuuccuuuaugccucccuaagguaaagacauguccuuauucucccaauaguagaaggucuuguaagagaauuauaccucuggugacccuuacaaaugugagaguaaauucauucauccagucauccauccauccauccaucuaucauucauucauucauucuggcuagcgacccaaguacugccugagauagcaauggcauuggccuccagagagccaccuccauggaugcugugagauauucaccugacugaauuugcccagcagauaguugauaguaauccagccauaggcaccuuccucuuggccaguaaugauccuggcacccuggaagucaaagggguaguugcugaggcuccucuccaccacauccagaacccugucugccaacucuucacuuuccauccuguacaaaggaagagcugagguuaucauuuuuguuuuaauaauuauauuacauuacccauuucagcuacagcauccacacagugcuacuaagaagugaaccauaaugcccuggaauaaaugaagagauggggaucuucgcacauagcuguccaagaaaccccuuuuuuggaugaggcagaauuaauauuuuguucaucucucuccaaauccacauccuuccaauccuuucauagguugguuuuccuuaaaauaccacuuuuguucugaaguucccuggcucaaaaaguuaucaaaggcucuuaaaauuacugugguggugauagcuggguaugguuugaugaccauaccugaagcugaugugugcuauauuaaccacuguggguggcuccuagcugguuacauggccagacucugcuccagguuuuuaauuaggguucuaguagaaaccagguggcaaaugaccuggaauagauauccaaucuccucugcugccagacugggaaaaaucuuccucauauuacagcucaguucuugggucuguuugagaccuugagaccuaaagaaggaaucuuccaggguugucuuaaugaagaugggaugcaauugcuuccaagaucuaggcuacccaacacugggagucucugagcgagaggaugcuaccuuccagcuggcauuaggccccugucaucucucaucuaaauggcguccacaccuacuaacugccuuccuuuuauccccagcuuuucuccccuccaauccaucuucucuaccagugucaccaguuguguagcauccuuuaauggcuuccuacuaucucuaagauaaacuccaaacuuccuagcauggccccauagggcacuuugugaccuggacccuuccuuuucagaaucccacucagaauccuggcuccaccacuucccaggugugugaccuugggugaguuacuuaacauuuguaagccacagcuuccuuaucuuguuaauaauuguuaauuucauagaguuguuaugacagugcaauuaagugcuuagcguagugcuaagaacauaggacgggcucaauaaauacgagcugcuacuauuauuaucauuauuauuuuacacuacuuaccuaucuucuaucuaugcagaacuacuuacaguccucugaauaugccucucacacuucccuaccuuugcacauccgguagaacacaagcuccaugaagucagagacuuuguccuguucacuguuguauccucaguacuuagaacagugccugacauauaauaggugcugaauaaacaucaguuacugaaugcaugcugucuguucugcugauaaagcuguuccccgauccuccaacucauuuuucaugauucaguucaggcaucccuuccucuaagucuuccugaccuccucucacccugggcagggccaaaugugcucccauagcagcucugagcacuccucuauuaaaacacugaucacccugcauugaaacugauuuccuugaggguugaguuuucauauucuggauagagcaggcacuauaugcugaaugaaugaacaagugaacaaauaauucacacagguaucaagugauauaaagaugugcuaguugugaauauuuaugaccugggaugucuaugagucuccucuuauccucuuccucccagauauugaauaguuaaaucuguagccccaaaccccagaguauacgggcccagucuuucucucccugugccccuuccccuuugaaucccccauagggagaugcacaagggggcuuuuuuuuuuaacauacauaaaauccuaccccuauauauacuaagaguuugaacauuuuauucacuuacuaaaauauccuuucuuaaguauggacuuggguguguagaacuugggguauuagggaguguggcccuuucccauaacuucagaggcucuuucacugccaagccuaacucccagauacucuuggucccuacaugcugcuauaccugagcaaccgcaugccugccguggcucccagguaaacgggugucucuuggugcugggaccuuggaaucacuucccuagcucuuuccaugcaaucagucagguaaaugccuauuucauuuacuuucugaacaaauuuugagauuccaggaccuaggaaaaaauguagaagauaacaaucuuuuaaaaaaaaauuauaaaacauaccuugacaauaguagaucaaaauaugguguuuugaaaaaaauacaagaaaacaauuuccugauguacuauacauuagguuauuguacuuagaggguaauucacuggaccuagccuugagaggauuuaauuuccagacuuuaaguugggucuguucaguguucaauaauucugccacuggauggcgcaauuucauauucaauugcauaacauucucagacuuuaauggggauauuauagauagcuacucuguuagcugcuuuuugauauuuccuccagaacacuguaauuaaugacacuaguuccuaaaagaccuaaagauaacacuuggaauaaaaauuaagcgucagacaaauuggcuuuuacuaaaaagauggaagcugccacuaacuaguuaucugauccuggccagcaccuuaaaguuucugagguggaguugcuuccuguuacaagaaagaggaacagaaucuaugucucuucagugacuuuuccacuccgauauccugccucccuagcaaaacuguuuuuccaguuuuagagcaaaaccgacuguugcuauggaggauuagagccaagauuccuuaagcuuuuugaaguuauaacaacacuuucaucucacauuaagauaaauaucuacacuaucagugcuucauagcagaguaauugcuuuaaggauaauuauucaaauaaguuauccagaucauucacagguuuucaaacagccuaauaaccaugagaaaaucagcucuaaguuaccagcuaauuguuuugauucagaaaauuugguguuaaauauuugauuaacuagagaacucucucuuuugagagggaagaauccuucauuguuaggccaaacgcucaugggauaagucucagaagaaggacaucugcuagauuuuuuuuuuugagacggagucuugcucugucgcccaggcuggaguguaguggcgcgaucucggcuaacugcaaccuccgccucccggguucaagugauucuccugccucagccacccuaguagcugggacuacaggcacgcaccaccaugccuagcuaauuuuuuuguauuuuuaguagauacaggguuucaccguguuagccaggauggucuccaucuccugaccuugugauccgcccaccucagccucccaaagugcugggauuacaggcaugagccaccgugcuuggccauuaaaauaacuuuuaaaaauggaaggcagugugucaaauaaaagccaauaaaaugagggauuugggcuuuaagaaaggccagaaguacugucucagauggggccaaagugucaguauugauggggcuacuggguagaaugacuugcucucuuggaaauaucuccucucuacuacuuucuugacgaccugugaaaauuaguggauuccacaggcugucaaacugaaaaucaauuaucuucuaggaucuaggcuaucagucugacuaaaaauaaacaguggguucccagcucaaaaggcuaagagagauaaaagucagagagacugugguauaauggugcaugguaggguacuggguaaagggauugaaagcugaaugucaaccacucuaacauauuaugaccuuaaaagaaaaaaauuauugauauauaaugcagcagcucagaguagcaggaaaccuagaguguaauuaggagaccuagauucuugucucuauucuguugcuacuuucaaggcacuaauccuccagguuuuuguuuccuucucugugaaacaaaauuuaaacgaucuguaaguuccuuuucccagcccuaagagccuauaauuuggucuuuccugccuacacagaagcugaaagcuuugaaaaaugucuuccaagcuguagaucaggguacaaagauuaagagagcaauaaaucucugaaccagacagauuagcaucaccuaggaacuucuuagaaauacagauuaucaggcuucauuccagaucugcugacucagaaacucuaggggaugggacccaucaucuguguuuuuaacaagcucaugcaaguuugagaagcacuggcuaagaugcagacuugaagucgggcagaacuugguuugaaccgcagcuccaucacuuacuagcuugaguaacaaacaagugguauaaccucucucaaccucagugcccucauuuuuaaaaaauuaguauaauaaugcauaccucaaagggagauuaugaggguauacugaaguaacacauguucaguacuaaguacauagcaugcagaaguguucuguugaugggagcuacuauuaauuauauuuauguguguuuauucuuagguuuugaucauuaacgacugauuucaauauguuuucuguaacgauaacauaacaacagcagcugcacuguuuucuucacuuggcuuccuaugcgugggacuccuuuuucucuuguguucuacuggucauacaccucucauguucucaugccccacuguuggccuccccuucccuuggucuucaucuuaccuuuaacccugcauucuucuacuugaugcaccacgccugugucauucuccuuuucugcuggccacuuauagauguauaaacuugugugagaagaacccgcauccagcacaaucccauacugaaagcaacacagaccaaaaacuuaucaguaucacaucacucaucuccauauuaggcuugcaaaagaaaggacuggaauuuucaaaaacaugaggagaaaguauuugagaggaacauugaggggauggcacuggagucacuccgaucacaagaucuaccaggacaacaacccugcuagaacggggcucuucaugcuguuugcauguuagaaauauucagaccuuaugcagaacagggcccaagaagcaguauuguuuagaagcuucuuaggugauucuaaugugcagccaagauucagaaccacaugcugaaguagcugagacacuauggaaggaauagaaagccauuaaucuauaguccccaaacuugucuacacauuggaaucauacgggaaucaccuggaaagcuucaauggcuacugaugcuuguguccuagacccagguauugugaucuaauugaugugguauuguguccugggcuuuggaauuuuuauaaggucccacaugauucuaaugugcagauaaguuugggaaccacugaguuacuccauugaaugccaguaagacguaauaaauauguucaucuaauuuuaguucaauaaaugcagaguuuguuuuaaggagagguguaaaaacacuaaauacacucacuuuuaaauuaugaauauaacuguaaaauuguauuuaauauauuuuacaauauauguacuuaaacuucauguuuuuagcuuuacgaguagggggagaugaaaagaagaaaaaaaggaggaaagaaagucagcagaggagaagaaggacagaugacagcaggagaaagaacuagaaacagaaacuauacacagaaacauagaagcaagggcugggcaauaauuuucaaauuggugcccccuuuuaaggacauuaaaugagggguagcuacaguaaagugugcaaauacuaggcauacaccucaauaaauuuuugcauaugugcacauccauauaaccaccacccagaucaagauacagaacacauucuagcccucauaaggcuucccagugccccucucagucaguuaccacugucuuaacuucuaccaccauguaugaguucugccuguuuuugaacugcaauguaugaacucacauaguaugccuccuuuaugucuaacuucuuucacuuuacacuauguaagaugaacucaaacuguguguaucaguaguucaucuuuuuccaucacugcaaaguauuucauuauauggauauacuauauuuuuauccauucaacuguugauggacauucggguuauuuccaguuuggggcuacuggaaauauagcugccagaaacauucauaugcauuucauuuuguugaaauaagcucucauuucuuuggggguaucuauccaggaguaaacugcucaaugcccauuuugaucaacugauagucaucuuugguuauaucucugggcuuacucaggauuaaaaaauuccaugauugauuaaugacaucugauaugaacuugggagaagagcaugauggcacaugugcuuuuaaaucuuccuuagagaagaaacauagagggaaguaaauggggaagcgaaaggaagagaagaaggagacgcuugucacguggcugcuuauuuaagcugcagaccucaaaguauggucugccacuuuaaaaaugcuuaauuuagcuguguguguggguguguguggguguguggugugugugugugugugugugugugugaaucucccuacauauauaagcuagguugcaugaacagaagcaguggucuggaaagaggaacaguagaaaugaccuuguuugguucauggagacaccaauguaggggccccagugaagaccugaaaauguagguggcaauggguauauauaucaucugcuaugaaucuaagagacuccagggagaaaagaagacaagaaauaggauuuaagagaccucccuggaccacuaggaaaagcuaaaaguagagccuauugagugucaaacucuacuccauuucacuagaccagggaguaccaccgugcagaccuugcaaggacccuugaccugccauaaccuccacaguguucucuuccuaguuacacacaguggggauucccuccaguaauuagcauuaugccuuuagaaagaaaagggccuguaugcuggcuuugggcacagcaaggaagcaagcuggacagacuccucugcagcuaggcuugcagugaaaggaauccaagaaauggcuuaggugguggccauugugggcagagaggaacacugacuaaggucuggggccacuggacccuugagaaaccucccagaguggagaaagaggcucaggaauuacacauggcagaaaauucuguuguuuccuaacagagccccugauuucuuccugccagaaaauguuccaaccacagcagcauacgacagaaacuggugagguagaagcagcaagcagcauuuaucugggaucagauuuuauucuaacauuguugauacgaaagucauucuucccauagagccaaagaaccaggcuugcuucugucagcuuguuuucucuaaggccuuacuuacacagugagguaguugagaaacaaaaacuuuuacuacguuucauuugacaaguguuugagaaggggguaaagcauauuuuaacacaaauugaagacauuucaucuuguguacacaguacacuagcaugcuaaccugugcaacugugccaaacauuuugucuucuaaaauggcuugcagaauaaaaaacuggcauuguuugcugcuugagagacagauaaagcuugacugaaaguucaauuugagcauuuggggagcuugccuuucuuuguuacaacauccaucagagcccagguagccacaacguuuuguucucuuuccaccacaccagcauuuuccaaugcauguuccagagaguacgaggccuacaggggcuucaguaaauaaagcuucccagaagucuggagaauguucauguucucucugccuccugggcucaaaaguccauuagcuagugaaugccucaaagucuggcaguggagaaacccaacauuucucuguagcuuauauuuaaauauuuccaaaagucccuaugaguauauccuuuaaagaaagcaguaagauuuaggugguaaggaagagaucugacacucccucgggaucauuucaauauuauuuucuauuuuaagaguacuaaaaguuucuuaaauaucacuuauaaaaugaaguaaaaaaagauguuuaagauucuacuaauuagauaucacuuuuauuuuuauuuauuuccuuccaagucuuuuuugaaugcgucguauugcccaaagaaaucaaagaauuagaaaaaaaucuacucuaaaauucauacagaccaaaaaagagcccaaauagccaaggcaauccuaagcaaaaaggauaaagccagaggcaucacauaaccuaacuuuaaaccacaaagcuaugauaacuaaaacagcaugguacugguacagaaauagauacauagaucaauggaacagaauagagacccugaaauaaagccauacacuuacagccaacugaucuuugacaaagcugacaaaaauaaacaaugggaaaaggacuuccuauuuaauaaauggugguuggaaaacuggcuaaccauauguagaaguaugaaacuacaccccuaccucucacaauauacaaaaauuaacucaagguagaauaaacacauaacuguaagacccucaaacuauaaaagucauaaaagaaaccuaggaaauacccuuccagacauuggccucaggaaagaauuuaugacuaaguccucaaaagcaaaugcaguuaaaacaaaaagugacaauugggaccuaauuaaacuaaagagcuucugcacagcaaaaaaaaccagugacagaguaaacacacaaaaagugggucaaagacauaaauagacacuucucaagagaagacauacaaguggccaauacacuuuugaaaaaaugcucaucaucacuggucaucagagagaugaauguuaaaaccacaaugagauaccaucuuauaccagucagaauggcuauuaagaagucagaaaauaacagaugcuggcaagauugugcauacaagagaaugcuuacacacuguuggugggaaugcaaauuuauucagcccugugaaaagaagguuagagauuucucaaagaacuaaaaauagaauugccauuugacccagcaaucccauuacuagguauauacccaaaggaaaacaaauuauuccaccaaaaagacaccugcacuuguauauuuaucacagcacuauucauaauagcaaagacauagaaucaacccagguguccaucaaugaugaauuguauaaagaaaaugugguacauaugcaccauggaauacuaugcagccauaaaaaagaaugaaaucauguccuuugcagcaacaugaaugcagcuggaggccacuacccuaagcgaauuaacacaggaacagaaaaccaaauacugcauauucuuauaaguggaagcuaaacguuggguacacaugaacacaaagacgggaacaauaaacacuagggauuccaaaagaggggagguggggaggaggucaaagguugaaaaacuaccugucagguucuauguucacuacuugggugacaggaucauuagaagcccaaaccucagcaucaugcaauauacccaugaaacaaauaugcacaugugccccaugagucuaaaaauaaauuaaauuuuuaaauuuuuuuuuuuuugagacggagucucgcucugucacccaggcuggagugcagugaucacaugaagaucauaaccgaucuucaugagcuagguugcauggauagaagugcugguccagaaagaggaacaguagaagugaccuugcuugguucauggaaacaccaaugcaggggccuuggugaagaccuggaaauguaggcgcaacagacccuaagcucacugagacuggaggccguauagauauggggcagauaucuccuuaggauggaaacaauucuaccuacacaaaugucauaguaccaggcuucuggguaagucuauuuagaagcagaaagaaagagaaacuagagcaucagacagccugcuuccuggcuccacagaaguagaauauuucacccucuucucauucagaaaacaccucugguggaacuggccugcuugcaguugcccauaggucucaugguuucugcuccagggccuuuaccgagaaagcccuucacuugacaucucagccuucucugaccuccugaguuuagauccuacccuccugaucagaaugccuguauuuucccucuaaagacgguacuggccacaugguguaauuacauauuuaugcagcuauuugauuaauaucuaucuuuauuauuagauuguaagcuacaugagggcaggucuacuuuguuuaccacaguauauacagcauccacgaugguauauccuacuauacauuaggcacagagaaagaauucaacagaucauuauugaaucaaauggauaaaugaggggguuggaacuggaugguuccuaaauuccuuccagcccuaaaagagguuaauauucauugucuaauauaaaguaguaccacuggaguuguccuacaccauccccaaaaagcucauaagacagaugcugugguuugacuguuuuccccuccaaaacucauguguugaaaacuucaucaccaaugcaucagcaucaggaggugagcccuagugggagguauuuagguauucaaguacucugcccucuuaaauggauuaaugccacaauuaaaugggguuuggggagugaguuugcuaucuccuacucuuuugccauugugaggaacagcauuccucccuccagaggaugcagaguucaaggcaucaucuuggaagcagagaccaggcccuuaccagacaccaagccugccagcaccuugaucuugggcuucuuggccuccagaacugugagaaaaguaauuucuguucuuuauauuauaaauuaccaaguuugucacauucuguuacagccacacaaaacagacuaagacaucugguaacacaggcaaguaugaucauuaacuuuucauggucccuucagacacagugugucuucaaaaacuuucuuaaaaguuccuguagcuuuaaugguaacuucagcagccucaucagucugucucagugagcuuggguuuauaaacaaagcuuauaauuuugaguaagacucuaguacucuauaaacaaaccagauuagcuacagagaugcuaguagggccuauaaacauuuagagaccauuuucuuccuuuccuuuuucuuuaauuagaguuacuagaucuuuaauacaaaccacaguucuguuauugucuuauuuuuuaauugcuguaaaacacacauaacauaaaaguuaccauuguaaccauuuuuaagugcaguuuugugguauuaaggauauucacauuguugugcaacaccaucuaucugcagauguuguuuucuaaaacacacauuaaaauccaauagaguaaaaauaauacagauauuuuccaagaguauucgagguuggaaaucagagcaaaucuuuccaaagucuccauaaaaagauaaaaucacaaaugcuuaucuaagaacagcacuuuuguucauuuugaaaaagcagaugcaugaggaaaggucauuacccuuuaacagaagcuggaaauccugcagaguacugguucagugaccauaauacacuaauagcuaagggccuuccauaggacauaucuucauuaaagcagguagucuccauugaggaccucugaugugcucaucgcucugacaauuaagucacuuguauuauuccauuuaauucucacaaccauauucuaaguagguacuguuacuaucuugauuuuacauauaaggggaggcauagagagaauuucuugcccaaagucucggcuagaaaguagcauaucugggauuaaaaucaaaguggucuggucccugagccugcauucacagaagaggcagcguuuaaugaaggcuaguuguuuggcauugggucagucuggugcuugugugacagagacucagugugugccaaaauguggaauguuugugcuaaaagaauaucugacaaccacuaacugccaguguucaguuacgaguagacaaggaaguggggaaccaagcagacgucaaagcuaccgccccaccuagguccaccagaacaaagguacuuucccagggggagucuuggguacagcuaaugacucuucaguucauuaaggcuauuuuuuuuuaaguucucauugugucucacaggcagugguucacagacuucaguggcaugagaacaccccaggaugccugcuaacacauguagcuucugaggcccugcacucuggagguucaaacugagaaggcucugaggguaagaguggggaacuaggaucucuagagaacucugaggcagaggucugcuucccucacugacacugccuggcuaccagguugguccuggguucuucacauacaaggagggaacgguuuuaucuguucaaggugcuuucucuauucagagucagcaaacuucucuggagcaacuacccaaaucagauguugugcuggcuguaauuuaacauuuauuuuaugauuauuugauuaaugauuaucucccucauuauacuauaaguucaaaacaaggguauaauaaauuugcccaucuugcucacuaauauaugccagggccuacaauagaguugauauucaauggcuauuuguuaaaugaaugaauggagucaaugaauaaauaaaaugcaaacaaagacaaaugaaauccauucccuguccucaaugugcuuauaaccuuuuagguagcugggcaaguaaacauuucagaacaauaaagaguucuugcuguguuaugccacauguggcccaggcaugagggcacuaucuccccagcagggcugaacccaaacuaggucaggcaggaagaugacaagacuggaucaucagcaugggugggcugaccugaaaugggcuagacaagggcaagucagauggggaacagugggaauaaaauaaagauaacugucaauuugucacuaaggcagguaagcugcaaaaaugauaagacaugaguuaucaaucacugagugucugcagugggccaggccuucugcucuggacucauauuugcauguacuuuaucccacugaauucucacaguaaucuuacaagagaagaagcaucaguuccaucauacaaguggagaaacuaaggcuuagagagguuaacuccugugacccuaagagcacagcgaagauucaaacccaaggcaaugugaguccauggcccauguuguguuguacucuaggcaggcagaauaaugaucccugcaagaggacagggaugacaaaucagaggaagugaguacaggacagcugaaagucuuuccauguaugaaguugcaccaacagaggcuuguggccaccacccucuuuaaacagaagcauucggaguuuucucucagcauuaaccgucccaagguaccuguuccaucuuaaucuuaaaagguccucaaaggaauuuugucacaaagaucuggucaacccaagugucuuucacauuauccccuccccuuaccccacagacaaugccuuaauucuggccucgccugccuugccuagaccauggcaggagcaugcuaacuggucucuccucuaaucugcucuccagccaaaaggaaucuugggaacacaaaucugggcaucacuuccuuguaugaaacccuucaaagcaguggucuucaaucaaaacuacucauuagaaucacauggaagauuuuagaacguaucagucccugggcuuuuuuuucuuuuuuuugagacagagucucgcucuguugcccaggcuggaguacaguggcgugaucucagcucacugcaaccucugccuccuggguucaagcaauucuccugccucagccucccgaguagcugggauuacagguaccugacaacaugcccagcuaauuuuuguauuuuuaguagagacaguucaccauguuggccaggcuggugucgaacuccugaccucaagugaucugccggccucagccucccaaaaugcugggauuacaggagugagccaccacgcccggugaucuacaauauuuugaaccauuuuuauuuaacuguaaccuccaaagaugauuuaauugaccugagauggggcccagccauauuuuugaaaagcuccucaggugcuucuaacauggauccaagcuugaacaccacugcaguuuaauggaugagaugcccacuuuuaagccaaaaauacuaagcucagacuuggaccuccucuuccaccucuccuuccugcccccauauucaacaaucuaaccauacugagcugcugauuccccagggauugcauaugauuucaagcugucacucuucaacacaugauauaaucuuugucuggaacauguccuaucccacuuucuagaaaacuccuuaccauuugucuuaguccauucucuguugcuaucacugaauacuugauacuggguaauuuauuuaaaaaauaaauguauuucuuacaguucuagaagcuaugaaguccaaggucaagaggcaacaucucaggagggccuucuugcugguggggacucucugcagagucccgagguggcacagggcaucacauggcaaagggggcauacugagagccaaacuagcuuuuaauacagaccuacucuaauaauaacuaacccacccugugauaacucaauccauuuauccaugaauggauuaauccauucaugaggucagagcccucaugacccaccaccucuuaaaggcccugccucuuaauacuauuauacuggggauuaaguuucaacaugaguuuuggagggaucaaacauucaagccauagcacuuaagacucagcuccaaggcuaccuucucugugaagccuccauguaaacaggcacaauuagcagcuucuuucucugggcuuccauagcacugucucugcaugaauauaucucuauuauauugaaauuauuuguacgaagaacccucaccuccacaaaaaucaggaggugcaaugauacuucagauaccucuugugaccauuuuacaucuuggccaacuuuuuacuccagccccagcaguaucuccuuaucucucuauuucugcccagcagcuucucuccugcugccuaaguugucaccugugguacccacaugaccccucugacacacgugcaaaccuggaagugacagggacuuaacaccagaugggagcaacccuugaccaacagauaaugagaaccaggggauaaauccccagggcagacaauucuaaaguucacucuccacagcucuugagagggucccugggaggaucaagccucaguggcccaaugugguaauuugcuccuaacucucucuuucccuucuuccuuguuuccuuggaaucacuucccaaaauaaacauccugcaugcaauuucuguuaauaggaugugcuguuuggaaaaacucacuaagacaaauggaaagaacauuagucuuuggaucagaaaacuggauucuaguuuuagcucccccucugccuugggugagagaacaucuaaggcuuugauuuuguuaucuauaaaaugggcauggccaggugcgauggcucaugccuguaaucccagcacuuugggaggccgaggcgggcagaucaacugaggucgggaguucaagaccagccugaccaacauggagaaaccccgucucuaguaaaaauacaaaaauuagccgggugugguggcgugugccuauaauccuagcuacucagcaggcugaggcaggagaauugcuugaaccugggaggcagagauugcggugagccgagaucaugccacugcgcuccagccugggcaacaagagcaaaacuccgucucaaaaaaaaaaaaaaaaaauggggauaaccuucuauucuucacaguauucacgggaagaaaaaauggaaaugcauguggaaaugauuuauaacugcaaagcacuaaauaauguuaucauuaugccuuaggaggaauucuuucccuauucacccuuuaaaucaguggucuccaaccuuuuugacaccagggaccaguuucuuggaggacaauuuuuccacagacccagagguggugaggagggggaaaugguuuugggaugauucaagugcauuacacuuauugugaacuaccuuauuucuauuuuuauuacauuguaauacauaaugaaauaauuacacaacucaccauaauguagaaucaauaggaggccugagcuuguuuuccugcaacuagacagucccauacggggguaacgggagacagugacagaucauccggcauuagauucucacaaggagcacgcaaucccgauccuacauaugugcaguucacaauaggguucgcgguccuauaagaaucuaaugcugccacugaucugacaggagauggagcucaggcaguaaugugggcgauggggagcaacuguaaauacagaugaagcuuugcucgcucgcguguuccucaccuccugcuguacugguccauggccuggggguuggggaccccugcuuuaaaugauagagcuucucaggacuuggaccuugacucucuucucauuuuauaaccccauccuagaugaccucauccauuucuaaggcuucagucaaucaaugccaucagagacauagcuuuaaucuaggccugugcuauuuaaccaggguaacaaauagcuggcaauugagcacuugaaaugugacuaguuggaauugagauaugccauaaguuaaaauuugaagauaguaugaaaaaagaauguaacauaucucauuaacaauuuuuuuuuggccgggcauggugguggcucaugccuguaaucccaacacuuugggaggccaaggugggcagaucaugaggucaagagauggagaccauccuggccaacaaggugaaaccccgucucuacuaaauacaaaaauuagcugggcaugguggcacgugccuguagucccagcuacucaggaggcugaggcaggagaauugcuugaacccgagaggcagagguuguagugagcugagaucgcaccacugcacuccagccugugcuacagagcgaaacuccgucucaaaaaacaaacaaaacaaaacaaaacaaaaacgaaauuuuuuuuuuuuugagacagagucuugcucugucacccaggcuagaguguaguggcgugaucuuggcucacugcaaccuucaccucccagguucaagggauucuccugccucagccucccaaguaguugggacuauaggugccuaccaccacgcccggcuaauuuuuuuuguauuuuuaguagagacgggauuucacuauguuggccaggcuggucuugaacuccugaccucgugauccacccaccucagccucccaaagugcugggauuacaagugugagccaccgcgcccagccaacaauuauuuauuuugaugaaauguugagguaauauuuuggaugcauugggccacauaaauuauauuauuaaaauuaauuucaccucuuuucuucuacuuucuaaaauguagcucuuugaaaauuuaaaauuuggcuuguuuuauauuuuuauugagcacagcaguagauaucugcuuagaaaagaaagguccaaaucugauuauccaacugcuuucuugacauuucccauuggcuuuccaacacucaaaacaauucuucaaaaauugaacccaaaggcucccccuccuuccacauuuuucuuguagccucuuccugguauccuccuauaucucauccuccucuaauucauugaaaucagagugaucuuugcaaaaacaaaucugaucauaccacuagcuucccacuacucuuaggauuaaaacugaaauccucaaccugucuugcagggccugcaccacguaccuccccaucuuuauauaacacguggcccacuccugcucuccaacuaguuccuaggagauauccaacuccuucuuguuucaggacucuugcaccugcuuuccuucugccuggaauuuuuuuuuuuuuuuuuuuuuugaguuggcgucucacucuguagcccaagcuagagugcaguggcagaucuuggcucacugcaaccuccgccucuggggcccaagugauucucgcaccucagcuuccugaguagcuaggauuacaaguacgcgccaccauaccaagcuaauuuuuuguauuuuaguagagauuggguuucaccauguugcccaggguggucucaagcuccugagcucaggcaaucugcccaccucggccucccaaacugcuucgauuacaggcaugagccaccgugcucggcccugccuggacuacccuuuaccuaugucuuucccagcuaacuuccaaucauucuucagauauuauuuuaguaucauuuuuucagggaagacuugccuggccccaaaacuuucauuugguggcaauuuaucauaauuacaauuaauaauuuguguuauuaaauauguuugcuuccccagaugguaagcucagucauaucuauauacugccuucccuauuguguagcccagugccuaacacagacaaugaauauuuuuuauuuuacuuuuuuugagacagagucuuacucugucagccagacuggaguguaauaaauaauugucgaugcauaaauuuauaaaaaaugaaugaagaacugcugaaugaaguauggucauaaagucaugucauugugugcucucaaaacacauguaucagccgggcacgguggcucacgccuguaaucccagcauuuugggaggcugaggcaggcagaucacaaggucaggagaucaagaccauccuggcuaacauggugaaaccccgucucuacuaaaaauacaaaaaaauuagccgggcgugauggcgggcaccuguagucccagcuacuugggaggcugaggcaggagaacgacgugaacccaggagguggagcuuucagugagccgagaucgugccacugcacuccagccugggcgacagagcgagacuccaucuugaaaaagaaacaaacaaaaaccccaaacaaagaaacaaaaaacaaacaaacaaacaaaaaacauguaucaguacaaauauccaaauaaguguuaucuuuuaaauggucauuuuuggaagcaaauacauuuauuucaauaaacuacucaaaccaguuuaguagcccaugauauuugggaugauccugguacuaguuuacaaaccaugcaagaaaaaaaguuuuuuuguuucuuauucuagauuuuauaaaauguuuuaucauacacccuauucauuaaacuuaguuuugaaugacuucagaguuaucauucaagaguaugcuuuaaaguggcaauguccaauagaacuuucuacagcaaggcaauauucuauaucuguguuguccaauacaguagccaccagccauguauggcuauugagcacuugaaauguggcuagugcaacagagggacagaauuuuuaauuuuauuuaauuuuaauugacaagcuuaaagagcugcauguggcuaguggcuaucaaauuggacagcacaucugguuuaaagccaucaccagaauacaaguuccugaaauauuuugcccccaauauaugccaggaaucuuacuaaaauuauuauauaaccucaacaaauggcuaguuugcauauauaaaacuaucuuuguauaaaauaaaucagugauguuauuaaaaagauucacuucagaugccaaugacugcucuucaauacuccuaccuuuuauuuaaagaaugccaaagaccuuguuccauuuugccaggcccauauaacaaugcagaagcacaagagacuuaaaggagaccacugugaaugagggaaggucguccaugaccacacauauucuugggaacauaacucaaguuugucauggauuuugccuccuaggcaucccccucuccaaugaugcaauacugaacauguaaaaaggucaaauuaagaaggcaaccauguauuuuuggagcugguaaacaaauaauggaaccaagaugucaugaggcuucaacugugagugaaguuuugccaaggaaacaacaucagucaacauuaaaaggcaagcgacccuuaacaaugagauaguaucagccuucugucuugacaaagggacugcuguacacagcaccacuggguugaacuugacaaaaagaugccagugugacacccacgccucugcuauacagugauuuggguggauggcaaaaguuucagaggccuggcauacacaaccauccuuccaggcucccaguucaacaucuucaaauacaagagaauauacuucuacacauguauucccaggccuccauggucaaguuaacuucuagauauauuacugcccauguguacauacaugcauauuagcauauugguaucaucugggcccuuauauauuuguuuacuauaauuucagugaaaguuuaaaaugguguauuuauaguauaaauuuuuauuuaccacaugcuuuuuaauuaacagauuaaaaaauauaaugaccauauuacaaaguacuugugagauauucaugucugaaauuuuacuuugaugaacuggaaagaaaacauaaauacauuaaaguuaaugauccuaaugaucuuuaaugauauuaacuaguuguucaaauguagaaaugucacaagaaaucugccuauccaugaauucauuucaaaugacuauaccugauacacguauauguuuucugauuugcuuuuauugauuuugauucuuuacuauaucuggagauaagaaacaugucuucuccucaaucucugacuuccaaaguacuuuauacagaguuguauaauaaacguuauuguuuuggugauagugauaauaaugaaguaaaaagaacagagugcaguauugugauucacccaugaugaagaaguggaaauauacuagaauauagaaucuuggcauaguauuacacagaucuggauaaggugaauaaagcauucaucucugcuagaguaucaauuuaaugaguuuacuaaacaaucauaaaggcaguuaacuucccaccacuaaugauucaaggcauuuacucuucuagaaugagcaccuauuuccauuuuacuccccuaauccaguggaaauugacuuguuccugggcuguuagaaccucaacucguccccuaugcucuacauaccuuaucccuccucccccugucccacccagaucuccucuuacauacacacaaacacacagauauauuugacuuaccuuaacguuuucuggcaaugcuuuguucugggucaaccccacagcaagcaaagcuaucacagcuaugauagaggagaagccaaggauggcuaggauauucuuggagcaaaaugucuucacguuagacucuaaaaccaaaagcagaagaaaaaaauaccaacaagaaaucaaaaacacugauuuuccuccccuuucugucuggucuuguaauggcuaccuggagacaucagagacagauuaaaagccaaucuuuuuuaucaaugagguacuuacagaguaauugggaaauaauucaagaacaaaaggauuuguuuguacuuugacaaaggccaagacugaguuaguggcuguggcaaggacaaaacuaggucagugaucagauauggaaugaggagugagaagagccccaaauuggcuguuuaacaguucacacagaucuaucaagguagaaguaacaaauaacaaaaaacaagaauaccccuccucauuuuugaaaucuaccacaaaauguuuaugauguuaaaaaguauuaagaauguaucaucaaacaacaaaucccacuauuccaugacauuuccuggcuugacauacauaccccuugcauuuaaaccacccuuacauaguaagcaauugguaauggcauagaggcugaggagucuugaacauuuuggaucauaauucauauuaucuuauuuauuuugucuuuagucucauucugucaugggacauuagaaaagcuccaauaguagaauuauauaaaaggcaaaaguggccggacacggcagcucacaccuguagucccagcacuuugggaggcugaggcagguggaucucaaggccagcaguucaagaccagccaggucaauauggugaaaccccaucucuacuaaaaauacaaaaauuagccaggcaugguggugggcaccuguaaucccagcuacucgggaggcugaggcaggagaaucgcuugaaccccggaggcagagguuucggugagccaagaucgcaccacugcacuccaggcugggcgacagaacaagacuccaucucaaaaaaauaauaaccaaaaacgggugccguggcucacgcuuguaaucccagcacuuugggaggcugaggcagguggaucacgaggucaacagaucaagacuauccuggccaacauggugaaaccccgucucuacugaaaauacaaaaauuagaugggcaugguggcgugcaccugccaucccagcuacucaggaggcugaggcaggagaaucacuugaacccaggaggcagagguugcugugagccaagauugcaccacugugcucuagccuggagacagagugaaacucccucucaaaaaaaaaaaaaaaaaaaaaaggcaaaagcuacuuuggucagauguaaacagauugcauagaggaagugaacaggaaaugaaaugguugcaccauucccuccauuuugacaacucaaccuccuccucucucaacuccccaaacuauucccaaacguagaagcuggcugggcacugaaaugggagcucucucugaagcucuugagcagaagcuugaacuuaauccaagucuaagcuuggauuaagguaugggucuccaauccaccucaauccccagaaucuugaggcagucuuuacccaucagaccaaacaauacaaaauuuaggagaaaaaguuuuagcaacaucauuaucuauugcuuccaaacaaggaagagcaggugaaauacacagcacuucccugcuucucccuucccaaaagaaacuccauuuuguucagaugcuugccuuucccccaagcucagggauggacuugucuguguaauuucauucccucaccagugacugguuuaauaauggguaugccaccuaauuauggcccaugugaccguggaggaagucuucuggggcaagucuagggaaaaaagaaaacauucucucuucauccucaaacauuguccugccuggaagggauggcauucaaugauggcagagcagagagauguagagaacgugaguccuugauggcauuuuaagcugcuaaaucaacaaaugcugagcccauccuuccauaaaacuuaugcuuugacccaauuagagucaggauuuuaacuacuugaagcuaaaacaucuggauaaaacugguaugggagagauguccucuuugaugccaguguucuggaaucuggaaaagaacccucuaagggcaccccacuuugguucccaacguugugauguugacaaacacagcccuaagcagcauguccuuuagauaagcaauuauaaauaaaacaaccaauuauaaauauaacaacaaacaaacuguagcaauguuucuaccauaauaaaauuuugaauguuuuacucccucaagcuauucaacaaggucuacuuguuaacuucuuuuguuuuuguaaauaugacaaucuugcaaucucauuuuccuuccauggccauuucaggcacuauucuuagcauccaaguuacuacaauaaaaaaagaaaaacugauaaggccccugcucuuuggaauuuacaaucuaguuagcaagacagauaaaccagaaaagaagcacauaaauaggugauuucaggucacaauaugugcuaagaagaaauucaaaccaaggaacuugauagagugacuugcgguagaauugggaaugaagggaaagguaucagauugagggucaagaaagccucucucagaagaugacauuugagccgagaccuugaaggugacauuugaggagaaaacaccagccuggagagggaguaagaacauaagaggaagaaggaacagaaacugcaagaacccagaggugggaaccaacuugaugugacuauaauuauuucuuccuuuuccuaacgagaaaauuuacuaacuucuucuugucauugaggaguuagauguacacuuuuccacauuuucccagcuuuugcaaugauauccagguuaccagaauauaugcaagccuuucauccuacucuuauuucuuauuaaagauauaauaagaaaaagauuuuuaggucagagagaaaauuuaggaauuuuucauacaugauuuuucaaauguuuuuauuaccaaaagaacccacaaugguuaaguuuguuuuucauguaacugacuacauuacccagagagcaguaauuaaaaugcuaucuuccauggacuauaugucagccaguuuucaaaagcccugaucacauccaggaagcaggagagucaucucagaaguggugccaaagaagaggugcuagagguggggugcagguugacauaucuuggauguguucauaaaaagagaauuacuuagguaacugccccuucuucuuagacccccagagugcuuucagaucccaugacugccacagucaagcucuauuauggaaaauucacauugauugucuucccccugaaaagcccuuaauuugccuuguggauaacagaaaugugguuucugucauacaaugugaaaugguauuucgaaacagaauuucaacaaaugauuuuaccaaaauauccaauggcaaaguguugucauuguuuucccuuugaauuggcuuacuguacuggagaauuuaagacggccacuuccuuugcauuuuuuucuuuucaugugaugugacaagggaggggaauuuucagcuuaaagugagagagcaagguaauauuaacuucaacucuucaccugacagagagauaaaacugaaggaaacccaagcuuugaaaaaacacaggcugauuucaagccaauuagcugugucagaggaaaaauaccuucaagacuuuuauaagaaucaaaggaagcaaagguucuuuugauucuuauagaaacagccaucaugauguccaguuauaaucauacuaaggugaaaaucaaaauuauuuaaucucggcagggugcaguggcucacaccuguaaucucagcacuuugggaggcaaaggugggcggaucacuugaguccaggaguuugagacugggggguaacauggugaaaaucugucucuacaaaaaaaauacaaaaauuagccaggcgugguggcauaugccuguagucccagcuauuugggaggcugaggugagaggaucgcuugagcccaggacaccgagguuguagugagccaagaucacaccacugcacucuagccugggcaacagagugagacccugucuccaaaacaaacaaacaaauuauuuaauuuuguccauagucaaaauucuguuguauagagaaaucccagcauugcuacucugugauaacaaaaauauaacagcuuaaaauuuuacuccauuaauaaacagauuugggguguugacagaugugguggauuucaggcaaaaaaaaguuuugcuuugcagauccaaugugacugacuagauucaaauuguuuccaauuuguuaugagucacaucuggacuaaacuuuucuugucauauagagaacaaaacagcaaauguggacaagcauuggugagcaaacauucaaggaauguugugguccuuccuguguuuacauagccuaaugauggaacaaucacugaagcucagaagacugguccuaaucuggcguugucguuccuccaacucacagagucaaagucuccacaccaccccugcuaccuuccuucuucuccaucagggaacucuucuugaggacacauauguagguuguucucacacucaggggcuugaagauccucucucaguuauuucaucccaagccccuuagacccaccuucuucuauagugauauccacauccccugauuccagucacccuuaccucauaucugaucuucuacaauggcccuuucuggugacucccacacuuccuaauuaucuucucuaucagaaucccuccuucauguggcuauagaaaucuuccacaauugacguuccuaagacucuaccuuaucaagaaccuauguccugcugugugccagaugaaagcuacacuggucuaccuagaccuccaagcccuucagaaauuucagcccuucccauuuuaccauuccaaccaacagaucuguuuggguccaagaugagaauuccugacauuaugacuacuagaauguaagcuccuuagggcagggacuuuuuucuggcuuguucauugguauaucccauguuguaugaaugaaugaaugaaugaaugaauuuuggauucucugaacuuuucucagugugggacgccuucauuuguaauuccauuccccucauucuccaagucuuuuugucuccuucaaaaucaagcucaguuggaagcuaugcucccccuauacucuacaaagcucaguuaugucaguaguccucucuucaugugcuaccucuagauauagcuugaaccauuucaguuugggaguucuauaguuguuggagaggggacuaugccucauucauuuuuucaguuggucacucaauaauuacuuauugaacacauuauuacuaugaacuagaccugcccuaggcucugagcuacagcaauaacccaaagugagaaaugucccuauccucauggugcuuauauucuaguugggagaaaaauacaauaagcaagauaaacaaaauuuacaguguauuacauaauuuuaagugcugaggaggaagaaaaagcaaggaagguaaaaaggaaggaugcagugauuaggacuggccugagaaggugauuucuaucacagggagaaagccugcauaccucugaggcaagagcuuuacagcaucuggaacuguacacagaaaggcccugaggggagaguaguaggaacuggucagaggaucaaugggguccccugcucauaaggccuugagggcacuagugagggcuuugccuuauucugagugaugugacuuacuucuaaagucauucauauaaucuaugcuuagcaacuuaggggugaacaaggaaccauugggggcuguugaagucacuggagagagaggguguggccuuuuaggguggcacaucccugccucuugugguaaugaugugcugaggcuacucaaaugaggucaggccacacagccaaguguggacagagccuggcuccaucagagcagagcuugugccaaaaccaggucugggcagacgcauccaggaggaguaaacauaaucacaugugacagccuucucaaugccuucuagacuucuugauggcucagcacuggagagucuuuucugagagaccaucaucaggaagggucaccgagccaacaaucaucaggauccaucagcaguuagucaaacuccacagacuucugggggaugguucaagcuagagcagaguucagauaagcuuaccuuugcuuagucucuguaagccuccauuuccucaugggcagaaugggagucacaauaguaucugcuucauaggguugcuauguaagguucaaugagcuaacaacacguaauagccuauacuaaagaguucuuacuauauuccagauucuacucuuagcacuuuaaaugcagccaucaauuuagccuucacuacaauccuauaaggugcacguaauacuaucaucuucucuauaaaaucuguauuaguuuuuuagggcugccacaacaaguuaccaugaacuugcuggcuucaaacagaaauguauucuuucauaaaucuggaggccagaaguccaaaaguuaagguaucagcaggggcaugcucccuuugaagguucuggaggagaugucuuucuugucuuuuucagcuucuuagcauuccuuggcuuguggcugcaucacuccaaucuccaccucugucuucacauggccuuucccccuguugcucuuugugucacguuuccuucuccuuucucucauaaggacaccagucaucagauuuagggcccacccuaaauucaagaugauuucaucucaagauccuuagcuuaauuacaucucugaacacccuacuauauuuccaaauaaagucacacucacagucacuauuauaauuaucauuauuguuaguuuacagaugaggaaacugagucacagagagauuaaguaacuucccaaaguuacacugauguaaauguugcgcuguuacauguaguuagacagacauggcaggaaagggcucuucucccccaccaacuagaaauaucaggugaugguuugacaguuaucacauugccucucuaaaaaugauaauuuggcagcuggagccagggagagaaaaucugcugauccacagcuguaacauuaaaguguuaauugaauucaagcaccagggagaagcaacuuccugggcaugcacauuaagagacaaaagguggaagaugacuugccgggagcacuccaccggaaaaggaaagaaagccucagaugagcaugcacacaacuuccuaaacacacugugugcucaaggagguaaggagggcacugugcgugcaggcagcccacccuaagggaagaaucacgggaaaagggcucaagauggccgccuauaaaguccuaggaucacagcuaaacacguuguuuguucuccaaguugcccacuuggaucucuuccaaggguucucuccuuucuuuccuguucuaaagccuuuucaauaaacuuccaguccugcucugaaacuugacucagucucuuuuucuacuuuauaucccucacauucuuucuucugaugaggcaagaauugagguuacugcagacccguauggauacacugccaguaacucagauagcugccaccgguaacagggccaggaauuaaacacgggcauucuggcuucaagguccaggcuuuuaaccagcacccuacccuacaauacaugacugaggcucauacagugucugggcugugcuaccaguacuguuaugugguagccaaucucauuauccagaaauaaaaagugaccaacauugaggauuuggcuggaaggguugucuggacuguucucacugaggauaccaauguccuaccuuuugaaaucaugaaucucaucccugacagucagaagcuuacaguuaagugacaaaaggcugagacuguguuucucaggaagcuuaagggacuugcccaagucaugcaccuugcacguggcagaacagggauuugauccaagugucucaguuccacuucaaugccuuaaaucauuguccugcauuagagaugcguagaaauuuuucaguuuuauucuuucucagcugacccaaugcaaaagcacuaguccaaaauucuaucuaaauggaaaggucuuauucuaccccaaccccauauuucuccaauuaaccaauccagagucacauucaaggauaaagcaguuuaauuuagcggguuuuuuccugccuauauuuuacuuaaagaagucagcacaaacaucaauagaaacacaacugcuaaagacaaacuuugauccuaaagaucucaaugauaaccaguuaguuaaagggcaaaaggcaaaaaagaaggaggaaaaaugagauggacauuggguugggagacacagguaagaaaauagagccaggaaauaagaaggaagggaaggggugggggugagaaugaaaagaaagguagaaagacaagguaauugaguaaauaacccauguccuguuccacugaucucuugaaccacagacgucagaggaaguuacuggcucuuuuuaaugcuauuuuauuuccacucuuugaacuuuuaauuagccaauuauucucgguucacagcuucuuaguuagaaaacaauugcauuuaucuuaacaacguagccuggcugauacugaguggaccccuugagacucagcuuuggguggggagagccuauuuggugacauccagauaguguagaugugggugggggugcagaacaagcucuuccugcaaaucagauucagccaaccugaggcuccccacccacaguucuugggcaacacacucuucucagauuagcagcauguaacuaacauaacugguuugcacuugguuauaccugacucuaaaaauguuaaugaucgcaaaaaucaaauggugacagaggcucuauguaugggaaaugaggaagcaaaagaguccucuucccugauucuucucacuuccuccaaccaaaccauccauucucucuugcccccaccccuucuagccucccucaaauucuuuugcccauagauugcauugagaauaauaggccuuuguggucaguguggaaucccauguuuaaguguaggguuggcagggaggaaggcuguuuccggcaaagugaugucacugacucugcagacaggaauucccugugucccagccaaaaggcguaacaaucugguauauugauggccucagcaauaagcgcauugcuuccacuaaacgagucuucuuccacaucugaaauugaaaaauugugcccuggggacucuacccuuucucaaagcagcugcauuugucaacaagccuugguuauuugcagauggugagaauaagcaagaaaaucuguauuggccaugcaucucuagugcuggauaauaguggaagcagggugaacugacucaaccagggugccuagccuuauagucuugucuuguauaccuugccuuuauaaacucucucauuuauaccgccuuauuuuugcaccaaugagguacaaaauuuagagguuacauacaaauauuacuauagaaaaaugugcuauaagcuauacaaaauaaaauucuaagccccccaacugaccagaccaucuuuuggccaaggggaccccagagaaaccuugaaaacugcguucucggccaagauggaauggagggugggaggggcucagacccucucccuugcuaaccaggaguaggcuuuccuucucaagggccuaacagaaaccagcccuuucaaaaggcuccaccacugauaucaaccgacucccugaugcugccccaucuuuucugccugauaagagaccacuaacuauggggugguucuggccagucuaugaagaauaggcagcuaguguuuucacauccucugcuucauguuuugaugucagagggccaaaaacuccaccuaaggucaccaccauuuuuugaacauggagaagcagaaggcucaauuacacaugcagaugguucucccuucauaaauauucaugacuccuucuauagcuuauugaauauguauauuuggccaccagcucuguguaaauuccuguucccuuugccccucccuccagauauguuucuggcuucugacuggaggcuauacuucccaaccugucaaaauggccauccugcaggcuguaaccuuuuauaagaaauaaagucuccucuucucuucaaaauuuguaaauuguauuucuguaaguuaacaaaucaaaguaaaaaaugacaaaaguuugcaacaauuaugaaauaguuggauucacuaauauauaagcgucauuuuaaaaucauuaagaaaaugaucagcucaccuaauagaaaaauggcaaagaagaugaauaggcaauucaaagaaaaagaaauauguguuaucaacauauuaaauguauucuaacuacccuuaauuaaagaaauguaaaugaaaaaaauaauuuucagaauagcaacauuuuuaaaguuugauaaauacauaauauucacuauacacuuauuagaauggccaaaauuuuuuaaauauugacaauaugaaauguugguaagaaugcagagcaacugaaacacuugugccuugcugcuagggaugggaaauaacaaagccacuuugagaaaguguuuggcaguuucuuauaaaguuaaauaaaaacucaccauaaaauugagcaaucccacacugagguauuuaccugagaaaagcaaagaccuauguccacacaaagacauguaccuagauauuuccaacugcuuuauucauaauugccaaaaccucaaaacaauccaaaugcuagcaacuggcaaauguauacaaauugggaacaaucauacaaugaaauucuacucagcaauaaggaaaaggaauaaacuacugauaaauguaacaauauguaugaaucucaaaagcauuaugcuaaguaaaagaaaccagacucaaacaggcuauuuacuuugugcuuucauugauaugauauuuuggaaaaggcaaaacuaagaacagaaauuagaucaguaggcaaaggcucaggaugggcacagaggauugacuacaaagggccacaaaggagcuuuuggaaauaauagaaauauucuagauuuugauugugauggugguuaaaugacuuuauauguuugucaaaauucauagaacuuuacaccuuaaaaagugaauuuuacuguaaauucaguaaagaaauuauauauguugacaaagaugugggaaaacagauacuucuuguauguuuguaggaguaaaaauuuguagaaccucuuugauggggaggcaauugaguaacaucuaucaaaggguaaagcacauauauccuuugacugaagaauucuaauucuagaaauuuaaccugcugauauacuuaugaauaugugaaaaaauggugcauagacagcgacauucagugcagcauuguuuguaauggcaaaagacuaaaaaugacuaaaaguccaucaacugaugucuggauauauaaauucuaccacauucauaauacauaauucuaugcagacaugaaaaagacugagcuagaucuaugaauguugacacaaacugucuucaaaacauuucauuaugugaaaaacaagauguggggccaggcguggugggucauaaccccagugcuuugggaggccgaggcagaauaaucacuugagcccaggaguucgagacuaaucugggcaacauagggagagacccuaucucuacaaaaaauuuaaaaauuauccagguaugguggcgugugcuuguggucccagcuacucaggaggcugaggcaggaggggacugcuugagcucgagaguucuaaaggcuuugaguuaaagaggaaaaaauguacagaggguuuccaguucagaguaaaguggcaaagaugauaggagcugggaaggugaacauuggguacauaggaaguugugcgcuggugguuuaauguugacuuugcccacucuagcacccugucagccacucaccaaccugauuaacucaagcagcuaccuuuggguucccauucauucuuucuugccagaucaauguaauuucuguacucuuugggcagaauuguaaagucucacuugguagacuuuggguggacucaaaguucuauuuugagggaaauuugacaucucucccucugccccucugggguuauguaucuguguaagcgagaaaugccaucuggauaagauauggucaugcaauuaaaugucuaugguaacacugucagagaucaucugacaccuaaccagcuggcuuucucuuuaaccaucaacacagaguaucugcacuuuagaaacaugaaaacucaaucuuauaaauugauuaguaucuaguuccugucaaaaugugacagauacuacugauauuucagaaugacaauaucaggguccucugcguuuuuuucuaagcauauuuucuguacccauuuagugaggaggaagguagguggaguuagagaaagguuccuuuaccuuggaaacaggaacuuccucugagagcaaaacuaguaagaugaauauauaauagaugagaguagcuuuuagccaaaucacccacaguuuaaaaguuauuucagucuuguggcuucaguaucuccucaaauccagcauaugacucagaaagucguguccuacugaauuuuguaccugagugaagaaggaauaugugaauaugguggggauggggucaucuacauagaauaaaaaaggcaacuaaacccugucugggaagugaggagcgccucugcccggccaccaccccaucugggaugugaggagcgucucugccuggccgcccuguccgggaagugaggagcgccucugcccggcugcccuauccgggaagugaggagcgccucugcccagccgcccuguccaggaagugaggagcaccucugcccggccgcccugucugggaggugaggagugccucugcccagccgccccaucugggaacugaggagcaccucugcccagccaccgccccaucugggaggugaggagcgucucugccuggccgccaccccgucugggaggugaggagugccucugccuggccaccaccccgucugggaugugaggagcgccucugcccggccaacccguccgggaggugaggagcgccucugcccggccgccccguccgggaggugaggagcgccucugcccggccgcccuguccgggaggugaggagugccucugcccgaccgcgacccugucugggaagugaggagugccucugcccgacugcgacccugucugggaagugagaagcgccucugcccggccgcccuuucugggaggugaggagcgccucugcccggccgccccgucugagaagugaggagcaccucugcccggcagcugccccgucugggaagugaggagcaccucugccuggccacugccccaucugggaagugaggagcaucucagcccggccgcugccccgucugggaaguggggagcacuucugccccgccgccccgucugggagguggggagugccucugcccagccgccccaucugggagguggggagcgccucugcccggcggccaccccgucugggggguggggagcgccucugcccggcggccaccccgucugggagguggggagcaccucugcccggcauccgccccgucugggagguggggagcgccucugccuggcauccgccccgucugggaggugggggggcgccucugcccagcauccgccccaucugggagguggggggcgccucugcccagcaucugccccgucugggagguggggggugccucugcccggccgccccgucugggagguggggggcgccucugcccggccgccccgucugggaggugggggacgccucugcccggccuccccgucugggggguggggggcgccucugcccggccgccccgucuuggggguggggggcgccucugcccggccaccccaucugggauguggggggcgccucugccuggccacccugucugggauguggggggugccucugcccggcugccacccugucugggagguguacccaauaacucauugagaacgggccaugaugacgauggugguuuugucgaaaagaaaagggggaaauguggggaaaagaaagagagaucagauuguuacugugucuguguagaaagaaguaggcauaggagacuccauuuuguucuguacuaagaaaaauucuucugccuugggaugcuguuaaucuauaaccuuacccccaaccccgugcucucugaaacaugugcugugucaacucaggguuaaauggauuaaggguggugcaagaugugcuuuguuaaacagaugcuugaaggcagcaugcuaguuaagagucaucaccacucccuaaucucaaguacccaaggacacaaacacugcggaaggcugcaggguccucugccuaggaaaaccagagaccuuuguucacguguuuaucugcugaccuucucuccacuauuguccuauuacccugccacaucccccucuccgagaaacacccaagaaugaucaacaaaauuauuaaaaaaaaaaaaagcaacuaaaauaaucugucaaaguaucucuagcauggucuggggaaagaaggugccuuggcauguggacucaaguacaccauuuccuugaaaguuuuuuccccuacagugaugaagaaugccuccucuaagauaaucaaacuaacucccccacuucugauuucaugucuaccaagcugucuugccaugucaauuuuucuacaagguaaaaaaugaagaccugguaucauuccugcugaaacuauucccagaauagggaagagggacuucacccuaacucauucuacgaggcauaugagcaucauccugauaccaaaaccuggcagagaugcaacaaaaaaugaaaacuucaggccaauauccuugauaaacauggaugcaaauauccucaacaaaauacuggcaaaccaaauccaggagcacaucaaaaagcuuauccaccacaaucaaguagccuuuaucccugcgauguaagguugguucaacauaagcaaaucaauaaaugugauucauccugcaaacagaauuaaagacaaaaaccacaugguuaucucaauagacacagaaaaggauuucuauaaaauucaacgccucuucauguuaaaaacucccuguaaauuagguauugagggaacaucccucaaaauaauaagagccaucuaugacaaacccacagccaacaucauacuaaauggcaagaccuggaagcauuccccuugaaaacuggcacaaggcaaggauguccucugucaccacuccuauuuaacauaguauuggauguccugguuagggcaaucaggcaagagaaggaaauaaagggcauccaaauaggaagagaagaagucaaacuaucccuguuugcagacaacaugauccuauaccuagaaaaccccauggucucagccccaaagcuccuuaagcugauuaacaacuucaacaaagucucagaauacaaaaucaaugugcaaagcucccuaacacuccauacaccaacaucagucaagcugagagccaaagcaggaagagcucuccaaggagaacuacaaaacacugcucaaaaaagucagagaaggauccauuccaagauggcugaauaggaacagcuccagucugcagcucccagugugauugacccagaagaugggugauuucugcauuuccaauugagguaccugguucaacucauuggaacugguuggacaacgggugcagcccacagagggugagcugaagcagggcggggcaucgccucaccugggaagcacaagggguugggggauuucccuuuccuagccaagggaagcugugacauauuacaccuggaaaacgggacacucccacccaaauacugugcuuuucucaaggucuuggcaacuggcagacaaggagauucucucccgugccuggcuuggcgggucacacacccacggagccuuguucacugaaagugcagcagucugagauugaaccgcaagguggaagccuggcugggggaggggcauccacuauugcugaggcuugaguagguaaacaaaguggccuggaagugcgaacugggcagagcccaccgcagcucagcaagcccuacuaccucuacacuccaucucugugggcaggacuuagcugaacaaaaggcagcagacaacuucggcagacuuaaacaucccugucugacagcucugaagagagcagugguucucccagcaugguguuugagcucugaaaacggacagauugcccccucaagugggucccugacccccauguagccuaacugggagacaccucccaguaggggccagcagacaccucauauaggcggguccccuuuugggacgaagcuuccagaggaaggaucaggcagcaauauuugcuguugugcaauauuugcuguucugcagccuccgcuggugauacccagacaaacagggucuggaguggaccuccagcaaacuccaacagaccugcagcagaggggccugacuguuagaaggaaaacuaacaaacagaaggaaauagcaucaacaucaacaaaaaggacaccuacaccagaaccccaucuguaggucaccaauaucaaagaccaaaaguagauaaaaccacaaagauggggugaaaccagagcaggaaagcugaaaauucuaaaaaccagagcaccucuucuccuccaaaggauugcagcuccuugccagcaauggaacaaagcuggauggagaaugacuuugacgaguugacagaaguaggcuucagaagguuaguaauaacaaacuucucugaacuaaaggagcauguucaaacccaucacaagaaagcuaaaaaccuuagguuagauaaauggcuaacuagaauaaacaguguagaaaagaccuuaaaugaccugauggagcugaaaaccauggcacaagaacuaugugacacaugcacaaccuucauuagccgauucgaucaaguggaagaaaggguaucaaugauugaagaucaaauuaaugaaauaaagugagaagagaaguuuaaagaaaaaagaguaaaaagaaaugaacaaagccuccaagaaaugugggacuaugugaaaagaccaaaucuaugucugauugguguaccugaaagugacagggagaauggaaccaaguuggaaaacacucuucaggauauuauccaggagaacuuccccaaccuagcaaggcaggccaacauucaaauucaggaaauacagagaacaccacaaagauauuccucgagaagagcaaccccaagauacauaauugucagauucaccaagguugaaaugaaggaaaaaauguuaagggcagccagagagaaaguucggguuacccacaaagggaagcccaucagucuuacagcggaucucugggcagaaacucuacaagccagaagagaaugggggccaauauucaacauucuuaaagaaaagaauuuucgaccuagaauuuccuauccagccaaacuaagcuucauaagugaaggagaaauaaaauccuuuacagacaagcaaacacugagagauuuugucaccacaaggcuugccuuacaagagcuccugaaggaagcacuaaacauggaaaggaacaaccaguaccagccacugcaaaaacaugccaaauuguaaagaccaucgauacgagaaagaaacugcaucagcuagcgggcaaaauaaccagcuaacaucauaaugacaggaucaaauucacacauaacaauauuaaccuuaaaaauaaaugggcuaaaugucccaauuaaaagacauagacuggcaaauuggauaaagagucaagacccaucagugugcuauauucaggagacccaucucaugugaaacgaaugcacauaggcucaaaauaaauggauggaggaagaucuaacaagcaaauggaaagcaaaaaaaaggagggguugcaauccuagucucuuguaaaacagacuuuaaaccaacaaagaucaaaagagacaaagaaggccauuacauaaugauaaagggaucaauucaacaagaagagcuaacuauccuaaguauauaugcacccaauacaggagcacccagauucauaaagcaaguccuuagagaccuacaaagagacuuagacucccacacaaugauaaugggagacuuuuacaccccacugucaauauuagacagaucaacgagacagaagguuaacaaggauauccaggacuugaacucagcucugcaccaagcagaccuaauagacaucuacagaacucuccaucccaaaucaacagacuauaccaaagacaaaaaccacacgauuaucucaauagaugcagaaaaagccuuugacaaaauucaacagaccuucaugcugaaaacucucaauaaacuagguauugauggaacauaucucaaaauaauaagagcuauuuaugacaaacccacagccaauaucauacugaaugugcaaaaacuggaagcauucccuuugaaaacuggcacaagacagggaugcccucucucaccacuccuauucaacauaguguuggaaguucuggacagggcaaucaggccagagaaagaaguaucaauuaggaaaagacaaagucaaauugucccuguuugcagaugacaugauuguauauuuagaaaaccccauugucucagcccaaaaucuccuuaagcugauaagcaacuucagcaaagucacaggaaacaaauuuaaugugcaaaaaucauaagcauucuuauacaccaguaacagacaaacagagagccaaaucaugagugaacuccuauucacaauugcuucaaagagaauaaaauaccuaggaauccaacuuacaagggaugugaaggaccucuucaagagaacuacaauccacugcucaaugaaauaaaagaggacacaaacaaauggaagagcauuccaugcucauggauaggaagaaucaaugcugcccaagguaauuuguagauucaaagccauccccaccaagcuaccaaugacuuucuucacagaauuggaagaaaacuacuuuaaagcuccuauggaaccaaaagagagcccacauugccaagacaauccuaagcaagaagaacaaagcuggaggcaucacgcuaccugacuucaaacuauacuacaaggcuacaguaaccaaaacagcaugguacugguaccaaaacagagagacagaccaauggaacagaacaguggccucagaaauaacaccacacaucuacaaucaccugaucuuugacaaaccugacaaaaacaagaaaugaggaaaggauucccuauuuaaugaaugguccugggaaaacuggcuagccauauguagaaagcugaaacuggaucccuuccuuacaccuuauacaaaaauuaauucaagaaggauuaaagacuuaaauguuagaccuaaaaccuuaaaaacccuagaagaaaaccuaggcaaugccauucaggacauagguaugggcaaggacuucaugacuaaaacaccaaaagcaauggcaacaaaagccaaaauggacaaaugggaucuaauuaaacuaaaaaguuugcacagcaaaagaaacuaccaucagagugaacaggcaaccuacagaaugggaggaaauuuuugcgaucuacccaucugacaaagagcuaauauucagaaucuacaaagaacuuaaacaaauuuacaagaaaaaaacaaccccaucaaaaagugggcaaaggauaugaacagacacuucucaaaagaggacaucuaugcagccaacagacacauuaaaaaaugcucaucaucacuggucaucagagaaaugcaaaucaaaaccacaaugagauaucaccucacaucaguuagaauggcaauuauuaaaaagucaggaaacgacagaugcugacgaggcuguggagaaacaggaaugcuuuuacacuguuggugggaguguaaacuagcucaaccauuguggaagacaguguggugauccaaggaucuagaacuagaaauaccauuugacccagcaaucuaaaaagccaaagaugacacaaacaaauggaaaaacauuccaugcucauggacaggaagauuccauaucguuaaaauggccauaccgcccaaagcaauuuauagauucaaugcuauuccuauuaagcuaccauugagauucuucacagaacuagaacaaacuauuuuaaaauucauauggaaccaagaaagagcccagauaaccaaggcaauccuaagcaaaaagaacaaagcuggaggcaucaugcuaucugaccucaaacuauaccagcaauacccaaaggauuauaaagcaugcuacuauaaagacguaugcauacguauguuuauugcggcacuauucacaauagcaaagacuuggaaccaacccaaauguccaucagugauggauuaaaaaaauguggcacauauacaccauggaauacuaugcagccauaaaaaaggaugaguucauguccuuugcggagacauggaugaagauggaaaccaucauccucagcaaacuaucacaaggacaaaaaaccaaacaccacauguucucacucauaggugggaauugaacaaugagaucacuuggacacagggcggggaacaucacacaccggggccugucauggugugggggguuuggagagggauagcauuaggagaaauaccuaaugugaaugaugaguugaugggugcagcaaaccaacauggcacauguauaccuauguaucaaaccugcauguucugcacauguacccuagaacuuaacgcauaauuuuaaaaaaagaaggugggaaauaaaucauucaaaacagaaaaaaaaaauucauggauaugcuaauuacccugaaaaaagaaaagaaaagaaacauuuuacaaccugcucucucucucugaggugugcuaucugagagcuuccucugcaaaauaaaacuuggucuccacaaucauuuaucuuuaaccugaacauuccuuuuuauagaucucaggucuuuugacaaacucaagcaauugucaaacagaaaacauuuaaauuuaccuauagccugguagcccucacuuggaguucuccuaccuuucugaaacaaaccaauguauuucuuaaauguauuugauuaaugucucaugccucucuaaaauauauaaaaccaagcuguaccccgaucaccuugggcacauguucucaggaccucccgagggcugacaggccauggucacucacauuuggaucagaauaaaucuaaaaagucagagaugacacaaacaaauggaaaaacauucuaugcucauggauaggaagaauccauaucauuaaaauggccauaccgcccaaagcaauuuauagauucaaugcuauuccuauuaaacuaccauugagauucuucacagaacuagaacaaacuauuuuaaaauucauauggaaccaagaaagagcccaaauaaccaaggcaauccuaagcaaaaagaacaaagcuggaggcaucacgcuaucugaccucaaacuauacuacaggguuacaguaaccaaaacagcuugguucugguacaaaaucagacacauagaccaauggaacagaauagagaacccagaggcagagguuacaauaagcagagaucacgccauugcacuccagccugggcaacaaaagcaaaucucugccucaaaaauaaauaaauaaaaauaaaaaauaaauaaaaauaaaaagaauagaggacccagaaauaaggccacacaucuacaaccaccugaucuuggauaaaccugacaaaaacaaacaauggggaaaggauucccuauucaauaaauggugcugggauaacuggcuagacauaugcauaagacugaagcuggacuccuuccuuauaccauauacaaaaguuaacucaggauggauuaaagaccuaaauguaaaacccaaaaccauaaaaauccuggaagacaaccuagacaauaccauuccagacauaggaaugggcaaagauuucaugaggaagacaccaaaagcaauagcaacaaaagcaaaaauugacaaaugguaucuaauggaacuaaaaagcuucggcacagcuguugcaggaagucagggaccccaaacagagggaccagcuggagccaaggcagaagaaaauaaauugugaagauuucauggacauuuaucaguucccaaaauuaauacuuuuauaauuucuuaugccugucuuuacugcaaucucugaacauaaauugugaagauuucauggacauuuaccacuuccccaaucaauacucuuauaauuucuuaugccugucuuuaaucucuuaauccugucaucuucuuaagcugaggauguaugucaccucaggacccugugaugauuguguuaacuguacaaauuguuuguaaaacauguguguuuaaacaauauaaaaucagugcacccugaaaaauaacagaauaacagcuauuuucagggaacgaggaaagauaaccauaaggucugacugccuguggggucgggcagaauacagccauauuuuucuucuugcagaaagccuauagauagaugugugaguaggagaaauaucgcugaauucuuuucccagcaaggaguaacccuggggaaggaaugcauuccuggggauaggucuauagacagccacucugggaaugucugucuuaugcaguugagauaaggacugaaauacgcccuggucuccugcaguacccucaggcuuacuaggauugggaaauuccagccugguaaauucuagucauacugguugucugcucucaaacccuguuuccuguuaagauguuuaucaagacaaugcaugcacagugggacauaggcccucaucaguaauucuaauuuugccuugccuugugaccuuuauugcucuuugaagcaugugaucuuugugacuuacucccuguucauacacccccuccccuuucaaaaucccuaauaaaaacuugcugguuuugcggcucagggucgucaucacaguccuaccaauacgugaugacauccccggaagaccagcuguaaaauuucucucuuuguacucuuucucuuuauuucucagaccggccaacacuuagggaaaauagaaagaacguauguugaaauauugggggcugguucccccgauacacagcaaaauaaacuaucaacagaguaagcagacaaccuacagaaugggagaaaauuuuugcaacuuaugcauccaacaaagaucuaauaucugacauccauaagaaauuuaaacaaauguacaagaaaaaacaaccccauuaaaaagugggcaaaggacaugaacagacacucuucagaauaaagcauacauguggccaacaaucauauaaaaaaagcucaacaucacugaucauuagaggaaugcaaaaccacaauaagauaccaucucacaccagucagaauggcuaucauuaaaaaguaaaaaaauaacggaugcuggcaagguuguggagaaaaaagaacgcuuauacacaauuggugguaguguaaauuaguuuaaccauuuuggaagacagugcagugauuccucaaagaccuaaaaacagaaauaacauuugacccagaaaucccauuacuggauauauacccaaaggaauauaaaucauucuaucauaaagacacauauguucacugcagcacuauucacaauagcagagacacggaaucaacuuaaaugcccaucaaucauagaccagauaaagaaaaugugguacauauacaccacagaauacuauacagccauaaaaaagaaugagaucauguccuuugcaggaacaggcauggagcuggaggccauuauccuuaguaaauuaaugcaggaacaaaaaaccaaaugccacauauucucacuuauaagugagagccaaaugaugagaauacauggauauauaaaguggcauaacacacacuagggccuauuggaggguggaaggugggaggagagagaggauaaggaaaaauaaccaaugggagcuaggcuuaauaccugggugaugaaauaaucuguacaauaaacucccaugacacaaguuugccuauauaacagaccugcacauguaccccugagcuuaaaaguuuaaaaaaugagcugauauuguuaaucccuaaauggguauuaugccuuacacauccaucucuuauguguuugguuucacaugauucuuauccuuuucauuccaucaggugaaauagauugucugucuguauaaaaccgggcuaccuauagaacacagaagcaacgugaagaccacugaagccacauauucagcaaaaucugugugcuucuugcucacaugcagguggucuguuuucuuauuugcucagauucacagaaguaggaguggugcagccacagaaggaaggccaaugcagacaauaguaauuccacaugccuuuucuccuucagaguuacaacaauguucugagugaaggaaaaugugucucuaccuuaacaaaagcuugagauaccaaacugaaggaagaauauauuaugguacuuggaaaugacuuguaaaauauuugaaauucuuuguagaaauuccuaaaaacccaaagacucuggggaacacaugaguuaaugaggaaaauuuuaccccaccuucugggaaggucauguugccuggaacugaccucugggaauggcuugucccaucuuuagggaaaggauagcugguaaagacaauauuuggauaacaagacaauauuaggccuacccuccacccauucucucaggauuggguggggugaagccacauccucucuucucagagcuuuuuauaguguuuauuccacuucucuccccuucaguucucucccuccagcauucccagagagcugauccaugccacacuaguucuuauuacuugacuuucucuaacuugcuuuuuuuuaaaauucuccuggcaauaagugccuuucuaaacuccaccucccuacuugcugaacccacuguaucuggcuccugaucccauuccacuaaagcuguucacacaaauaucaccaacaaccucauagugccaaauccaguggacacaucucaguaucuacauuucuugugcaaucugacauuugacaucuuaguacauaagcacucuccuuuccuggcucccaugacaccagguuuuuccaauaaccauccuacuuccccuacuuugccagcuucucuuuuacaccauacccuuuaaauaugaaugauccacagcguuccaucuugggauguugguucaucucauuuuaucuacauaugccaacugaauggugauaacucccuacucacuaugaggauggcaaguccuuaaucucuaugaggauaacuccccaaccucuauaggaaugacauccuacucucuauggcgaugaugcacagucuggauguuuuccuccuccaaaucucauguuaaaaugugaccuucaauguugaaggugggccuaguggcaaguuuuugcgucacagggguggaucccucaugaauggcaugguguccucuccauaguaaugagcgaguucucguucuguuaguucacacaagagcugguuguuuaaaagagccuggcaccuccuccuuucucucuugcuccaucaccaugugauaugcccauugccuucugccacaauuguaagcuuccugaggcccucaccagaagcagauguuggcacuauacugcuuguguacaagcaccauguuacaggcugaaccugcaggaccauaagacaaauaaaccucuuuucuuuauaaauuacccagucucaggcauuccuuuaaagaaugcaaacagacuaacacaaugcccuagucucuaugaggauaacuuccuaaucucuaugaugacaaguccccagucuuuauggccgugauucccugaucuguauuuccagcccaggccuuucucuugagcucaaaauuuauaaugcuagucaccuacuggacauaucugcuuggauguucuauggccaaacucaccaugucuaaaauuuaacuuuuuacccacucuaaauuaaucuuuucgcauaauuggcuaaguaaagaucaccacuuucccucuaagucccccuauauucccacuucucccucuaaucuccaaguuuuguugauuccacccacuaaauaccucucaaaucuauuuguuuaucuccuuauuuuguuuuuguguuuuuuucagauagagucuugcucuguaacccaggcuggagugcaguggcauaauuauagcucacuacagccuugaacuccuggacucaagugauucuccugucucagccuccugaguagcuagggacuacgggcgugcaccaccgcaccuggcuaauuuuuuuguagagacagggucucaauauguugcccaggcuggucucaaacuccuggccucaagugacccuccuuccauagccucccaaauaauugggauuaccaguaugagccaccaugcccaggccauuucucucuguauuucuucccuggacuccuacaauaacuucuguagaguccuccccaccucuagguacuuccccuuccaacacaucaucuacuuaaaagcuaacauagucauccuaaaaaugcaaaccucaguauguggcccuaacuaguaugaaguucuucaguuaugccuuuaugucccucaaaagccaaacuccagcaacaauuuuaaggccaugcuaaccaucuaaccacacaacccauguguauuaagguguuggucucuaaauggggucuuuuuuuccuauccuccugccuuauaguaaaauguuccuguuucuuucuuguaccugaaacaguauucuuuccucucuuauuuaucuaacuaacucuaccuuaugaagaaauugaggcucaaauuguuaguuuauguguuaucacuuccaggaagucuuucugagaaaggcuuuccccuucucuaaugauggacgaaauacccuccuuugcaauccucucauagcacccuucucacaaugcuauaauagccuuuaacuugugucagucuccccuaugagacagagcaccuuaagaacaaggagugccucuccagagcccagcaaaggguuuggccuauagcaguguuacauaugucaguugaaugagugaaauggauuuagacuuuuaguacacaacguuuuccaucaaaaaaguggagguauauauuugacuacuucaaacauguuuuaacuucucaauuccaugguucucacuauuuuuaguaagcuuccaggcaaccucaacuucaguuuccauguuuucuaggaagcaaggggacagauguuugggcaguaaacccaaaaucuggaucucagagcuuaaucauaaacuccaugggauauuuuuucacugacuuuccaagaauaguagacucaaaugccauguuuauaauggaagaaaauauacacucagcuggucauuggucguuccuuagcaaacaugguuaacucuccauuguaucugagaaucagucauucugauuaaggaaaugcaguaugacuagguacugaugcaucuccuaugaaaugggaucucaacccugccucuuacuagcugcaugaccuggggaaguuauuuaaccugucuaaauuuucauguucuagauaaaauuuuaaagacguaacuuauuuagguaaguugacaugaagacgcagugagcucuguaugaaaaaaugauuagagugaucucaccggaccccauggucuuaguuacuguccauacgugggaaauacuauauauuugguccagacauauguauuauugaacuuucagcugccuccuucaccuuuuaacuuggauaucucacaggcaccuuaaaccuauugugcccaaacagaauucaugcucuccuuuccucugcaaaacuguuucuccuguagcuuucuauaacucaauauucacagcucagugaacaucaccacucauccaguuacugacaccaagaacagcagcaucauccuguauuccuuccccacccucacccuuuauauccaagcaacucacuaacucagcaaaugucccugaggccuuguaccaagucuuggaaucucccaaaaauucaaugccauguaacccucuccaucacucuaaugucuucuuagucccaucaucaugcccucccacagaagacuccuaacugauuccucugcauccacucuuaccuaucaucaaucugcuuuccaacuacggccagaguaaucuucucaaagggucuauauaaucacaucauccacuaguuacuuagaauacuccacagcuucccauuacuuacaagaaagaacacaauccuuuaucuagcccguauguccuguauguucuggccccucccugggucuccacuucucuaaucacaguauuuccuucacuguuugcccccuuucagcccccauuucacuaugcuguccucgcccagagcccuagcacaauuuauguacucugccuagaacauucccuucccauccucuuugcuuagcuauuuccuauuuacccuucagaucccaacagaaagucacuuccucaaggaugccucagaaaacccuacccugaaccccacacuaacugguacccuucacaacacucugagcuuuuucuucauagcacuuaaggcuauuauaaugaauuguuuacauauguaagucuuucaccagagcaguccucaauuccggauauauacauuagguucacuggagaccuuuguaaaaaugccaacucuggggucccaucucaaagcaauuaaaucagaaucccucgggggcugggguccuggcacugacauuuuuuaauggcucccuggugccaagugcagccaggguugggaaucacuggguaggagggcaaggaccaugucugcugcuuauccaugacuucaucccccgugcugagcacucagcagugucugcacagaguaggcacucgauaaauggcaacuguacuuaugauuguuguuuuuguuaugguugauaggguuaugauuacaaagaucauuaagccauaugacuuuuuuuuucacauuuuuggccucugugauucuuugcuacagaacucuaaaaaauaauaauaauaaaacuguaguagccaaaucaucuuuuuaaaauucaaugaguuucuauuuuccugucaacauagagcuucaauuaaggauugacuagaaccuauuggacauguuuuuacuaaaagcuaugucuccaaaaugaaacaaaauacuguauacuuaaaaauccaauucauaucauacaaugcccuuuuaugcagauauauauuagaaauuagucauuagugacuuucuaauuuuguaaugauaugaauuaauuggauugaccacugugacaucauucugauccuauuugauuucacaauucucuguucauuuuucuuuccugucacauuaacugucuugucacauaaaugucaaaccaccacccaccguggcucagugguuaguucugguuucuucugcuugcugcuuuccuguucagccccaugucagaggguaggcccuggacuucuccuuuaaagaaccuucuaaaaacauaguuucucuaauccaauucuuaaccauaaaccugcaucagaaucaccuggaaggcuuauuacaacugcuugaccccauccucagaguuucugauucaguaagucugaggugaggccagggcauaugcauuucuaacaaguugcuaggugaugcucugcugcagguccagggacuacacuuugagaaccacugcuuuaauucauaacacacauaaguaaccuccuaauuaauggcggaugagaaggggagaaagagacugaagagcaauugugaggccuuuuagggauacagugggugaagacuacccaaguuauucucuauacuuaaagcccaaccaggggccuuuuccccauaauuuuagggggauuuucccuucauuauuuuuuauaaacaacucaacauaucccauccauacuucucucuuuauaaggaagagauuauguaggggcagcaugccucccgucuauuccuuauuaggcaauucccucaguuacuaucagccugcuuuuuagaagcaguccuaguucaccauccuugaagucagccaguuuaaugaaauucuuuggcacuguuucacacaauggugggaggggaacugaaauagcagugaggaaauugcuaagaagcuauucaaagaaacaagcuucaaaaucacuucaggagguuucagcugguguugggaggaagcaaugacguaaggaaucccaaggcaccccaaagaaagcauaguaagcccaagaccagcacccuggcaagaugcuggacacacaaguaugguacuaugaguggaauacguggccagagugaacaugacauuucagcuuuugcaguuacgcacaccaaagccaugaauucagaugaaugcagagcacaucuuuacucugcaggaagagugacuaggauaacaaaugcuuucccgugcugccuucauuuauggguguucaacaaaaauuauaggaggccacuguuuuggacuaaaccccugcacuaggccccaacagaccagccuaaaaaccaaaauagagucccuuaucuaagguucugcuucuccaaaccuugaguuuguuaucuggucuuccaugaaaucaggagagagaggcaacagccuaauuucccaacaggccaguuucagucuucaacuggcaaucaugcaguucccucuguuuuaauucuuacaacagaguaacccgauguuaaccaaucaguuaucuuuccaucuuucuaucucccuaugcccacaaugaaaguaacuuugaaauguccaaucuacuuuuuguucuuuguuucugcuuucuucagcccuuucucugucuagaaagccugcugccucuggucaacucauuggaacacuuacucuguuuuauggaaugaaguguugccuaauucuaaaauugcaauaaagccuauugagaucuuuaaacuaaauuuguuguaauuuugucuuuugacagggucuuauggggcacucgggugaccaaccaucccaguuugccugggauuguccugguuuuaacacugaaagugcuguaucccaagaaaccucucagucccaggcaaagcaggguggguugucugauggacacucccaucuucuucagccacgcucucuucuccuaauaccauucccacucucacuucuuuugauguuuuuuuuuaacuaugcaaggcacccucuccucuaagcuucucugucuccugguaaacucuggcacuuuuagucucucuuaagcaauucucuuuacuccccugaguucaguuuugugccugacuucacugucaucuucagguuuuccaccaugcugacuucuaaaauaccccccaugaacaugauuucucuuuuucaaaccaaaaaaaaaucucaaaguugaaaggauccuuagaguucacacacuccagaguucccuggggacuuucuguagucucaccugggacaauuacaucagaauuucuagcauggggcccaggcacuguucacuuuuaacaccucuacccccagccgggugauucuaauguacagccaaaguucucccuugugaaccucuaacuuaguccaacuccuuccaagugguaauccuguuuaaaagauggguauuuacccucugcaguaaaauucuccacugaugggacagaagugcauauccagguagucuaagccauugccagacaugucuaacuguuagcaaucuaucuugaccuaaguucuguuucauucuaacuuccacucucugaucccagcucgaagcuacaaagcaaauuagaauuuguuuacuucauuaaaaauuuguuuuucaaguccucauggguugccaguauauaaaccccauccucaaguccccuauucuccaggcuaaauagcuccaguuccauuuaccauucuuuacauaucacgauuuucagauuuuaugucacccuaauuacccuccacuagaugcccuucaguuuguaauguccuucucaaaauacauugcucugaacugaauauagcagauacagugaaguuauuauagcccuucaccuggaaacuaaacauuaacacuguuuaaauaugacucaucauuuuagauacucauacugagggcuacgggucuaguaaaaccuacagaucuucccaugaacuaccuccaagucaggaaucucaccuuguguguaucaauuaaaugucaaccuaugguuucagcucauuuuuccagccugaugauacuugauccuuuuauguaauacauugcagucucacuaaaagcuacguauuguuagcaaaucugcuaagcaugcuuucuaaauuuuuggccauaucauugauaaaucgugccacauaagacaacaacaaggacagaaucuuguaguauauuucccuaccaccuuucuucaagguagauuucaaacuauuuaucaacaugauuuggccaugguuuauguuaguaccaauccuuuuaguucauucuuauccaaucucuauuucuccaacucaucuuugggcauaucaugaaagacucugcuauacauuuuuuucauacugaaguacuuacaaguaaaaugauauaauauuugagauuugcuuaaaauauuccaaaaacagcaaaaagguaugguugggaggaaagugauagaugaaacaaaaaaaacucagaauauugauaguuuguaaugauggguaauaaguauacagugguuuauuauauuacucucuucaucuuguauuuguuugaaauuuucuacaacuaaaaaacauuuuaaacucuugaugaaauaaacuucaguuagcccuugaacaacauggaaguuggggguacugaccuccacggaguugaaaaucugcauguaacuuuugacuccccaaaaacuuaacuaauagucuguugaccaauaacacacauagucaauuuacacauauuuucuauuuuacauguauuauaugguguauucuuacaauaaaguaagcuacauaaaagaaaauguuauuaagaaaaucaaaaagaagugaaaauacauuuauaacccuguacuguauuuaucgauaugguaaguuugcaagauccccaucuaugagaugaaucaucuaucugaaguggugggcaaccaccgcugcagacaucaaccuacaguucauaugaagcaauucaacuuuuucuuguaaugucaugagucaugacuuuucucugcuucuugagagcacuuccaauaucacucgugguacuuugaaugggucccauguuguuauucaaaguuuacaguguuguacuaaacacaaugaaaaauacucaaaauacuugagaaccauuagagaucacuuuuuacugcaauaugcaauuuauggcauucuaggcagauacaugcaacaccugagcucacuguaauagcaagaggagguggcuacaaaauuauuacaguaguauaguauguaaugcaguuaauuuuaugcaguuaugacuuaauacugcaucuuuauauuuguuuaaauuucuaucaacuguaaguggugucaugcauggucuguaauuguguaagcuuugauaaauguuaacuuuuuauaauagauuuguguauauuucaugguaguaaugauagauuaauaucuacauauauuuuaugcauucaugacauaccuuuuaccuaauuuuuuucaguauuucuaggcuauaugguucaucuuugaguuuuuccaauuguugcaaaguggacccauauaauucaaaccuguguugugcaagggucaaauguacacuguuucuaugaauuugagagacugccaaaauuuuuuaacccuagagcccuucuaaauauuuuacaaauaagaguaauuugauauaaguugauucaauaaaugcaugccaguuucaagugacuggagcuuucuuuuuuagguguuaacaaaucuuccauauuuaagacuuugccacguaucaacucauacugaguuuccuggauccauucucuuucaucuuuuacuauuuagauuaccaauuccaauaauuuaaagagcauaucucucuaaaauucuuuaaacucauuuagaaaagucaagggcucucaauaaauucucauccauuucaauuacuucuuaauuguguauguuuuacuuuguacugauugaacuccauuuuucuagauggaagcaaaauagaaguucagagguuccaauuccuuugcaucauccaugaucacuaugcauuccucuuccuguucauguucuuccacugaacuguaaccaaaauaacuuuuguuaucuuuagcauuuuuuccuccaugccucaucgccaacagauauuuaguccaagugaugcuacuuuuaaaagaauucuccuagcuucuaaccauucuucucaauuacuugcauccauuucucuauuguacaaauccucgggggaaaacuguuuauuuuauaaaagccauaguuaccauagagauuuuuagaaaauagagaaaauaauauauaagaaaauuaaacucacccauacuuucucgccuccucguaaaguuccucagaucaaauaaguguuuuaacugcuuuucgcuuuucucauccauuaugauuauuuauuauuguauaaucagguuucucauuuaguuauuucuuuuuuagacucgcuuuuuucuuuuuuuucuuuuuuuuuggacagagucucacuuugucgcccaggcugcagugcaguggugcaaucucagcucacugcaaccuccaccucccauguucaagugauucuccugccucagccuccaacguaucugggauuacaggcacccaccaccacgcccagcuaauguuuguauuuuuaguagagaugggguuucaccauguuggccaggcuggucucgaacuccugaccucaaaugauuccccaacucagccucccaaagugcugggauuacaggcgugagccacuaugccuggccuagacucaucuuuuaaagccauauucuuuuuaguaaauuugaucaugagaauucgucuaccauuuuuucugguuuuguuuuaaaauuuuauuuaugcauguauuuauuuuuaaaucugccuucuuaaaaaauugaggccaugugucugguugccuuacaguucccucuuuuaggacuauuaaugccuagaugaacuagucagucauuucuccuaccuucucaaucauaucuuucuuuugaauuaaaauuaaaccaaggaagacaggcacuaauaucuuccucuaacuugcaaagguaucuccaaggaaaaaucaagaauucuucacauguucuacuuuucgaaaaguagauauccaauaaauauauagguaaaguuacaguguuucagaauuuucauaacugaaaggaauuuggggguggggguugauggaggaaaguguugccauauccacugcagccuucuuuaugacaagcacuguaguaggcacuucacauacuuuuuuuuguuaauacucucaaagauuacauaugguaagaacuguacuguuuuagucccauuuugcaaauaagaaaaaugcaaauaauauagguuaagcaacuuccccaagauggaagaauaucuuuaaacaauaauaauuuacauauccagugugcaaacuccccucgagauacugcaucaacagucuacauugcuucugucccagcucugucauuuguaauagaaauacuucauccagagccugcacuuaacuggggugguuuaucuuauauucauacaacaaugucuuucucauuuucucuccuuuguauucucucacccaaagcccucuacagagcugccagucucauacuucuauauuuucauacagccaaauacuaucuuuaacauccccucuccuuccuaaaacaccuauaucuuuaaauaaaaaauagacuuuguugcucuguaccaauuaguaggcccauccuuccaagcccucuuguaauauguggagcuucauguuuacacagaguaaaagaagcaugucuauuuuaacagauuaaacuuugguuugaaaaugaucaaaauaaagcuuggaauacuacgcugaucaaauuucccuaaaaguuguaucaauaaaucauauucccccuuuuuucucccucaacucuuuuccuggaaauuaauauaucuuauuaugcuuuauuggaagaugcaaagaccauggcccagcaccuuucuaugcaucauucuaauguugguagcucauuaccuaaauugaaaacaaaaccaaagagcaaaacaaaaccucgagguuacuagcucugggaucuugaguaagucaccuuuucuaccuuguuuccucagcuguaaaaugaggauuaaugguaauaccuacuugacagaguuaagaggauuaaaguaaauugaauaauguauaagaaacugccauaugaaccauaaauucaaugauuauaaugaugauugugaugguuugcaaggccacaacuccauuuguaaucaacauacaaaaucaaauaucuaaaugugcaacacucaaguaaccagaggcuuuuuauauuuauaaaugguguugaaaauuuuaaguuucccagauuuccagguuucaucuuuuucccauggcagaaaagucuagguuggauaaggugguuucugucauuuuaagauaugcugaaacuuuuucucacuagauuuggugcuuucucugcugacagugggcacagggagccagaaucuaggacugcacuuggcuuggugggaaccaguccugagcugccuuccuccuuggggaacaacauuagucucagauucuaacaccaggguucgcuuucucaggcaaaggacgguagugcaauacggaagcuagggauaugcauuccuucucccuccccuacugaaccugcgucuccuucaaccuugucuuucaggcuccuuuucagggcaauauggaagucucugugcucaaaguacccuccauccuccauugcuuauugcuccacuaauuuccaauuugguggaguuaaaaagaaauaccucugguggccuuaaagucaaaggaagcugugugguccuucucaccaaaaccuggcuguggcaaagcugaacagaaugaacagaaguuuugagucauuaugggaaggggaggggcaaaccaucccuagggaguuuggaacaaagugcuuuaagcagcacccaagcacuggguagcagggugggaggacauaaggggucaggagguagaagugaggcucagauaugaggcccucagauaaacaccucucuuucaccugcauccaguuuuaccaagugcccacucuugucuccuuccugccuccuuagauaacaagagcagcaccacuggaugcuaggccaagaaaaacgcuugccauccucacaaucauccucuuccccauuuguuauguucuuacuggguagcaggcacugugcuaagcacuuuauacucauuguucaucaaauuaucacaacaccauagauaucauuagccuauuuugcacuugagaaaacugggguccaaaaguuugauaacauauucguggucacacaaaugguaagcacagagcuggaauuugaggacaagccugucugacuccagggauucuaagcucuuaauuauuaggagacauugacacucauuuaacucuucucuuuucuuuuauuucccccaccuauccaccucccaacuuccuucagccaaaugaggccaguuuacauagccaccuucugagaaaaguuaccacagaugguuucugcuucauaaguugcuggguugguuuuguggccaaccuuguguccugagaccuuaugaucuuggccacaacagauuguuccaacaacugcugcuuaagccaaagucaacuauaggcuggacuugcauuaucucauuuaauccucauaacaaagcuuuaaauuaaguacuaauaccaacugcauuuuacaagcgggaaaacugacauucagauaaguuaacuuaccugccuaaggugggacagcuaguaagaagcagaacuaugauuggaagguagguuuaucugaaugcuugaacacuguucuaccucccauuuuuucagagaucaauagaguuggccuggaacaagagaugcccuugaaugcaaguuguaacaacugagagaaauugcccagacacugcaacgggaguugccaacaaaguaacagagucagagaagagcugagucuugggaaugaaaaagugaugaggggaugacuuccacaguggguauccggucauuugggcugcugcucugcccucaucaaagugauuuccacucugugagucucugauaugcagcuauagaaccuguugccuguuuccuaauuuauccaugugggccugucacccucaucaccucagguaacaaaguccaguccuuauuacuuugugccucacacauacacucccuuaggccuaaacucccugcaacgccacuccugccaaacccccaugauuguccuggccugauggagugaaguaaugagagacuugaagcuuuguagaccugaaugcucauaucuugccacuaccccagccuccagcuuuacuuccuccuccaauggguagcucucucuccuccuuccucauugucugccagccugagggaaaagaguacugaggccgauagguguuuuccaaaaggcucugggugcacuggauguacaccagauguuuccugcgacaacagcaagacaaaggcagugggcaugcagaaagccauauagcaauuggucucuggaacugcuacuuccuggguccacaaggucuuggggugacuaggaaacacagccugaguuuuucuccccaggccuucacacucuacaguuagccccauucucuacacaagacaauggagcucauaggaguccccaugucucugagcuuggcuagggcaaacaguuagagaguggcugcuggugagagacagugcugaaaaugcuggcagcaagccauauaagacauuuuuaguggccccauaaugucuauauacucuaaggaacuuguauuugugagcagcuggugcuacaucauuagaugucauaugugacaggcuguuccaagaaagauccaggauacaagaagcuggauuuccugacuucagugucccuggguuuuuaaugccuacccuaucuuauggguaauuuggcaaauggucaaauugcuacacugaucuuuucuacaaucaaaaaaaaaaaaaaaagaacaagcaaagcaccugauuauacaaagcaucuuacuacauuccuccugcaggaaggcaggauauaguaaucgaaagagacaaaagaaaaaaaaugacuaggaaccuauauuuuugcauagauuuucuacccgcuuucacccccaccucuucccaggccaccugcuauucuaguucuuggucaccaauuuugccucaucuuaaaauuuguuccucuuucccauaaucaguaguaacuagaagcugaguuccccaggcaaccauaaauacuuguuauucuuuuugccacgugacuugcccuaaaaauaaauucaaauauuuuuccuaccaucaaaaugccaggaagaauuggauacugucuugaagaaguggacacuguuuuuuuuuuuuuuaugccuaccugugaaauagagcaggccuaaugcuacuuagccaaaauuuuuaggaauccuaagaaaguccuaacacagaagguaauauaaaaaccuggguguuauccuaucuugaaaaugggacaagcaaagaagggguugggaaaagagaauuagaacaagcugauacacacaugcucacacaacccagaccaguauaauuuguuuuucuuuuuagaaagagaguagcaaagaaaagagugcguguuugcucugaaguuuagucaagauuuugccacuuucuuugaaaugcccccuugaugugccagccaaggacccuuagagaccuccauuugaagcugaaaguacuugaagccaauuaaugaaaaagauuugcuuuccagucucaugugacucugggguggaugaccuuuuggaaaucauggacaaagucuccauuuagagcuccuacagagugaugaccccacuauacaaaucacugugaauuagggagcuuccaaauuaaacaagauucagcaaauagaacagcgacaaugguaacaaugcuacucauaaaacuacauuuagaugcucucaaaaacaguuuacaaaauucauuuuuguccacucucuuuuuugauccucaaagaaacucccuaggagacaacggauacauacacuacacacacacacacaaacacacacacacaccgcuuccauuuuauaggugugcaaaagcugaagcuaaagagcaaagcaacuugcccaaccuguauguugcugaguguaaaauucaaccaagccuucuacuucuagcucaguaucuuuuuaacccagacauucuccucccaugccuccaucccauuauccccaagaauccugaaaccaguaguuauccagaugaccaggagcugaaaacgcagccuuagaacuuuuagagaaucaauucaaaaauagauaaaagaauagaaaaacuguugggguugggggaacaacaggaagagcugagaugaacuaaugcaggaugaaaucaauaaggcaagggggaaaauucucucuuccuuuuuccuucacaucuucccuguucaucaccaccuagccuaggcgccaggacuuccucaaauugcccuaacucuuuugcccaauacuggguuguuuuuaccagguucacgugauaggcucugaaaauauuuuagcuaaaccuucugauuagccaggagcauguuuccaauuuuuucuuggaacuacuagccccagucauauucauuuuuacuaccuccuuugacacauguuccuuauaugacauagucucugcauccuuccucauucuggacauaccuacccaguuugacaaugucucacuucagaugugauacaaaaaaggaaauauacuacccauaaagugauuuucaguucuucacucaauaaaucaaccaaaaaguaaauaaauauauacugaaucacaggaaacauuuuagaaugauagaaugcucuauaucuuaauagggcaauuuaaaaauuguuguuguagggguaaacaagguggugaaagucaagcacuuaacacagagccuggcacauuaguccuuuauagaucacugcaaaccaaugccuucauggcacucuaucugcaugcaguauuaucuucagcucagagcaguguauuuuggaaguggcauuaacaaacuggaggcagaaauucuaaagaagagaaaggaguuucuacucacagaacucucaucaauaauuugucccuuucuguucacccuuauccagcucugcccugccuuggugaaggcauaacaggcuuguuuccugaggcucugucucaccuaauuccuggaauauauuauggacauuuuugcuuuagugggagagcaccugaaaacccaccaucaaucccaugccuggggucaaguguccuggaaggaauuuaacaucaccuaugggagaaucugggcaaaccuccuuggcuaaauccauuucagaguauauaacacagucgugaacuuuggucuggcuaccaagguccuggcccucuuuucguuuccacccuuaagacuacaaccugacauaaacuguugaccaaauuaguaggagacuggcucccuaugcugauuuuauuuuuauuuuuuuauuuuuaauuuuuauggguacacaguagguaucuauauuuaugggguacuugagauauuuuguuacaggcaugcaaugcguaauaaucacaucaggauaaaugagguauccaucaccucaagcauuuaucuuuuguguuacaauccaauuauacucuuuuaguuauuuuuaaauguucaauuaaauuauuauugucuauagucacccuauugcaaaccaaggcaauagguuugauagcacccuguugcgcuaucaaauacuaggucuuauucauucuuucuaacuauuuuuuguacucacuacccaucccuuuuuccauucuacccagcccccacuacccuucccagccucuaguaaccauccuucuacucucucucaguucaauuauuuuaauuuuuagcucccacaaaucagugagaacaagugaaguuugucuuucugugccugacuuauuucacuuaacauaaugacuuccaguucuauccauguuauugcaaauaacaggauuuuauuauguuuauggcugaauagcaguccauuguguauauguaccacauuuuauccauucaucugucgauggacacuuagguugcuuccaaaucuuagcuauugugaauaaugcugcaacgaacaugggagggcagauaucucuucuauauacagauuuucuuucuuuuggguguauaccuagccauggaauugcuggaucauaugcaugcacugguuuuaguccacuccugucacauaaggucugaauucaguuuccccugucuccauggugcuaagacagacuucccugaccaaggacuuggacacagaccaagaauguacuucccugaugccccuacagcuggaccccacaccuaggaucaaagcccuugaauacagucaugaccuggaucaaacaugaguuuguuccucucuuggacacaaugaucugaauugccuggggcaacuuccuuuuagucuuccauuugcaaagaacuucaggcacauuucauguccauagauauucuauuuacaaugacagggagaagggaaaaaaauuacaaaaagcagacacauagacucauaaagcaaaacaguuuauaaaagauuuaguguaguggcaaauaguucuaaaaacuuuaauagaccuugaggucauugcuguuuuauaacuucauugauucauucauguacucauucaauacgcaugugugcagugauuugaaucauaguugccuacaauaugcuuggcacugucuauacaaauauacauaagauucauauuuauagggccacauauuuauucuuacuuaaagggccacaaaaauuaauguuugacggacacuuagguugcuuccaaaucuuagcuauugugaauagugcuacaaugaacaugggaggacagauguucaauaucaucaccucaaccuaucaaauaaaaguuuuuauguuugguauguucuguuaaagaugagaaguaugcaauacaccucagcagauuauauaauuccuuccaacaacaucagcuauaauuggcauaaaauacaauaugugagcuucauuucuguggguaacagcaguauuagucuugagucugguauguuuaggucugcaauacaccucuggcccuccuaguuguaucgaacuagccacaccuccucacaucuaaauugagaauaacagcaguucucaccucauaaugcuguuauaaaagccaaaugaaauaauauauaccaagugcuuaacauggugccugaaaagcccccauuuacauuguauuuuacuucucaaauaugcacgauaguguuuguuugugcaauuuaaauuaagauauuuccauuuuucaaaucaccuuagcaccuccacuugggcuuaauagcuaagguuaagugaaaauggccuugaaaaaaagacccuaggagguaaaagcaguaaccaguaaggacaacacacacacacaacccuaacuaaaaaggaguaaguagaaguaggcagcucagaguccuagaaauuauaauuugugagaaacaucaaaaguauuacuuucuaggaaaagaaguugcagcacaugaaauuccucaaauugaaacuaagccaacuccagcauacauuaauaaaaugacaguaucccauuugagguuaagucuuucagagcauaucuggacccuauguuaaguuauagacacacccuuaaagugagacuuugagagaacaugguccaaagcguuccaaaaauguuagccaagcagaauuucacaaaggugcagaauaaaguaggcagaaccaggccucuucaggcuggggaauggcagauguggaggaaucaugacaguaucauuucaaauauuugagggacuaucuccuauggaaggagauguagaaaugggagaggaucucuauggucuacagggcagaacuaguucuaaugacaguggaaagguaaagggaaggagaaagacuuuaauucaacuuggaaaaaauucuaacaaaguugucuaauauaaugagacaaguguugggguuagggagguggugaggagagauuuuaaggauucaacagagaauccagcuagauuaagaagcuggacuguggauuuggcuggucugugaccaguacuuuuggucuaugaccaacaauuuuuucagcugcccaugguaagagaaauaaaacaaugauacacucucuaagacucauuaacuauaaaacaaggauaauaauauuaaccugauagaacugagugaagauuaaguaagauaauaugugaaaaggucuucaacaugaaagacauaaaugaaaaguuaaaaacacaguuaaaaaaacagaggaaacaaagaagaaaacauuaauuacuaucaucagagagaggagaaaauauugcauccaugauaccaaaaaaguguacaauuuuauuuaaauaaacuaucagaaaauaaaaacaagauuuuagaaauuuaaacaguaauaaccaaaauaagaaauuuuaacaaaaagguuaaaagauaagguugaggacauauccuaaaaaguagagcaaaaugucaaauuuuauccauugcauucuagccaacaguuagggaauauuaguuuccccacauuuucaacaacacuggauauuaagaaaaaaaucuuuuagguaugugaaaaauaguaccucacuguuuuaguuuacuuuguuugccuaccagugaaguuggauauuuucucauaucuuuuagccauugacacuuccucaacuacaaaccaccuguugagcucuaacaagagucaagucaacugccugggucuugucaguuuucuuuucccugucugucauuagaaacaucuugguuccaagauggcugaaugggaacagcuccagucugcagcucccagcaugacugacaaagaagacaggugauuuuugcauuuccaacugagguaccugguucaucucauugggacugguuggacagugggugcagcccauggaggacgagcugaagcagggcgggacaucaccucaccuggaaagcgcaagggaucaggggauuucccuuuccuagccaagggaagccaugacagaugguaccuggaaaaacaggacacuccugcccuaauacugugcuuuuccaacaguuucagcaaauggcacaccaggagauuauaucccacacaugguucagcggaucccaugcccacaaagccuugcucacuucuagugcagcagucugagaucaaccugcgaggcaggcggaggggcauccgccauugccgagguuugaguagguaaacaaaguguccuggaagaucgaacugggcagagcccaccgcagcucagcaaggccuacugccucuguagucuccaccucugggggcagggcauagcugaacaaaaggcagcagacaacuucugcagauguaaacgucccugucuaacagcucugaagagagcagugguucucccagcaugguguuugagcucagagaacagacagacugccuacucaagugggucucugacccccauguagccuaacugggagacaccucccaguaggggccagcugacucuucauacaggcgggcaccccucuaggacgaagcuuccagaggaaggaucaggcagcaauauuugcuguucugcaauauuugcuguucugcagccucugcuggugauacccagaaaaacagggucuggaguggaccuccagcaaacuccaacagaccugcaguuaagggaccugacuguuagaaggaaaacuaacaaacagaaaggaauagcaucaacaucaacaaaaaggacauccacacuaaaaccccaucuguaggucaccaacaucaaagaccaaagguagauuaaaaccacaaagauggggagaaaccagagcagaaaagcagaaaauucuaaaaaccagagggccucuuuuccuccaaaggaucacagcuccucgccagcaaagaaacaaagcuggauggagaaugacuuugacgagcugacagaaguaggcuucagaagguugguaaugacaaauuccuccaagcuaaaggaggauguucgaacccaucgcaaggaagcuaaaaaccuugaaaaacgauuagauaaauggcuaacuagaauaaacaguguagagaacaccuuaaaugaccaagcugaaaaccauggcaugagaacuaugugacccaugcacaagcuucauuagccaauucgaucaaauggaagaaaggguaucagugauggaagaucaaaugaaugaaaugaagugagaagagaaauuuagagaaaaaagaguaaaaagaaaugaacaaagccuccaagaaauaugggacuaugugaaaagaccaaaucuacauuugauugguguaccuaaaagugauggggagaauaggaccaaguuggaaaacacucuucaggauguuauccacgagaacuuccucaaccuagcaaggcaggccaauauucaaauuccggaaacacagagaacaccauaaagauacuccuugagaagagcaaccccaagacacauaauugucagauucaccaaggugaaggaaaaaauguuaagggcaaccagagagaaaggucggguuacccacaaagggaagcccaucagacucacaguggaucucucggcagaaacucuacaagccagaagagagugggggccaauauucaacauucuuaaagaaaagaauuuucaacccauaauuucauauccagccaaacuaagcuucauaagugaaggagaaauaaaauccuuuacagacaagcaaaugcugagagauuuugucaccaccaggccugccuuacaagagcuccugaaggaagcacuaaacauggaaaggaacaaccgguagcaaccacugcaaaaacaugccaaaucguaaagacugucgaugcuaggaagaaacugcauaaacuaauggguaaaauaaccagcuaacaucauaaugacaggaucaaauucacacauaacaauaugaaccuuaaauguaaaugggcuaaaugcuccaauuaaaagacacagacuggcaaauuggauauagucaagacccaucagucugcuguauucaggagacccaucucaugugcaaggaacgcacauaggcucaaaauaaauggauggaggaagaucuaacaagcaaauggaaagcaaaaaaaaguagggguugcaauccuagucucugauaaaacagacuuuaaaccaacaaagaucaaaagagacaaagaaggccauuacauaaugguaaagggaucaauucaacaagaagagcuaacuauccuaaauauauaugcacccaauacaggagcacccagauucauaaagcgaguccuuagagaccuacaaagagacuuagacucccacacaauaauaaugggagauuuuaacaccccacugucaauauuagacagaucaaugagacagaagguuaacaaggauauccaguacuugaacucagcucugcaccaagcaaaccuaauagacaucuacagaacucuccacccaaaucaacagaauauaccaaagacaaaaaccacaugauuaucucaauagaggcagaaaaggucuuugacaaaauucaacagcccuucaugcuaaaaauucucaauaaacuagguauugauggaacauaucucaaaauaauaagagcuauuuaugacaaacccacagccaauaucauacugaaugggcaaaaacuggaagcauucccuuugaaaacuggcacaagacagagaugcccucucucucaccacuccuauucaacauaguguuggaaguucuggccagggcaaucaggcaagagaaagaaauaaaggguauucaauuaggaaaagaggaagucaaauugucccuguuugcagaugaccugauuguauauuuagaaaaccccauugucucagcccaaaaucuccuuaagcugauaagcaacuucagcaaagucucaggauacaaaauuaauaugcgaaaaucacaagcauucuuauacaccaauaacaaacagaaagccaaaugaugagugaacucccauucagaauugcuucaaagagaauaaaauaccuaggaauccaacucacaagggauguaaaggaccccuuaaaggagaacuacaaaccacugcucaacgaaauaaaaaaggacacaaacaaauggaagaacauuccaugcucauggauaggaagaaucaauaucaugaaaauggccauacugcccaagguaauuuguagauucaaugccaucuccaucaagcuaccaaugacuuucuucacagaauuggaaaaaacuacuuuaaaguuccuauggaaccaaaaaagagcccacauugccaagacaauccuaagcaaaaagaacaaagcuggaagcaucacacuaccugacuucaaacuauacuacaaggcuacaguaaccaaaacagcaugguacugguaccaaaacagagagauagaccaguggaacacaacagaggccucagaaauaacaccacacaucuacaaccaucugaucuuugacaaaccugauaaaaacaagaaauggggaaaugauucccuauuuaauaaaugguccugggaaaacuggcuaggcauauguagaaagcugaaacuggaucccuuccuuacaccuuauacaaaaauuaauucaagaaggauuaaagacuuaaauguuagaccuaaaaccaggaaaacccuagaagaaaaccuaggcaaugccauucaggacauagguaugggcaaagacuucaugacuaaaacaccaaaagcaauggcaacaaaagccaaaauagacaaaugggaucuaauuaaacuaaagagcuucugcacagcuaaagaaacuaccaucagagugaacagacaaccuacagaaugggagaaaauuuuugcaaucuaccuauuugacaaagggcuaauauccagaaucuacaaagaacuuaaacaaauuuacaagaaaaaaacaacuccaucgaaaagugggcaaaggauaugaacagacacuucucaaaagaagacaucuaugcagccaacagacacauuaaaaaaugcucaucaucacuggucaucagagaaaugcaaaucaaaaccacaaugagauaccaucucacaccaguuagaauggcaaucauuaaaaagucaggaaacaacagacgcuggagaggauguggagaaauaggaacgcuuuuacacuguuggugggaguguaaacuaguucaaccauuguggaagacaguguggcaacuccucaaggaccuagaacuagaaauaccauuugacccagcaaucccauuacuggguaucuacccaaaggauuauaaaucaugcuacuguaaagacacaugcacauguauguuuauugcagcacuauucacaauagcaaagacuuggaaccaacccaaauguucaucagugauagaccggauuaagaaaauguggcacauauacaccacggaauacuaugcagccauaaaaaaggauggcuucaaagcuucaaaggacaggaugacucucuuguuaaaggauaaugaagcuagugacuuuaaguuuaagccauuauuaauugaccauucugaaaauccuagggccuuuaagaauuauguuaaaucugcucugccugugcucuauaaauggaacaaaaaaggcuggaugaccauaaaucuguuuacaguaagguuuacugaauauuuuaagcccacuguugaugucugcuucucagaaaaaaaaaauuccuuccaaaauauuacuguccauugacaaugcaccuagucauccaagagcucugaugaagauauacaagaagauaaauguuuucaugccugcuaauacaacauccauucugcagucuauggaucaaggagugcuacgguuuggauauuugucuccuccaagccucauacugaaauuuuauccccaguguuagagguggggccaaaugggagguguuuggucaugggggcagaucccucaugcauagaucaaugaccuucuuugggggugagugaacucuuacucuauucguucccaugagagcgguuguuaaaaagaggcuagcaccggccucucuauacuuugcuuccucucccaccaugugaucucugcacacucuggcuccccuucaccuuccuccaagaguggaagcagccugaaacccucgccagaugcccaaucuugagcuuucaagccaucagaauugugagccaaauaaacuuucuuucuuuauaaauuucccugucucugguauuccuuuauagcaacacaaaacaaaguaauuuugacuuucaagucucauuuaagaaauacauuuaauaaggcuauagcuaucauacauaaugauuuuucuguuggaccugggcaaaguaaauugaaagccuucuggacaaaaauuaccauucuaggugccauuaagaacauucaugauucaugggaggaggucaaaauaccaauauuaacaggaguuuggaagaaguugacuccaacccucaugaaugacuuggaggggcucaagacuucaguggagaaagugacuacagaagugauggaaacagcaggagaacuagaauuaguaguggagccugaagaugugaaugaauggcugcaaucucaugaugaaacuugaacagcuguggaguugcuucuuauggaugaacagagaaagugguuucuugagauggaaucuacucuuggggaagauacugugaacauuguugaaaugacagcaaaggauuuagaauauuauguaaacuugcucaaugaaacagcaggagugcuggaggaggauugacuccaauuuugaaagaaguucuacuguuaguaaaauguuaucaaacagcaccacaugcuacagagaaaucugucacgaaaggaagagucauucaaugugguaaacaucauuguugucuucuuuuaauaaauugccacagccacuccaaccuucagcaaccaacuccugauaagucagcaacauaaacaucaaggcaagacucuccaccaacaaaaagaguaccacucacugaagguucagaugacuguuagcauuuuuuuagcaauaaaguauuuuuaauuaaggugcauuuuuuuaaacauaaugcuauuguacacuuaauagauacaguauaguguaaacauaacuuuuauaugcacugggaaaccaaaaauucauacuacucuuuuaaucacguuacuuccuuuguagcggucuggaacaaaacuugcaauaacuuuaaaguaugucuguacuacagugaguaagauuuuagagagaaaauauaugaucaguaaagcuaaaaagaagucaggaaaacuccaggaagccuucggauacaugaaggaauaucuaauggguggcaguucuugacuaaugggaaaacauuuguaccccuaaagagaaaauguaucugagaaguguacaucuucucucaugaaaaaggacaucucuaauuguucagaguucaugcccagagauacacugggggacuaguuugggauaagugggagccaagaguuuucaggaaaagguuaaaugucaucaagguccaaggagucauacgggacaucacuaaaaggaggcugaaaugcuauagaaagcaugguaggaagaaaaggagaggggcucuuucaaaaaggcaagggaacugggcacacucagccaccaaccaguugugcaacaugagcacauuccuucccaccucaggacuucaauguuucuaucacucauacacugcugaaauuuggaaagaaauuuggaaauucuacuuuuaggaauugauccuaaagaaacugucaaagaugugaaaugagauuaauccacagaaguuauaauauaauuauauauuuggaaaauaacuugcaaauguuuuugaaaaauaauuuggaaaguaacuggaaguuucucaaauguuucccaaaaggaaaugguuaaauagacauaugguacauguucaaaugauggaauauuauaugcagccauuaaaagaucauaugguaaaagccauucaauugucacgacaaacuguaaaguaaaauugaggauuacaauugguaugcauaacauggauccaaauuuguagaaaauaaauacuaaaaaacaauaaaaaguaagccaaagagagggaacaagagaaagacuaaaaagucauaugacagaguuaugaguaguaaacuuacacaaauuuuuauuuucuuauuuauucuuuauauauuuuaaauuuuguuauaaacuuguauuauuuuuguaauuaaaacagcaaaugcaauugauuucauuuuaauuaagagauuugaggauauuuaagucucuucuagcacuaaaauccacugagucuuuuuaaaaugccaaaugcauagauaccuacaccacauuugaaaugugaucuucuacuccuccccagcccuaauccuccauuaguuuugcaaacagaucugcucucugaagccauaaggcaguucugggaagaguaacaguagguaggggccuggaguuugggcugucuucacaaugugaaucuuagagcaagcuuuuugagaaaaacacaauugaaaaagaccauacuuccuggcccugaaaggccucuggcuuuucuuucacagaaaaugucugcagucuggauggacaucagcaccaggaaguuacacaccucucuguaaauauuuccaucccuaaaagacuuccucuaccugugaaaucuuuacuaacaacuuucaacauucacugugccaaaugccagggucaauucucaguuucaucuuauuuuacccaugagcagcauuagacccaguuagacccaguugaaacacuuuucuccgauggcucccaggacaccauacucaccuaccuaguuuauccuccuucccccacuccaacacacacacacacacacacacacacacucacucacucacucucucucucucucucaaucuucuuggacgguuucucuuccuauccccaaccuuuaaaguuggagcauccggcucaguccuuagagcauugucguuuuuuuuuuuuucuaguuacacucacuuacccagucucauuggauuuaaauccugucucacucaguuuaaacaccaucugaugaccuaaauuuguaucucaaguccagucuucuuccccaaacuccaaauuuguauauccaucugcucuauuugaaagacccaugucaaauaggcaucggaacauuaacacacccaaaaccgagauccugaucuucccacucaaaacuauuccuccuacagucuucucaucucaaggcaacuccauccuucuaguuucuuggaaggcccaaaaccuuggagucaaguuuccuccucucuuguuucccaucuaaauccaacuaggagauuuuauuggcucuauuagaucccaaauccaaucacuuuucaccguguccacugcuacuaccuggaaauggacaccaucaucuuuuaccuguauuacugcaguagucucccgacuagucucucugcuuauaucccuuuaugucuguucucuacaaugcagccagagugauccuauuaaaacgugaauuggauaaagucacuccugugcucaacacucacagugguuucccauugcucuauaaguaaaagccaaaggcuauacaguggccugcaggaugcuagacauucuauuuaggccaaaccuaccucucagcucucaccuccuugcuuucuccacuccaaccacacuggauucuuuguuguuucuuaaacacuuaauuucuccucaggacuuuguacauguugguuccucugcguggaauguucuucacagaaacagccacacuagcagccauaugcuaccacaagucuaaagagaucuuagaaaugauauccaaaaaaaggcugaggaaaacugcuaagcaguggaacaggagcucacucccuaauucaacagagguuugcucucaguggggaaggagcaaaggcuccuuccugaaugccuuuaugccucuggacaaccauauugacagaacucugacagcccuagucacucuaucuucuggaacaugacuacuguacauggcgagacuuuugccuucuuuccugggucugagugaacuuuucugccuggaggauuuagaugucuucucauacuuagauggggaucuagcauuuggugauugcauuuuuccaagaccugaacagaaccuaagggagccaugggcagacuaugcauuccauccauaucaacguuagacugggauaaaucuccccuaauacauccuuaaauacuuuuuaggauaaggugaaaaacacauucauccauacauacauacaaaaggaaucucuuuucuuucaaggauaaggccuuagauuaaauaaauuuugcaagaaaauagaaagaacaaugaaggaaaagcuugccucuaaaauagauaugaagcaggaauagauggaaaucguuuguuuuuuugaacucuguacaagaggauguugccauaaacaagcuaaaauaaaagauuucauggaagccaaaaacacuguaacugaaugaaaguuuauaugggagauaguuaaggaaaauugaaucagugauauagaggaaauucuuaggaaaauagucucagaaugcaaugaaaaauaaaugaagaaaaugaaaggaauaaagaaggaaggagaaagaaagagagagagaaagaaagaaaaaagaaaagaaagaaagaagaaagagagggaaagagaaagaaagagggaaggaggcaggcaggcaggccacaggcaggcaauuuagagauaagagauccaaauaggucccugaagaagaaaaaaacaaacaaacaaaacagcagcauuaaucaaaguugugacagaagaaaucuuucuugcuccuaaauaaguccuaaauuuggaaaucaagaggguuuaccauaucccaggcaaaaauuuuugaaaggaagucuauacccaguuaucuuauugugaaaguuguaaauuucagaaauggggaacaaaaaccauucaggcuaaaaaacaguuguccucaacuucugagucuguuuugugcugcuacaacagacugagucauuuauaaacaacagaaguuuauuuggcucacaguucuggaggcugggaaguuccagaucaaggggccagcaucuggcaagggccuucuugcugugucaucccauggcagaaagcaaagggcaagagagcauaagagcaagagaacaaacucacagcuucaaguccuuuuauuauuggcauugauccauucaucaggguggagcccucaugacccaagcaccuccaguaggucuugccucccaacauuguuauacuggggauuaaguuuugaacauaugcuuuuggggggacauauucaaacuauagcaacuucuuuacagcaucaaacuucucaagacaauggaggaauauuuccaaugacuugagggggaaagauugcuauauuuaagagaaguugucucucuuuuauaacacugauccccuuucuaaaaauuaauaugcuuacuagaucauuaugaaaggaaucaagauuagggucccaagaauggggaaaggcauagugagauaagaacuauauuaaaauucauuaaauucauggauggaugaauuugauuauuaauauccaaauaaagagaaaaaauccugugaaauaagugacuaacauaauuuuuacuauuugaauuuauaauauuaucaaauuaaauauuuaaaauaagaaaaaggaggacacagggacacaaaaacucuuaauccuucucucauaauggggucaaaaauuacuaauuucacuuugauauuaagauaaauuuaagcucaggaauguuuugcuuuccuuuuuucuuucuuuuuuuuuuuuuuuuuuugagauggagucucgcucugucucccaggcuggagugcagugguaugaucucggcucacugaagcucugccucccagguucacaccauucuccugccucagccucccgaguagcugggacuauaggcgcccaccaccacgcccggcuaauuuuuuuuguauuuuuaguagagaugggguuucaccauguuagccaggauggaaugcuuuucuuuuauuuccacagccugggcaacauaacaagacccuguuucuacaaaaaauaaaaaaucagcuggguaugguggugcacgccuguagcccuagcuacucagaaggcugaggcaggaggaucaccugagcccaggaguucaagguuacauugagcuaugauuaugcuacugcacuccagccuaggugacagagcaagacccugccucaaaaaaaaaaaaaagauugcuacaaguacaauuaaaaguaagauguccguuauucacagcuuuguggaaauauaaaaacaaauaacaaaguccagagucuguauagcaaaaagcauaacagaaaaaaacauuaaacacuaaagagaauaaaaugagaaaaggcagauaaaauaaaugugaacuguuuacauuccuuuauuaaaacagagaaucaaauuggauuuagaaagauuaaaaauaaagauggacaaaauauaucagccaaaugagaagggggaacagaauuuaggacuaaaaaaguagauaaaaagaguuauuucaauauuuuaucaaaauaugaacugcaaaaacauacaaaauaugaguagagguaaauagacaacagacaauuguauugaauuaaaugaaucuuaauugcauuaagagcaugaagucauuauuauuugaagcacuguuagagaaucuaagaacuuaugaggaauauaguauugagcguaauugagguuaaaaguaaaucuaugauaacaauuguuugaccaauuaacaaaauuugauuauggacuacaauugaaaguauucuaucaguguuagauuuccugaguuugacuacuguacugugguuauauaagagaaaaucuuuguucuuaggaaauacauacugaaauauuuagggguaaaggaacauaauauauacaacuuauucucaaaugguucaggaacaauacuauaugugacuguugugugugggagagauauaaaagggaagagagaaugauaaauguggcagaauuuuuuaaauuggugaauacuugugaaaugcucuuugaauuguucuuguaacuuuucuguaauuuugaagucauuuuaaaauaaaaaaauuaauacaacaacaaaaaaaguaaaucuaugauaacaaaccaaaaaugaaauuuuaaaacaauuauauuuauaauagcaucaaaaagaaaaucauacuuaggaacaaauuuaacaaaagaaauacaaaaguuacacucugaaaacuacaaaauauuacuuaaggaaauuaaguaagaccuacauacacagaaagacaucauauguucauggauuagaagauuuaauauuuuuaagauggcaauauucucuaaauagauuuacaguugaugcaaucuuaucaaaaucucagcuggcuuccuugcagaaguugacaaccugaucuuaaaauucauauggaaguuaaugggacccauaauaccccaaacaauauuuaaaaaauaaaaugaaauuggaggacucacacugccugauuucaaaacuuacuaccaagcuguaguaucaagaaauguggaauugacauagggcuagauauauaaagaaauggaauauaacugagagucuagaaaaaaacgcucacacuuaugggaaauugauuuucaacagggugccaaaacaauucacuggagaaaauaauaaucuuuucaacaaauggugcuggaacaacuagauauucacacacaaaaacaugaaguuuggccccuaccucauaacauauacaaaaacuaacucaaaguggauuaaaaaccuaaaugcaagggcuaaaacuauguagcucuuugaagaaaauauagauguauaucuucaugacuuuggauuaggcaauaguuucuuagauaggacaacaaaaccauaagaaccaaagaaacuauagauugaauaucaucaaaauuuaaaacuuuuaaauuuugugcugcaaacaacacuaucaagaaagugaaaagacaacccacagaaugggagaaaauuuuuggaaaucauauaucugaaaagggaauauauaaggaaucauugcaacucaaucauaaaaagguaaacccauuuaaaaaaugggcaaagaggccaggcgugguggcucacgccuguaaucccagcacuuugggaggccgaggcagguggaucaccugaggucaggaguucgagaccagccuggccaacauggugaaagcccgucucuacuaaaaauacaaaauuagccgggugugguggcacaugccuguaaucccagcuacuccggaggcugaggcaggagaacugcuugaacucaggagguggagguugcagugagccaaaaucacgccaucacacuccagccugggcaacaagagcaaaacuccaccucaaaaaaaaaaaaaaaaaaaaaugggcaaaggaucugaacaggcauuuuuccaaaaaagauccacaaaugcccacuaaacacaugaauagauuuucaaaaccaucagccaucagggaaauacaaaucaaaaccucaaugagauacuacuucacacucauuaggaaggcuauaauaaaagauagggaauaaaaaguguuggcaaggauguggagaaauuggaaucaccauauauugcugguggaaauguaaaugguccagcuacuuuggaaaacagucuggcaguucaucaaaugguuaaacauagacauacaagugacccagcaauuuugcuccuagguauauaaccaaaagaaauuaaaaacaaguccacaccaacacuuguccaugaaugcucacagcagcauuauucauaaugucaaaaaguaaaaacaauccaaauauucaucaacugaugaauaaaaugugguauauacauucaaugggauauaugcuaugaaaugaauguccagaauuggcaaaacuguggggacagaaaguagauugguguuuuccuaggacucagaacggugggggccauguagggaggaaauggggagugcccauuaauagguaugagguuucuuuucagggugauaaaauguuccaaaauugauugugguggugguacacaauccugugaauauacuaaaaccacugaauugucgacuuuaaguuggugaaucguaugauaugugaauugugucuccagauaauaagaucaacaacuauggauuugaaucucaacuucaacacuuaccaacugagagacuuuaacaauugaguuauuuaacaguaaauaauaccaaccuccuuggaugguuggagaacugaauuaacaucuguaaggugauuagaauagugugcgaaccaauguccacuauaagccuguguguuaacuaacuaaagccaccagcacuuccuuucauuaaacacuuaccguauucguuuucuuugccugcuauaacaaauuaccauaaaaaaacucagugguuuaaaacaagacacauuuauucucuuacaguucuggaagucugaaggcugaaaucaguuucacuggacugaaaucaagguguugguaggacuaagcuccucucuacccaucagagaauauuaugguuggagauaaauuaccauauaauugaaaagacuggauugauuaauaaauauccaauuuuauauccuaaaaacauacagcuucuucacaaguguucauagauuuacacaaacccaucauaugcuuaguuacaaggaaaccucagaaauuauaaagccauauucucuaaccaucauggaaaaaaugaaaaauuaauuauaauggcaaacaaaaauaaaaaucauuuacaaucuuuuagaaguaauauucugggcuacagagaauaaaaaugugaugucaaacuauuuagaaaacgaugacaccacauauaaaaauguguuggaucuauucacaguaagaacagauucagaaaaacuaucagaggccgggugugguggcucacaccuguaaucccagcauuuugggaggccuaggcaggcagaucacuugaguccaggaguuugagaccagccugggcaacauggugaaaccccgucauaacaaaaauaaauaaauaaauaaauaaauacagaaaaacuauuauaaguauggcaggaaaacuugaauacuuuuauaugauaaagcaugcacauaaguugauuaaaaacaucaaauccaaauaaguauuauaauaaacaggaaaaggauguaaaaaguauacaaaagaaguauaucgugaaaaaugucaaauuuacuguaauuaagaaauacaaacuaaaacaaucuaaaaauugauaaaauuauuuaaaaacaaaaacaccaaagcugucagggaugccacaaaacaggaacugcuuuugagagcaugaagggcccaaccuuugggaaugcaaccuggcaacaguaaucaagaacuuuaaaaaacauuaacaaguuucaaucuaguaagucuauuucugggauccuguccucagagugcaauccuacauauggaaaaaacuuccugcacaaagacauuuauuggaaauggaaacauccucaauauucaauaacaggagaacuguuaaauaaacuaugugacuauaaaaauuacgcuaacaaagaccacgcuauaaaauggaaaauacaugugcuucacugcuacaguaaaaccaggcuuuaaaacugcauauauagccuaaugaucauggugccaucucauaacuuuucaagguccuauucaagugaaugccaaaugagagaaacaacccaggcauaguaaaaaaaaaaaaaaaaaacugccaggaaauggcaccaaaauauuacaagugauuguuuuucuucccuacuguaaucuauaguaucauguuuucuuuaaugggcaugugcuauguuacuuguauccucacggacauaaagcaaugcuuuacauccuuccuaugaaucaaaaggaaacacuucuuuuuuuuuuuuuuuuuugcuucuuuuuaaauuuuuuuaaaccaagcagugguuauggaaggaaacaccucuuuguguaacagggcauguacugccacugucggucucuaaagucacuuugaugaucuaacaaaaacagcauguuucauacauguuagacaaccucuacucuggauuuuuuucuccaacaacuuauuuucucuucacaacccccucaaguuuucaagccuaaagaaauuccaucgguucucucugcacccacuuuccuugcuuugcuccuagaauuauucccaccuuucuucugcagagcguagacaaugccucaggcacacuguugccagucucagagcccugagucccugcuaccucuagcucccugggacuccaacacccagcacaagauucugcaggcagccacacauucugcuccaguacuucucaaguugaaggcagagaauaagggaaguuuagggaagcuuggagccauggagaaaagguggagacaugcaggaaaucuaacacaaggccuuuuuguguaacaguaguuuuugugugcugaagauuccaguuucuaggauuuggcaaauugggagccucaauuuccuguucuagggcauauauuugcugaaugaauaaaugaauuaggcuucccaucauccugcaaugacaccugaccagugacuagaaguggcagcuuggugagggaguagagggugggaagagcuuggucauuuaguaccaaaauaagcccugagacuaaggcaugcgaugacccugccacauugccagucaaaguguggucuguggaggggcagcauuaucaucgccugggaacuuguuagaaauguagaccuacuucagagcuauuggaucagaaucugcauuuuuaacaaguucucuaaugauacauacucaugcuaaaguuugagaagcacugcuucagaacauaugcacacacacaccaaaaucaccaagacaaacaagugacuccacucuugcacacuucaccaaaccaucaagacauuuagugauucuucaccacaggggcugcccuugauuuuggccuuccuccgaaguacuuaaaagaauagacucuauggcugggcgcgguggcucacgccuguaaucccagcacucugggaggccgagacgggcggaucaugaggucaggagaucgagaccauccuggcuaacacagugaaaccccgucucuacuaaaaauuacaaaaaauuagccggguguaguggcaggcgccuguagucccagcuacucgggaggcugaggcaggagaauggcgugaaccugggaggcggagcuugcagugagcugagaucgcgccacugcacuccagccugggcgacaaagcgagacuccgucucaaaaaaaaaaaaaaaaaaaaaaaaaaaaaaaaagaauaaacucuauguaauuuacuccaggccucaccuucacucuacacagauggagcccaucaccucuggacaguaguuggugcgauuaaacacuagugcccuucagcaccauuaccaguuauaaagagcggagaaacaaccaaaaagacaacacaagagggaaagcacucucaaaaugcaauuugaccaaguaaaggcaauaccaaucacaaugauuuauaaaaacuguuuaccagauguauguuauuaccccgcagugcaaucaugauuaaggaaaucauuuaaugugcagcugauugcuuuguaaaggcuuauuugauuacacgacccauagugaaggauaaacucuguacuucugccuucaaaucuccaagauggacauguaaguagguugacugcucagagcuugggaaaaaagggggcuuuuuacucuuaaaucuacacuauaguuaagguaaaagagagaaaagaucuucaagcacugcugggagggugaaggggcuugccaugggcaccagauucuacucaucuuucuagauccaacugaaguguccuauccuuugagaaguuucuccagaagccaucgcucccuauucugcuucucauggcacuuucucuuguauuauuauuuuuuauuuuuauuuuguuagagacaaagucucaucauguugcccaggcuggagugcagugguuauucacaggugcaaauauagcacauuacagccucaaacuccugggcccaagcuauccuccugccucaaccuccugaguagcuggaacuacaagcgugcaccacugugucauggcacuuuguuuagacuuacauuacagcucuugaggagguagaacguauccauuaggaucccagacuuugcagccuaaccacaucagucaaaauuuccccucugccuauuauuagcuguguggccuuaaccaaaugaccuccuuccacagcuggaagaugcagaaaccaauaucauggaauuuuuguaaagauuacaugagacaacacacauuacaauguuuggcacauaauaaaugaucaauguuagcuauuauuauuagcacuucccagcuauuauuauuaggcuuccccacuagaccgugagcaaacuguuuauccaaggaucuguguggcaugggaacuuacaaaugguagacacacaauaauauuugucaaaaugguuugaagguaugccaggaagaggaaagggagggugcuggaaaaaaccauagcguacuuuaugauuuuucccagggccaacuucuguaguguuuguuuuuauuucauuaccagaguacauuaucucagacagcaagguugcuauaaaguagggcuagaaagacacuauuuauggaaccagauguucuguucagagaaagcaaaguuggcuaugaggcaucugaaaucuccaguuuggcccuuggcugagcagggaguaggggcugaaguucagccagagcuucacuugcccaacagggugcccuggcaugggguuacauuagcucugaaaaucauccacccagagggaugcauuuuguuuuucaguguauccacauagagggacgucuuuacagauugugccaaagaucuauauguaccaguggggaacccuacugcaaacucaaagguccccuuuuaaacaagccucuugaaggucucaaaugagcaucagcuaaaauaauaauacuucacuuacuaaauauuuauugaguucccauuagggaacucaaggugcuaauggcugacaaggaccuuuuggacuugcacaagagccugguguguaccaccuucuaaggaaagcuugggauguucucugagaggaacaccaaauucaagaaccugucccaggggcugaugaauguggcugccaagcugacccacaauaaguacgucagaggaccucacagaccucauggagaaggucauugaaaccugacaccuuaaccauugguugcugaaugacaugugcucuuccugaaucaguacucagcauauguccacuuccugcguggcuucuggcccucuaugacugcuauauggucauccucuguggcuaccuccuguaccccuaucaugacugaggccccucucccaccacucugcccacacugaugagaaaguugccacaaguuuagagacuaaaaauaaaauugcacuagacacugcagaucuaaaggugaauacagaaaauauaauuggaagggagagaaggugaugcagagggcaggagcauggacaaguaugaugagugccaccuuaggcauaacugaugagguacuauagaagcauccaagaugggggcuaaucuagacuugaaggauuagagaaggcuuaaaggggaauaacacccaauaugaggcuucaagcagugauagcaaauguuaauauuuauuuagcaauacuauauaucaggcccuguucuaaaaacuuugcaugaaucccucauucaguccuuaccacaacccuguaagauagauguuacuguuauucucuucauguuacagaugaugaaacuaaggcacacaguaaaugguggagcugaaauucaaacccaggcagcucggcuccagacuaaaggggaagcagaguaccagauaggcccuuaaaacagaagaaagugccuagcuucagucugaggaaagaugcaguuccuuuggggaacugaaagcaacucaaugaggcgcagcuugggguggggacagacguucagagaugacugggucugcucuguagguuggaagaaaaaccagaagcagaggguuucagauccaguccaaaucuuuuuuuuuuuuuuuuuuuuuuuuuuuugagacagugucucacucucgcccaggcuggagugcaguggugcaaccucagcucacugcaaccucugccucccggguucaggugauucuccuaccucagccuuccaaguggcugggacuacaggcgcacaccaccacacccagcuaauuuuuguauuuuuaguagagacaggguuucaucauguuggccaggccggucucgaacuccugaccucaggugauccgcccaccucggccucccaaagugcugggauuacaggugcgagccaccacauccagccccccaguccagacuuuugacaacuagcugugacuggugucaccaaacuaaccccuucugaccucaguuucuccuuuuugcaaaagaccauaauaacaauaccugcuucucauagagaauggccaugagcaccaaaugaggaaaauguaugugaacuugagugcaaaguacaaauuccuucacagacuuaagauuuuaccaguaucacuuccccaguagcuucaaggauuugcaaaccugaaauccacaaugucagggcaccagaaaaagcagagaaacaguauuggggaguggaaaagcccaccagcccugccucagaccaccuccauccacacucagcccuuacuaacuaugagaucucaaggcaaguuauccucucaguaccucaauuaugccaucuggaaaaugggaaugucaaugauagcacuuguaagguucaugugacaaguaaguagcacauguaauaugcuagguauagcucccaacacagaauaaagacuuagucaacauuaacagcuaucauuauuguaaguauuaagaaauauguuggcuacucaugcuauucuuccauguucuauacgguauaagcaugugggaauguuagaaguuagagaugauaaagaaggaggagaaggagguuuacaacccuauacucccucacugcugcagagauucuuccuggcucucacacgcuggcaagcagcuggcucuccgucuuggcagaaaaugcccaaaagagguaaaagauagagacugcacaccaucugugcaaaccaggcugcucuuguaguuuuuagacaaaaucuaaauguagucagaugugaccugcccuuuuaagauagaauuauucuauuuccucccucuacccguccccgucccccacucugucccccacauaaaacucccccacauaucucaagaaacuuucagcauuuugaaagacauacucugggguccuguugugacagccuugugccacauuaacuucucugucuuguucccagcaaagaagccuuugcuaauuucacaacaggaaagcaugcaagaaauucgagaacaaaacaaaucuacacgcagagcccagcaucuucaagcaaacacccugagguacagacccgaggcuagaugaguccggacugcagaugaggcagcugccucuuaaacugcaaggggacugaaaaagucauuugccucuaaaaaaaccaacucugaauacaaauugauaaugaauauucaugagccccuccagcuugcucuagagccacccuugacugcaacccuggacucugcuuccuaaaaaguuucccaaagcucuuucucugccuccucucagaaggaagagggugggaaaguucauucagggcuuuuugccuccagcuuucaaguacuugcuuuuuggucugggcuuuuauuuuuccuucuauuuuuuuuuucuuaaggauucagaucaaaucaauuuuggucuuacccuuuguaucuuccauaaguagcagcuuuuguuuuccuccucuuuccucgucuuucccccccccagccucugcuugcugugguccgucuccgugagagagguccucaaggaaacagagauauaacagacccuugggcucgugggaggggcuaaauuagccggccccguuucggaaggaaccucaaacccugucuuuuucauugacuagaaaggacagauugacugaggaguccagcagcucauuuuccuaaaguuacucgaagccuuuuccagguuguaauuuuuugcauccuugaagcaauguauauucaaaucucucucucuuucucccuucuucccucucucccuuacucccucccucuucaucucucucucccucucuucguuauagaaaucccuuuuucucccuugaaaaagucaucucagcugcaagcaaaaaaagcuauuccuuacugcaauuaugaagcuagauaauaagaaaguuguuaccuugaaacccgcucgaaaaacugaaagucaagaacaguucuucccuccccauaaagccucuggucccaugaccagcaauccuuucucaaggcucauuagagcaaagagcaacaggugacccaagcgaugaguuuccugcaggagacgcugcguuauugguuggaaggcuggguggaaccacagaggagcugcucaaugggaaccgcugccuggcuaugaauugaugaaagucauccaccauuucccaacuuugacuuccuaccuuugaagucuaaugagcaugaauuaccacauccagaccgucaagauuaccccaauguagaugagagccugaccaaauuauuuuuaaacuguguaacaaaauuauuuugaaaucaaaacaagggcuaauccuuugaaaggaagguaaguccucaagucccaaggcgacuuggcagcuucucccuccacaaggcuguugcaaaccuuagcauuucaggucugaaagauaccucagacauugagucuaaaagagguuagagauguggagagguuaagccaccugcucaugcucacauacauggucucucuuauuugcuaccauguuccccagcaccuaauacaguuucucucacagcaugggcucucaauaaauauuugaugaaugguugaaaaaaaugaaugaauugcagcaaagcagaaauguagaucuguuuuccuguuuccuaguucuugauuuuucuacauugcuugucuggcauguaaauuuguaucuaaagccaguuauaccauauaaaucauuaaauuugugagcccgaaggacuguuuugacucuauguagaaacuauauucuccagcgagcuuucagucauacuuuaauaaggacaaaggauaaccuuuuaguuuaggcaucucuguuacuuugcacggugccacaugguauauacucaauacauuuuuuauacuuuaauaaauuuggagcuguuuaacaauacuuuauuucugaaaugcuuuauaguuauaggauuuugcauguaugauaacaacuaauuacacugaaugaaagacucaauggaugucuucucccgagucaguuuagacuacaucucuaauaaugaauauuggucugauauucauccuguuaugauaaaacugguuuuuggugauaugaugggauuuuuuguaaaaaccaacaauugguuuaugacugccuuuguacuauuguuuuggagagaaauuugaaaagagcauguccacaaaauagugugcgaauuacagaauggaaaccaaaacaucaaagcuagaaagagaaaagaaugaucaaagggaagauccagaguggcugagggguaggcaggagaaacagacaaacaaguaccugagcuugucaaugagagacacacuuuggugggugcuguggcaacgguucucuacuuuauuacauuaggauauuagguucuuuuuuuuuuuuuuuuuuugagacaagaguuuuacucuugucucccaggcuggagugcaauggagccaucucagcuuacugcacccucugccucccggguucaagugauucuccugccucugccuccaaguagcugggauuacaggcgcccgccaccuugcccagcuaauuuguguauuuuuaguagagaugggguuucaccauguuggucaggcuggucucgaacuccugaccucaggugauccgcccgccucagccucccaaagugcugggauuacaggcgugagccaccaugccuggccuauuuuacuacguucuuacauucuuuuuuuugagacagagccucacucugucauccaggcuggagugcaguggcgugaucuuggcucacugcaaccucugccucccagguucaagugauucuugugccucagccucccgcguaacugggauuauagaugcgcaccacuaagccuggcuaauuuuuguauuuuuaguagagauuggguuucaccauguuguccaggcuggucucaaacuccuggccucaagugauccgcuugccuuggccucccaaagugcuaggauuacaggugugagccacagugccuagccacaguucucuauuuuaaacaaaauuaaaauucaaggucacuucagucauguuguaucagacguugucgacaaaagguuacuuugacaauugucucauucucuuuacauuucaucagggagagaaagaguuaguaaaaaguaaauuguucuaguacccaacuucugguuuaaccaggagagguaaaaucucauuauaguaacuagcacuucauaaauauuugaaguucauccaaacugaauauggaguaauagaaacauaguuuuaaccccuaauucauauuacaugagccuuuugacaacauuuaaugcuuuuuaugguaauaugcucugugcuacaauuuaaucacguuguccagguucgcacccuccucagcaucaugaaaauacuaugguuaaguauauauuaucaccaauucauacaagaauaauuauaaaagagaugggaguuuguguguaucuuucuaaaggccucagaauuuaucuuaaaaaauaaaucgucuuucucaacaaaaaauuaucaucaauuuuauuguuuuuuuuuguaauagaaaguagaaaauuaaaacugcacucagaaagauggaaggaguugucagaaagggguaaagauauuugucugucuuuuaaugaugaaauggucuuauaaaguucuuagaaugguagaauuuucauuuuuccuacaccuucauccucuuucacuguaccgguucaucccccuaugcauauaaaauauuuaagugauucucauucuuaaaaacaaauucuguuguuuaaugguaugaauuauuaguguugcaagaugaauaaauucuugagauuggcagcacaacaaugugaauguacuuaaaaauacuuaaguauacuguuaaaaaugauuaauaugggccaggugcauuggcucaccguguaaccccagcauuuugggaggcugaagcaguagguugucuggaggccuggaguuugagaccagccuaggcaacauaacaagaccccaucucuacaaaaauaaaaauaaauuuuaaaugauuaauaugguaacuuuuuuuuugagacagaguuucgcucuuauugcccaggcuggagugcaaugucgcgaucucagcaucucggcucaccgcaaccccugccuccugggugcaagugauucuccugccucagccucccgaguagcugggauuacaggcaugcaccaccacacccagcuaauuuuguguuuuuaguagagacaggguuucuccauguuggucaggcggcuggucucgaacuccugaccucaggugaucugcccaccucggccucccaaagugcugggauuacaggcgugagacacugggcccagcaauauaguaacuuuuaugucuauuuuaucacaauuuuuaaaaaauuaauuaaaacaaaaacagcuccuucacaaacaagcuacuugagaccauggucuaccuuugccuuccuucaucaccuccauucucuccucauucauuuacuccuccuuccauugcauucccguuucucaccgcaccaugccaaugaaacugcccuaagauugccaauggccuguaaagcaaagaccaauuuuuguguuuuaucuucuuggaucuauguagcaugggccauuguuggccuuccuucuuucuugaaaauugaucucuccuuauuuuccagaaccccccucaugucugauuuuccuccuccaucuguguaugauggcuccuuuucagucaacuuuugugucuuguaaauguugguauucccuagaccuucacccuuugccuucucucccuacuucacuuauucuaccuaggucauaacuucuuaugccuuuacauuucugccaaguccacucccaugagcaccagauccauauuuccauccaccuacugggugucaagagaauaucccacaagcagcucaaacuuagcauccaaacuguacucuguaucuuuacuuccaaaucugcucccauccaguaccaguauucccuacuuuuuuuuuuuuuuuugagacgaugucucacucugucgcccaggcuggagugcaguggcacgaucuugacucacugcaaccucugccucccagguucaagcgauucuugugccuccaccuccugaguagcugggauugcaggugcacaccaccaugccuggcuaauuuuguguuaggagagacaggguuuugccaugugguccagccuggucucgaacuccugaccucaggugauaggcugccucggccucccaaaguccugggauuacaggcgugagccacugcgcccaaccccuacauuagauaauggcacuaccauccaccuagucacacaacccagcaaccucaggguccuccuagaccccuccccacaucccacaucuuauuguuuaccaaauccaauuguuucuauaccuuaagaucucucaaauucaucuccucucuccauucucgucacuucugccauagugcauacucucucaucuuucugaaaucgauaucugauaaugucauuggcagacuuuaaaaauucuagucuccuuaucaugcauaaaauaaaauuuaaauuccugucaucgaauauguaaggacucucucuaccucucuaaacucauuuccuguuauaggcuuccugcacuccaaaaacugaaucuaauuccaggacccauaauccuuauaaaacucugaauuuuuguuuuguuuuguucugagauggagucucgcucugucacccaggcuggaguccaguggugcuaucuuggcucgcugcaaccuccgccucccagguucaagcaauucuccugccucagccucccaaguagcugggacuagaggugcgugccaccauggccggcuaauuuuuguauuuuuaguggagaugggguuucaccauauuggccaggcuggucucgaacuccugaccucgugaucugcccaccuuggccucccaaagugcugggauuacaggcgugagccaccgcgccuggccacaacucugaauguauacaagcuauuacccugcucagaaugcuguuuccccucuuauccaccugguccuccuauauaucuuucaugacucaaauaucugguccccuguguuaggccauuuuugcauugcaauaaagaaauaccugagacuggguaauuuauaaagagguaauuggcucauggcucugcagucugugcaagaagcauggcaccagcaucugcuucuggugaggaccucaagaaacuuacaaucauggcagaaggugaagggggagcugguacaucacauagcaagagagggagcacgagagagaaaggggaggugccagacucuuaaacaaccagauuucaaaugaacucauuuucaccaagucauucaugagggaucugcccccaggacccaaacaccucccaccaggucccaccuccaacauuggggaucacauuucaacaugaaauuuggaagugacaaauauccaaaccacaucaucccccgugaaguuuugccugacccauccccgcuccuuucccacagacacaaacacugugcugacccacaaaagagaugccacucguguuaucauguuuuauaauuucauuaacaucucaggccuuaaaccuuggagucacauuugaauccucuuuccuuacaauccaagucuaauccuuuagcaaauucagcgguuccuaucuuccagauacauccaggaccugaccucuucuuauuacuucuacugcuaccacacugauccaagccacaucaucucucaccuguauccuguauuauugugauagccuccucacuggucuccucccagauucuacucuucaaacucuucagccuauuuucaacccagaaacuauaauaauucaguuaaaaauuaaacaaaacaaaagauuauggaacucuuuugcucaaaauuuauaaaaggcuccaucucaccccaagaaaagccaaaguccuuccaacuucccaccaggaaguuggucaccucuauuucuuuccuacuacuguccucuucuugcucccucagcucuagccuccaagucuuugcauaugcuguucuuucugccuggaaugcuguccucccgaauauccacauggcucauucccuccuucccuauagguuuuuacuaaaucauuaccuucuaucccagcaccaagauggcuauuuguaaaugcuauuuucuacuaaaauggccuaaggcccuuuggaaaaauagcuaaccaagucuggggcaggagguauaccagaaagcaaggacacuaucuaaaauuacuaggguugugucaaaaggauucaggagcuaacuuuaaguggcuccuacuggccaaaguauaagaaaagaagacauuugagcagcaauaaaaagaauaacugcaauggauugaaauguaucagauauauugagauccacauagucauaaugacccuaugaagaaaucacuguucaccuuuagaacgaauucauuauugugaaaacacacaagggggauaauagcaacacucaaccucccuuugcugcacaaaauguaccccaggacaacaaaaucauugauggggaaaagugucuuuaaaguauuccagauaaugaaagacuaaaauugguagcauuuggguaucaccaucuugcaauaccucacaaaggaaugaacauaaacaauaaucaucaaugacuguucacauaacaaaaggggguauaaacauucauucucugccuucugauggaagcacacaucacauccucugaagcugucuucccaaaaauggaagcuucuaaaccuaauaccaguuuguggggaaaagagggcacggauaaacacguuaaaaaaauacaacaggaaugcaaucaguaaaauccaguuuguaggagacuagacuaaaacaaucaauaaaacaacucaacuucuugaacaaauaaacugcagagaagaaaaaagagaaugaguuaccuauaaauuaaaagagauuuaaaagauauaccaauaaaauuaauaccaggaccuugaaauucugauucaaaccaauguaaaagaaacuuaaagaaaaucaaagaaauuugaaaacugacuagauauuuuauaauauuauagaacuguuaacuuuuaagguaugauaguaguauuguggcuauaauuuuuccaaagcccuuaucugcuggagacacacacagaaauauguacagaugaaaucugagauuaguuucaaaaagaggaggaaugggugagguacagauaaaacaagauuagggaugacauuauaacugcugaagcuggaugguauauggggauauguuuuauuauucucucuacuuucuauguuugaaauuuuuugcaauaaaaggcaaaaaagaauccuggugaaaaagugggagauuauuugaugauaugcagugguuauaugggguauuauuacuguuauuuaagaaauguaacugaauauuuccugagucaguagacauaugcaaaauggacuuggguaguuaaaaauaaugcuauaauuuggcaagaugauacucacaaaauaggcuauuucacuuuaggggcaaauagaaaaaagaaauaauuugggccgggugcgguggcucacgccuguaaucccagcacuuugggaggccgaggugggcggaucacgaggucaggagaucaaggccacccgggcuaacacagugaaauuccgucucuacuaaaaauacaaaaaaaauuagccgggcaugguggcgcaugccuguaaucccagcuacuugggaggcugaggugacagaauggugugaauccaggaggcagagcuugcagugagccgagauggugccacugcacuccagccugggcgacagagcgagacuccacuucaaaaaaaaaaaaaaucauuugccagaaaaauauaaguaauugaacaauaaacugaucaaagccaaaaaaaacuguuaaaccaguguaagcaagaaaaguauauucaccaugcaauuugucuguuguguaauaaucaggcagcaauaucaagguuuccuuagauuucccuguggaacuuaacaucagauguagaaaucaggaaggaccauacacaauguccaauaugcaauaugcuauugugguuugaugguuuaaggcacacuccauaaacccaacagugaccaagcaggaaccacauaaauuggacuaaguaguaaugguaguuucugcaucauuaggggccagauaggggggacagaaaggacagagcuagucggauaggguggaagaugagcauucuguucucuauauuguuuccaguucuccauuaaaacagaauucuauugauaaaacucaugagaggugguacucugguuuuacguauccuaaaauaaaugcccaaaguaacuauuguaugaaaugacauguuuugccaauuccaagaaugccuguguuuauguauucaacuuuaguuauagaugaauauacgaagagguucuucauaacguaugucaaaguguucaaaauauuaugacauuugaacauuuugauuugaaucaaaauauuaugaugcucauggucaauuucaagguuaaaaggagacuguaaaauaauggauuuuuauaauugagaugccauagauaugguaaaucgcaauacuucaaaaaucuugggguaaaauguuacauguuauauggcaauuaacaaaucuaaucucaggaauucaaaauuauuuuccuaccagcaauagauccaugccccaucuuuuuuaugaucccuacaaaccaagauaauaagucaguacuauuugguguuggugaaugcauauucaacaaaccaaaguugucaacaaauuuggaaaacuguaucaaauuuucuugacacuacuugacauugugcuuugacagucuaucagcacuacauauacguguuuuaucaaaagaggaaugcugauuaaauuaauucaauugaauuuguauuucuccacuaucaauaacaaccucucuucucauuccaucugcuuacuuacagauauccagagaugaaaaggacacuguggugcaggguaggaggagcagagaaaaagggauggaucugaaaguguuccaagaguauuuagaaugcacacucguucaaaaaaugccccgucccuucuuguggaaaguaguaggaguggcacugccucuuuagucagagccaugguucucaacuucagcugcacacuauaaucacuuggcccaauuauaaaaaauacuaaugcccaucccaacccucagagauuggaauuuaauugaguuugggguagguuucagccacguuuuuuuuuaaaggccaagaugauuuuagagugcugccagagcauuaagaagaucuggauucaauucuuuuuguaugaucuuagacaaguuagcgagcccuucugaaccccaauguauccauaaaauaaaggucuuuuuuuuaaucuacuucacaaagccauguuggagguaaaaaagagaauaaauaugugagaacucccaacacagacucuggcacauagguggcacucaguaagggugaguucucuuccucuucacuaugcacuaaucuauguucagauuaaacaaaacauugccuuuuguacuugugucucuugcuuuuucccccucugauaucuuccacuuauuuuucagaaguaaccuaacgguacuugaaggaaaugagagucaaaguccuuucccuucuauagcacaaagggccucuccaccccuuuucccaaaguuaagugauucuauguauucaaccagcagcugugggacugaggccauguugggagagggagugaaguaugacaugagaucacccaugucuuccuauuuccagguagucagggaggaaugcccuaacugagcuuggggaagcccuugaauguggcagaauggccaacucuuccaaagugaaagucuacaacccaacguggcagcaggagaagguaagccuagaguacacagcacagcagcuucaagcacagcagacacucaaugagaguuugcugaacugaaaugaagauccuaugcuacggcaaauaucuaacccaaugcuaguacucaaugaagucagugcuguguaggcauuaccuuaguuuuuuuagcuauaacuacuuccucucucuugccuugcaugaguggauucucuuacauaaauguucuguugaaauauccccuuuaacuccuuuauccuacucccacaucaagugccucaauuugucuaaaugucucaaaggucugcagagauaauaagugacugucacuucaucaaaaaugguaagauuggccaggugcaguggcucaaaccuguaaucccagcacuuugggaggccaauucaggaggauugcuugaggccaggagaccagccuggacaacauaauggaucucgucuuuaaaaaaugaaaauuaaaaaauuagcugggcaugguggcucaugucuauaucccaucuacuuaggaggcugaggcaagaggaucacuugagcccaggaguucaaggcugcagugagcuaugauugugccacugcacuccaaccugagaaagagagcaagaccuuauuucuaaaaauaaaaaaacauuuaaaaaaaguaagauguuauugcugcuucaaaacacaaauccaaaucugugaauugcaaguauaacugauaaaagcuauaauuucuuuaaggucaaagauacucauuuucaaacaaaguacucauuaucuaugaaagaccaaucaacuuauuagagcuccaaaacuuaaaaauauuuuuaaaaauuuaaauuuuuuaaaaaacugcuuacuuuaaagagagacaauaaauaaaugagugauuaccaaagauucaucaggguagggaaaggucgaauaaguaaagcagaggggauauuuucagauugauaaaauuuuucaguaugauacuguaaugguggauacaugacaauaugcauuugucaaaaucuacagaaauuuaaaucacaaagaaugaaccuuaacccauacaaaguuuucaaaaauuauucaggaagucaagggagcccagaaugaaauuuaaauucugacaaaauaauggaacuguauuacaaaugugugaaaaaaccucacagagggagguagaggaaaagggugcugaccuagucacuuuuuuuuuuuuuuugagacagagucuuacucugccacagaggcuggaguucaguagcaugaucuuggcucacugcaaccucugccucccugguucaagcaacucuugugccucagccucccaaguagcacaccaccaagccuggcuaauuuuuguauuuuuaguugagaugggguuucaccauguuggucaggcuggucuugaacuccuggccucaagcaauccaccugccuuggccucccaaagugcuaggauuacaggcaugaguccccacucucggccccaagucacuuuagaugugaguaaagucuacaggaccaaaggcaaaaggaacuguguaaaaguacauuacucugucucccaagauucauaauucugaaaccacuauacauguauacuggaaucagaaauuauguaaauggaugacagacaauaggagucaggcuucucacuguuagaguggaagguuauagacaaguaaggggaaauggcuagaaugauccaugugguaauggauuaacguuagagacaucaguaugaacucagguuuagcuuaauagggauacauaugaauaaauguagaacuauuuauaguugugcauauauauauauauauauauauauauauauauauauaugguuuaaaauacaucuauauuuucuugcucugucagcagagugggccuauaagcaaugauacugcaguagcaauaagcacaucuaacccccagauuuuuguuucuauaaccguucuccaguaaaaggaaccagaauuccccugauaaauaggugacucuaggcuggggacaggaaauauuacaagacaauccuggaguaucuuauggggccagaaaguaauuaagaaaaaaaaagcuuacaaugauggggugugucaaagugacacaggagccaauagagcuuccaauagccaaaauuagaauaauuugaacaauaaaauagaaccauauucaaagauaauccaaaguauaaaauaaauauccacgagucuauacugaaauagacuauuaguguauuuaugaaauagaauauuuaacaaaugaauuauuaaauaaacaaaugggagagaauagacaaauccauacagaagaauuucaaaugaguuacauaaauacuccacucucuaggagguaaagcauaacuccucacuccuuaaguauggccugcauagugacuucuuuccaaagagugcagcagagaaaaagaguaagaaagagugacuuuacaguggaaaaaccugacaaacacuaccucagcaaggccaucuagauuaacaucaacagugauaaaucauguugauaacacauauccuugguaugaugugaugaaaauggcacucuguggucuuccuccaaaaagugcauaacucgagccuaaucaugagaaagauaucagacaaaucccaauugaaggacauuauacaaaaauuucugaccaguauuucucaaaacugcuacggucaucaaaaauaaaaagucugagaaauucucacagccaagaggagccuaaggagucaugaagauuaaauguaauuuggaaucuuggaacagaaaagaacauuggguaaaaacuaaagaaaucugaauaaaguauggacuuuaguugauauuaagguaucaauauugguucauuuauuguaucaaauguaccacacuaauguaagauguuaauaaucagggaacuggguagagaguaccugguaacuuucuguacuaucuucauaacuuuucuguaaauugaaaacuauucuauaauuaaaagcuuauuuuaaaaaauauguuaacaguguauagauauuuaacugcagcuguuguaccggaaaccccuugugaagcccaucuuuauuaaaguaacugcuuuaaugacgacaugauuuugcaaaagcauuuguuacacaugauuucuuguucaaacagaauucauuguauccacauccagcaaagcaaaguuaacucaggcugugugccaagacacggaaauggccuuguuacauugaacucaaugugaaaacauaguaguauucaaaucuuuccauccacaacacacaauauucccauuggucuaaaaaaaaaaaaagaaaaaagaaaaagaagaagaagaagaaaaagaaaaagaaaguuucuaaguugauuuucuaguaucuuaaaaaguuuccaaauacaugucacuggagagcagucagcaacucuagggggaggacaggaaggaguagcgacugcugguugcagcacuugaaaaaaaaaauaacaaaaggaaggaaaaggccuaggcuucuccagacgggguuacccuuauuugggaacauugccagacaacuuaaaguagcucugagaugcagaaaagcuaguguuaagcaaaauuuacuacacuaaccaaccguuaagugccccagaauuguauuaauacuugccaagcaaucaagacuccaaacagcauaaaucucugucuucuacuucuggaccuugcugggccuaagagucaguggaaaguuuugaagaacacauggcccuuagacuaaugccgaugaccuuaucagcauggcccacacacccagcuuuugaggacaauaauaucccacaauaccagaacagucuacagcaggaagcuccuauguugcuguuaacgccuccgccuuugcagagaucagccaggggugacaaaucuuugagguaaugccaaaaucaggccuccuguucuccuuuacauuaggcccuucauccucugggggcagcaaagucugaagaaauaggaaaacagaaaaagauaauaguaauagcaauuuuuauacuuuugagaucauuacuuaaccuaagaugauugucucagcucauccuucagggucuggcucaaaccuugaaucuuucaagucuuccagcuaacccucucuccuccaaauucuaagagacuuucauaagugccaagcaaccugggaacugcuuaaugccucacacugcugauuuuucauauuuuauguuucuuacaggcauacuccacuugcuugugcuuggcuuuauuguguuucacagacguugcgauuuuuacaaauugaagguuuguagcgacccugcauugaacaagucuaucagugccauuauugcaguaccaugugcucacuucaugucucuguaucacaucuugguaauccuugcaauauuuaaaauuuuucauuauuauuauacuucuuaugaugaucugggaucagugauguuugauauuaaaauuguaacuguuuuggggcaccaugaaccaugcccauauaagaugaugaacuuaauugauaacugcuguuuguggucugauuguuccacucacugucugucccacuaucuccuccucuccuugggcuucccuauuccuugagacacaauauauugaaauuaggccaauuaauaaccuuacaauggccuguaaguguucaaguaaaaggaaaagucacacaucucucacuggaaaucaaaaguuagaaaugauuaagcuuagcaaggaaggcaugucgaaagcugagacaggcuaaaagcuaagcugcuugcagaaaacagccaaguuaugaacgcaaagaaaauuucuuuaaaaaaaguaaacacagugcuccagugaacacacaaaugauaagaaagagaaacagccuuauuacuaauauggaaaaugucugaaaggucuggauagaagaucaaaccagccacaacauuccuuugagccaaaaccuaauccagagcaagaccuuaacucucuucaguucuaugaaggcugagaaagguaagaaagcugcagaagaaaagucagaagccagcagagguugguucaugagguuuaagaaaguaagccaccuccguaauguaaaagcgcaaggugaagcagcaagugcugauggagaagcugcagugagguauccagaagaucaugcuaagaucauugaugaaaguggcuacacgaaacaacagauuuucaauguagaugaaauagccuucuuuuggaagaagaugccaucuuggaugccacauuaggcccuucauccucugggggccaguagaguuuuucauagcuagagaggagaagucaauaccuggcuucaaaucuucaaaggagaggaugacucucuuguuagggccuaaugaagcuggugacuuuaaguuaaagccauuguuaauugaccauucugaaaauccuagggccuuuaagaauuacguuaaaugggccgggugcaguggcucacgccuguaaucccaggacuuugggaagccaaggcaagcagaucaccugagguuaggaguucgagcccagccuggccaacaugguaaaaccccaucucuaaaaaugcagaagaauuaggagggcuugguggcacgugucuguagucccagcuauucgggaggccgaggcacgagaaucacuugaacccaaaagguggagguagcacugagccaagaucaugccacugcacucuagccugggugacagagacuccaucucaaaaacaaaaaggauuauguuaaagcuacucugccugugcucuguaacuggaauaaaaaagccuggaugacuguaaaucuguuuacagcaugguuuacugaauauuuuaagcuaacuguugauggcugcugcucagaaaaaauauuccuuucaaaauauuacuguucauugacaaugcacuugaucacccaggagcucugauggaaauguacaagaagaugaauguuauuuuuaugcaugcuaacacaacauuuauucugcagcccauggaucaagaaguaauuucaagucuuauuacuuaagaaauacauuucauaagucuguagccaucauagauaguuccucuguuggaugugggcaaaguaaaucaaaaauuuucuggaaaggauucaccauucuagauaccauuaagaacauucgugauucaugggaagaggugaaaauaucaacauuaacaggaauuuggaagaagucaauuccagcccuuauagaugacuuggagggguucaagacuucagugaaggaaguaacugcagaugugguggaaauagcaagaaaacuagaauuagaaguggagucuaaauaugugacugaguugcuacaucucaugauacaaauggagcagaugaggacuugcuucuuauggauaagcaaagaaacugguuucuugagauggaaucuauuccuggggaagaugcagugaacaucguugaaaugacagcaaaggauuuaaaauguuacauaaacuuacuugauaaagcagcagcagggcuugagaggacugacaccaauuuugaaaguccuacuguggguaaaaugcuaucaaacagcaucacaugcuacagagaaauugucauaaaaggaagagucaauugauguggcaaacuucacuguugucuucuuuuaagaaauugccacagccaccccaaccuucggcaaccaccacgcugaucagucagcagcuauuaacauagagguaaaauccuccaacagcaaaaagauuacaacucacagaagguuuagaugaucauuagcauuuuuaacaauaaaguauuuuuaaucaagguauauacauuguacuuuugcaaauaaugcuauugcacacuuuauagacuauaauauaauguauaauauaauguaaacauaauuuuuauaugcccugggaaaccaaaaaauuuguguaacuugcuuuauugugguggucuggaacugaacuugcaauaucucugaaguauaccuguguauacaauccaaagugugacuucaaauucucgagucugagugcaaauucuuuuucucuccuccucaucuaaauccuucaacaucccacagcaccuaaaccagagugugccuaugugcuuaauaaauagguaaucuucuuuggcuguugugaucucccucuaauugucauuuuaaaaaguguaaauuagaucucuuuucucaucuuacccuucuggcaagcuacucaaaauagucagaucaucaugaguaugcauagccuauuuauggugagucuugguuugaggugagaaggaauaggucuucuccaucucaccaacaggguaugcauuucucugacgaauuuugccuuucuugacccugaccacacacaacuccuuggcucccugcugacugcccacuauauccagcuuuggugcaggaaaaugaugggaccuaagccuuuggacagugacuccugaucuggccaagcaaggggccucccucacuucaguuuuggcccuagguuugccuacugccauacuucauuaauaucugacaauuaccccauccugguaaaagcugguucauauucuuaucugagcccuuaccaucuagaaaucaaggcaggcacaggacauuaccaaucuaaucaccagacaaccaugcacacacagagauuccaggggcuaaugcaaaacaguguuuucucccuaugaggcuacugagcaguccaugugagcucaguauccauaucccugcugagcaucauucacgcaaucauuuauucaauaaauauuuacuggacaccuaccauaugccagggacuuuuccagaacauugggauccucuccuggucuccuucaucuucccucccuuccuuucucccuacccagaagucccagcccucaacugauuuguuccaccagguuuuccucuuacagagugguggugcugguggugggauucagaugcuccagguaccccagcaugauacguuuacaagucaaacauuuuuccagcuaauuuggccaccuaucauaguuauagauuuucuguuguuccaucauaaggguuugagaggaauucugcaacaaagguggcuguuccacagucauugcaauuuagagcaaaacucaauuccaagucuauucaauucaaauaaauacaaaacaaaauucuuuagaaugaauuuuagggcuguguaaauaauuuaaacauuggggaaaaguuuuaauuuuuaggccgguugcagcagcucaagcguguaauggcagcacuuugggaggccgaagcagguggaucaccugaggucaggaguuugagaccauccuggacaacauggugaaaccccgucucuacuaaaaauacaaaaaaauuagccaggagugguggcagccaccuguaaucccagcuacucaggaggcugaggcagaauaauugcucaaacccaggaagcagaguuugcagugagcugagaucacaccacuguacuccagcuugggggacagagcaagauuccaucucaaaaaaaaaaaaaguuuuaauuuuuuuuucuacugucaauucuccagagagguuuuuccauuucuaaauuaggcccccaauuaacucucacagagcaccuucuauucauucuucauagcacuuauucaauuugcaaagauuuacauaugacaucauugcuuaauaucuuacucccccacuagacgagcuccacaagggcaggaaccauuucuguuuuguccugcacugaauaguagacuguacacagagccugcacauaguaggaaaacaguaaauacuuguugagaggacaaagauucauuugccuaaccccccauaaauccuucuucauacuucuagcuccacuacuuuaucucaauauuguagaaaguggcuuaguucaacuucaguagacucaaguggaggcucucuuucaugcacacacacagacaaaauuacuuuugguaaauauauagaauauauguagacaguuuuauauuauagcauuguuuuuagugucagaaagcagaacaaagcugagaaacuacugggaguaauugacuaaauuauacugaugagggggucaagagcugaaguuuauauuuuugcaccuaucagucauuaguuaaggguugggggguggaagcauaaauucaaaggcacuuauggcccccgaugugcauaaaugaagcacauuccaguaaccugagggucauuugcucauaaagugaugcagggcugggcuguugggaggauaacuacaccaggaguuggagugcacagaaauagugaagagaucugaaggggugugcgugcaaccaucauugcuacauuuuaacaaaaaccuauauaugcacaucaugcaagagcaugaaaaaagaugaacaagaauccucugagggaggaacagaagagaaaauggcuggaggggugggaaaggaguuuauuaacuuuuucuuuauguauuuucauauuauuucuauuaaauauuaaacauuuuaauaaacauuuuaggggaaaagguuagcuagaaacuuuuaauagauguaccauucccaagcaaaacuccuccucagcacacgaauuggucacacacauugcucaaaacuuugaaaauuuucuagcugggcacgacagcucacaucuguaaucccagcacuuugggaggccgaggcagguggaucacuugaggccaggaguuuucagagcagccugggcaacauggggaaaccccaucucuacuaaaaauacaaaaauuagccuagcaugguggcaugagccuguaaucccagcuacucuggaggcugaggcaggagaauuccuugaaccagggaggcggauguugcagugagcugaggucaugccacugcacucccaucugggcaacagagugagacucugucucaaaaaaaaaaaaaaaaacuuugaaaauguucuaaaauagaccaaaguacguaacaacuccuauuguuuucaaauucauuguucagcuaaaacaggcaaucuuccauauuaaaaacuaaagucagccgggggcaguggcucaugccuguaaucccaacccuuugggaggccaagguggguggaucaccugaggucaggaguuagagaccagccuggacaacacggugaaacacugucucuacuaaagauaaaaaaaauuagccgagcaugguggugcgcaccuguaaucccagcuacucgggaggcugaggcaggagaaucacuugaacccgggagguggagguugcagugagccgagaucgcaccauugcacuccagccugggcaacagggcgagacuccaucucauauaaacaaacaaacaaacaaauaaauaaauaaauaauuguauuaaauauuuaaaagguuuuaaaagccaauuggaggucuagaauuuaauuaaaauuuaccugcaucaacuacuguuacaaauaacuuaucugcuuuggcaaucagauuaaaugauaucuucuaugaaauacuacgcauacuugugcacaaugacaaacacaguauaacuugagauucucuggaaacaaauagauuucuuuugacuuugacugaaagacacaucuugauuuccaaacacuaaaaaucuauuuuugccaggcaugauggcucacgucuauaaucccaguugaggcgggagaaucaccugaggucaggaguucaauaacagccuggccaacauggugaaaccccgucucuacuaaaaauacaaaauuggccaggugugguggcacacaccuguaguccuaguuacucaggaggcugaggcaagagaaucacuugaaccauggagguggaggcugcagugagccaagauugugccacugcacuccagccugggcaagacagagcaagacucugucuaaaaaaaaaaaaaaaaaaaaaaaucuauuuucaucaagugcuuuggaauccaggaaauacagauucaauguagaaaaugccuguaacccuacccacccaacuguaauuucuuccaugaaaaacagaaauugcacagaggucucugcucugaagccugcacaaugacaaaggagucugugagauggagaacuaaaagagcgaagggaucuucacccugugugccaugaugccuugacacugacaccaaacaauguugugucugucucuauaauccggaggaugggcaauauggauuuugugacauaaaaaucagugugacauaugacuaccauaaaagaaggaauuaacagacuaaguauuuucuucauacuugacuaauaaacauuuacuacauguacaguuacuuguuacuguacuuuauguuaugaaaucggagcaagcaagaaaagaauccaagagaaaaucauuccuucccccuucuccguuuaauuguucuuuccucugcccagcuggaagaagcucuguggagaagagccugcaagguuuccaaauugcaaauaacauaucaugauuuauuauagauacauuccauugcuuagccuccccuagagcccuugccauauucugcccuuuuugucucuguuuuuuaugcauggagcaaguuccaucuuaauccaccacauauagguguccaaaaaauucugcucuuuauuuucuuuauaucaacuuaaauucaucucaagucucuggcucucugagcuggcaagaaacucaaucugucauuacuggaguccucuuaccuccuuggcuuacaccagaaucuggggaaagugcaucuauagaaacugggagaaggguuucuaaucucacaccuagcuugaucccaucugauauucucacugcccaaccuuucuuuccccaugcuaaguaggaaagggggaguguggugagggggcuuugccucagcuggacgcccuggugcuuggaguggagcaucucugagacaccaugcagcuguccuuucugacguauuacccagcaggacaugaccacagaacaggcaagaguccccauuacccauagacccaugaaccuucaucccuucccagugacccaaaacuuucacucuuucuuggucuucaaagguaccccuuuauucuucccuauuaccuuauugcuuuagggaagcuugcauaauuuugacaaugagccaggguaggacugggaacccacaauaauuaacaucuuaacaaagaauucugccacucacacuuauguuaucauuucuucccacacagaauuucucuucgcuccucaccccauccuccauuacuaccaaaccuggaguuccagagagaauguugcaggaagucagggacccggaaaagagggacugacugaagccauggcaggagaacauaaauugugaagauuucauggacauuuauuaguuccccaaauuaaaacuuuuauaauuucuuaugccugucuuuacugcaaucugugaacauaaauugugaagauuucauggacauuuaucacuucccuaaucaauacucuugugauuuccuauaccugucuuuaaucucuuaaucccaucaucuucauaagcugaggauguauguccacucaggauccugucaugauugcguuaacugcacaaauuguuuguaaccauguguguuuaaacaauaugaaaucugggcaccuugaaaaaagaacaggauaacagugauguucauggaacaagggcgauaaccauuaggucuggcugccugagagccagguggaacagagccauauuucucuucuuucaaaaguaaauaggagaaauauugcugaauuccuuuucucagcaaggaacagcccugagaaagagaaugcauucccagggguaggucucuaaacuggccgcucugggaaugucugucuuuuaugguugaagauaagggaugaaauaagcccuggucuccaguagcacucccaggccuauuacggugaguaaauucucaccuaguaaauuuuuagucagacugguugucugcucucaaacccugucuccugauaagauguuaucaaugacaaugcgugccugaaacuucauuagcaauuuuaauuucgcccccguccugugaucucacccugccuccauuugccuuguaauauuuuauuaccuugugaagcaugugaucucugugacccauacccuauucauacacucccuccccuuuugaaaaucacuaauaaaaacuugcugguuuugcggcuuggggggcaucauggaaccugccgacaugugugugucucccguggauacccagcuuuaaaauuucucucuuuuguacucuuucccuuuauuucuccgacugaccaacacuuagggaaauagaaaagaaccuacgugaaauaacguugaauuauugggggcggguuccccugauaagggaagagucuguuuauuacuuauuuuaucuuuccuaaaauaccuaacauggggauucacgaccacugcauuugagagagcaaaucccucccagcagccccuacaaauuuucauugauauguaaaaagaaaauuuuuauuuuugcuacaacugaguguaaauauugucacaguaaugccugagaugagaaacaaaguagguuagauggcuggguguggaauagcuuuguuguaacuaagacguacaugguuagugugucaucagguuggcacuacagaaaaauugcaagaacuuugccuccaugaagaauacagcuagggcagaacaagcucuucucuaacagccaccauccugacagccaccaauaaccccaaccuuguacuggcauuaugguggcaauagcacuguaaucauugcuggccuaauuaguauuguugucaaucauuuaauuaucucaugugucucaaaaaaguauaguauucgaagcaugccucuguugcaguuacuaaaggauguccacucuggccggacacaguggcucacaccuguaaucccagcacuuugggaggccaaggcaguuggaucaccugaggucaggaguucaaggucaaccugaccaacauggugaaaccccgucucuacuaaaaauacaaaaauuagccgggcgugguagcaggugccuguaaucgcagguacucgggaagcugagacuucagaauagcuugaacccaggaggcggagguugcagugagccgagaucacaccacuguauuccagccugggcgacagagcaagacucugucaaaaaaaaaaaaaaaaaaaaaggauguccacuccucuaauucuuaccuucuuccuaacuaaaagaauauccaauguuagacacacucagcauuuggggcucugucuugauagggacccccugggaaacagguguagaauacagcucauagcuguuccaacucaggggaacagaaagagagaaauuuauccaccaguuccuacacaucauucauuaagggguguucccuggagaaagcaacuauccagaaccucuggccgguccugugcaugggcuaagcguguuucuauggccagaaaaagccaucaggcagagaguggcagguauuuucaaaagaagaagccaccaccauucauaaggaauggugagggcugaggguacauggguagggggcccagagggucggcuacaucuucaguuaaagaguacagccacuacucauccauggcccagcagggaaggagcugaggaauaaauaccagaucuugcucugcucccagccuccaaucuccugcugaaccuaaccagaagcccccugaugcaguucacucuggccggucucucaggacccagagcaggguggaggagaauggagaaugaauacagaauauccagcacacuagccuucaggcauucucaagucucaagauuuaaaaucucagacagcacuguuuggcuauaaaaauauuaugacauguuuauauauuagcuaaaacuagugaaacuggaaaagaucuuggaaaaguuaccugagagaccaaacaguugaagaaaaauccuaaauaagaggagacuugaauucuaguucuggugcugauaauuauuaaugacgcuacuuuaggcaaguccuuagcagcaugggcuguuuccucaccuucacaguagaguaagaucuauugaccuaaugaagcuauuaugaaaaucaaaagaaugggaaaaugcucuguaaucacaaagguuauacaagugugagguauuaguauaccuucacuuuuccagacagauaggaagcaauuccauuguuaaacacaacacuguuaaaaagaaaugccacuauuuuuguuucauuguguuuuucaauuaggaagacauuuacauaaauauuuaccaccacauaucuuuuuuaaaauaagaauggcuauaaauaaauaacacauauuuacuuacaauuauuuucuuaccacuaaucucucaccaaaaaucugcauucuaauuauauaucaguuucuaauaaagucauaguuuuuuccccauuauuuccuuuuauuuuucacuguacuuuacuuuuucagccacuuccucuuuuguccuuauaugcuuuaacauuucugaugacccaguaauuaugcccaagauuaugauugauucuuuguccuuucucuuuucacuucccuuuuaauguagaaauauaagccaaauggugguggcaccacuugauuauagugggaaauacuggcacaguggcucacaccuguaaucccagcauuucagggggcugagacaggaagcucacuugagcucaggaguuugagaacagccugggcaacauggcgggaccuugucuguaacaaaaaaaaaaaaacaaaagaacacagaaauuaaugaggugugguggcaugcauaccugcagucccagcuacucaggaggcugaggugggaagaucacuugagccugggagauugaggcuguaaugagcuguaaucgugucacugcacuccagucuggguaacagagugagaaccugucucaaaaagaaagaaagaaauacugggaagaauagcuucugugugcaauaaucaaauccagugaauuaggaaaaacauuauuaauguuccuaaguggagauuucaguguuucugacuugcuacaaaucaggaaucgggauaucacuaaguuagagaaauucaugaaacaaaaggcaauuauuuccucuaaggcuaucucgcuguuauugucuuaagauccucccaauguaaagucacucuuuuggcuggaauaaaguuuuugaaaaggaacauuaggggaagggagauuguuuuuaaauguaccacuacuaggaaaauaagcauuugucaauucuuaccuacccaagacaacauagagugagguagagacuuaaggaaacaaaauuagaaauuucauaaaagggaacauaaaguugccauucuuuuugcugacucuauuguuucaagucuuugcagugggugggaguaggaaauuuuucugggaaggaaaagguuuugcccgcuuccuuaaagcaagucuacucuauuuuaauuagcuuucuagcuguuaucucuuuacuucacauaaggaacacugccaacacuccauuuugacaccauccugaggaaacagauagugcccuccugaacuuugguaagaagcauaacacauacagcagcuuaagacugacuacuccaggaaacaguuuuugaguagaaccuccuucccaauaaaguuaaaggaaauuacuuucuaaaaaucucuaugaagugauaagccacuuuccauauagguacuuuucaugcuucauacuguguuucucugaauauaauugguaggaacuccauuuaaaauguuaggauauuugauguauuuaaggacagaaagagaaaggcuggagagaauucaaguaccuuugaacaacucaaguuugaacuuugagaguccacuuacauguggauuucaaaaaauauauauauauuuuaaaauuuuuagaaauuugcaacaauuugaaaaaacaugcagaugaaccaugcagccuagaaauauugaaaauacuaagaaaaaguuagguaugucaugaaugcauaaaauauauguagauauuagucuauuuuauuguuuacuaacauaaaauauauguaacucuauuauaaaaaguuaaaauuuaucaaaacuuacacaaacacagacuauacauagugccauuugcaguugagagaaauggaaauaaacauaaagaugcaguauuaaaucauaacuucauaaaauucaccguagaacauacuguacuauuguaaugauuucauagcuaccuucuguugccauuguggggagcucaaguguugcaagaaucugcuuaaaacacugugugacgaacaucaucucugugugagcaguucaucuuuccaguaaauugugugucacaguaaaaacugaucucucauggcucucacauauuuuucauuguguuuagugcaauacuagaaaccucgaauaacaccgugggauccauaaaaagugccacuagugaugcuggaagugcucccaacaagcagagaaaagucaugccauuacaagaaaaagaugaauugcuugauauguaccauaaauugagguuugcggcugcagcugcccaccauuucagauggacaauucaccuuuuaaacagacaacauaaacuuacaguauccauaaauacaguauaguacuguaaauauauuuucucuucccuacaauuuucuuaauaaucuuuucuuuacuuagcuuacuuuauuauaaaaauacaaaauauaauacauaugacauacaaaauauguauuaaucaacuguuuauguuaucaguaaggcuucuggccaauaguaggcuauuaauagauaaguuuuggggaaggcaacaguuacaugcuaauuuuuuaugaggcucagcgccuauagcccccacauuguucaagggugaacugaaauaugaaacaaauucaauaguuagauagccuaaauaagcuauuauuuucauauucccaaacuugcuaaagauugcuccaguuuguaauaacuaaaacuacaaugaaguugucuuaggauuuaaaaaauauuuuggaugggaaggauaauaacuuaauaauaaacuuagauaauuuaacuuauacaaaauauuuaugugaauacugugauguuuguacaacugucacuccacauauaaaaauucuagauuuguuuagauuuuggcaucagacugcuaggaguaaccauuuagguagaugauauuauugcagcauuauuuuuaacaugcugcuaagagaacuucuauuaaacaaccucuaucacuugccugcugacaucuuaaauuuuuuuaaacauggcuaaauucauuuacuccacaauuaguuguaaauaaccaugagaaaaguaaugcaagcauauaucauuucuagguuaaaauaauaagaaaauacaugugcuuaaaggaguuaaaacauugaucucacaagcaaauggugggauuggagguagagagauugcauucuucccacggcacaucuugaguccuuauaacugauugacacgugagggaauucuuuccacaaagaaauggguaauaaaugaaacaaaucuuuaugaucgaaaaauaugaaucacauauaaguuaucaaagggauuuccuagacaacuuccaaacaggagguagagaccuugaggucaucuguagacugaauuuugaccaccauucucagauacagagaaaaaauuucuagagaauaaauaugaauggaagccuuauguuuuggagguggucuagucuuguuaauaauacaagaguuggucuugauuaaaugagucucuccuuuccuucuccucaaauaaaugggaaaauucaguguaccaaaacuaugacucaaaucgagaggucacacugugaaucuccaaauguuagagcuccauguuuuguccaaacaaaucucauaaccugacuaaacugcuuggacuacacgggacaaauuggcauuucaucaacuucugaaccugagcuggggcauaauuuacuguggaaacacugacgaaggagcuucauguucuugggaguucucuggauuuuaaauucuaaacugaagauggcagugagccagugacccuaaccugaguuugaagguggugccacuucucugggagcacaaaguucaaaaggaugaauuugggaaaaagcaucacuucuggugggcacuucugucacucaggacccagugugcagagaugauacugggaacucaaacaccuaaaaauucaagaaacugagugaacccucucagagauaaaccccccaaaaugcaccaaaacacaucaaucaucaaacuuuugaaaauuaaagacaaauaaaauaucuugaaaguaaagagagagaaacaacacuuuacuuuuagaaggaaacuaauuugacuuacaguagcuuucucaucagaaaccacagaggccagagaaaauggcacaguauuuuucaacuacuaaaauaaaagaauugucaacacagaauccuauaucuagcacaaauauucuugaggaaugaaaggaaaauuaagacagucucagaugaaggaaaaugaacagaaucuaucaccagcauauauacccuaaaagaauaguuacagaaguuuucuaugcagaaaagaaauguuaaauaagaauuuuuggaagacaagaagaaaggaagaacacaacaaaaauaugaauaauuauaaaaagcuuuccuucucuuuaguuuuuaaaauuauauuugaugaaagaagcaaaaguuauaacacuuucacuaugguucuaguauauguagaugauauauuuaugaacauuauaaauagaagaggguaaagugaucuaaaaggagguaagguuucuauuaucaagcacagccauuucagugcaccagaaauugagcaaaggcagacaacaaguugaaaagcauuuauucaugaaaagucuccaaaacuuuggguaacaacaaugggaaacuaugaccugcuugccagggaugacuccccuuuagucucuacccauaacauggacacagcuuggcaagauaguaguucagccaugaaaaccagcagcuuuccuccagagagggcaggcucaacccaaggugggaagagaaaaccacuuuugccagcuagaugugaacagggaaaaccccacgguuuuguaguuccaguugggaugugaaguguaccaaccaaaaauuuaauggaauuaucugagaagauauaagcauuccacauaucucucucugaccuguguauaguggaaauccaagacaggcuagcaaaaagugaaagccagagauuugagaacuggcuauaacuuugaaagcauucccuaacucacaaacagauugagcaggaguggguggaaucccuguggacucaguuuuuuuaacacaaccucuccuaaaguguaggcuguccacuaaacuaaaguagacaugagggcaacuugcagaaagccaggcuaaaaauuaagaauaaaaagcugagcagagguaucaguagcuacacaccacagagaagagaaucugcaguuuaaucccagacaaauugcuagaaaacaacaauccucagaaaaauaaaacagaaucccgaguugcuauauuaguucauauguccaguauuuaauuaaaaaucacuagauaugcaaagaacuauaagaguauaacccauacucaccgagggggaauaaagaagucaguauaaacugacuuugaauggggccagauauauaggauuuagcagagauuucaagaaguuauuaugauguuaaaaaaucaaagaaaaauaugauaaugauucagcaauaggaaauaucaauaagaaacaaaagccauagcaaagaaucaaauaaaaauucuagagaagaaaagcaaaauaagugauaugaaaaauucacuagaugggcccaaaaguauaauagauugaaaguaucagaauaaggaaucaguuaauuuaacaauauaucaauagaaaggaucugauucaaguaacagagggaaauagauugaugaaaaauaaaaagagccucagagaucuaugggaccauuucaagugucccaacacacauguaagaggugucccagacaaagaggagagagaaaaaaugagcagaaaauguacuggaagaaauaaaggcccaaaacuucucaaauuuuacuuuuaaaaauuaaccugggcaacccccuuuggguccccucccauuuuaugggagcucuguuuucacucuauuaaaucuugcaacugcacacucuucugguccauguuuguuauggcuugagcugagcuuucgcuugccauccaccacugcuguuugccaccgucgcagacccaucacugacuuccaccccucuggauccagcagggugucugcugcacuccugauccagcgaggugcccauugccacucccaaucaggcuaaaggcucgccauuguuccugcauggcuaagugcccagguucguccuaguugagcugaacacuagucgcuggguuccaugguucucuuccaugacccacggcuucuaauagagcuauaacacucaccacauggucccagauuccauuccuuggaauccgugaggccaagaaccccaggucagagaacaagaggcuugccgccaucuuggaaauggcccacgaucuugggagcucuaagaacaaggaccaccccgccccgguaacauuuuggugaccacgaagggacauccaaagugguaauauuggaccacuuucacuugcuauucuguccuauccuuccuuagaauuggaggaaaauaccaggcaccuguuggccaguuaaaaacgauuaguguggccgcuggacuuaagacucaggugugaggcuaucugggaaagggcuuuuuuuuuuuuuuuuuuuuuuuuugagacagagucuugcucugucacccaggcuggagugcaguggugcaaucuuggcucacugcaagcuccaccuccuggguucacaccauucuccugccucagcuuccccagcagcugggacuacagguguccaccacaacacccagcuaauuuuuuuguauuuuuaauagagacaggguuucaccguguuagccaagauggucucgaccuccugacuucgugaucugcccaccucagccucccaaagugcugggauuacaggcgugagccaccgugccugugcugggaaagggcuuucuaacaacccccaauccuuguggguugggaauguuggucugccuagaaucagcuuccgcuuucaauuuuccuggggaagccgagggccaacuagaggcagaaagcuguugucccgaacucccagcauuagcugguucagaucauggcacagccagaagucucuacucaacaguugcccaugugugugccccuaccuuuccuucugacccauaccuccugggucccaaccacgacuuucuugaaaguguagccccaaaauucuccuuaccucugaaucuacuuccucccaucccugccuccuagguacuaaugguucagaguuucauuuccucuagcaaguuguaucuccaaagggaucuaagggagcucuacacugcauccuuaggccccuaggcuaugaacccagagagucuugucccugguaucccucccaauuuagguauacagcucuagacaugggcaguuaugugagacccauuccccaccacccuugccagggccccaaguuuguaaagggcuaggagaaaagagagagaaagagagagacagaggggagagaaagaaagagagacaaagagggagucaaagagagaaagaaagagaaagauagaaguaguaaagaaaaaacaaugugcccuauuccuuuaaaagccaggguaaauuuaaaaccuauaauugaucauggaaggucuucuccaugacccuauaacacuccaauacuaccuuguugucaguguaaacaagggcguaacagccugaaaacacugagaccacugacaacccgcagccuuccuaucaaaaauccuuaacccaguaacccgcagauggcccaaaugcauucaaucuguagcagcaacugcuuugcuaacagaagaaaguagaaaaauaacuuuuagaggaaaccucauugugagcacaccucaucaguucagaauuauccuaagucaaaaaagcaaaaugguagcuuacuaacucaaaucuuacucguauggggcuauucuguuagaaaagggugauuuaaccuuaaccacugaaaauucccuuaacccagcagauuuccuaacaggggauuuaaaucuuaauuaccauacaaagguccgaccagaccuaggaggaacucccuucaggacaggacgauagagguuuccucccaggugauugagaaaaaaaccacaaugguauaucucccagugcuaacccuccccccucccuccaacccacaacaguccccagagugugauguuccccuuccuguguccauguguucucuuuguucaacucccaccuaugagugagaauaugcaguguuugguuuuuuguucuugcgauaguuuacugagaaugaugauuuccaauuucauccaugucccuacaaaggacaugaacucaucauuuuuuauggcugcauaguauuccaugguguauaugugccacauuuucuuaauccagucuaucauuguuggacauuugggugggugcagcacaccagcauggcacauguauacauauguaacuaaccugcacauugugcacauguacccuaaaacuuaaaguauaauaauaauaaauaaaaaauuaaaaaauuaaaaaaaaacaaaaaaacaaugaacuugggauaauaaaaaaaaaaccacaauggguauucaguaauugauagggagacucuuguggaagcagaguuaggagaauugccuaauaauugguuugcugaaauguucgagcuguuuucacucagccaagucuuaaagcacuuauagaaucaaaaaaaucuaucucaauccugacucaaaauguuaccuacacccucucugacacaaauuugcauaagaacuguuuuauuuauuggaauguaucuugauggggcaacuggguuguuaugaaauacucaggaacccagcccagcucuacaacucaccccugagcacaaaggcaauguugggcaugcugguaaaggaccacuagaauacagcagccuggacccuuuucuuuguggucaagaaaggcgggaaaaggggugcaggacugcuacuugguaagcguaacuaacccgauaagcagagguccauggguaguuacgcacccuggaaagcaauaagcauuaggaccauagaagacgcucuagcacuaaugcucaucagagaaugacuaggggugauggcaucccgguuuuuuuuuuuucagauaggaaacauuaccccuaaggcaaaaacgccccuaagauguauucuggagaauucggcccagucagaguguauguaccuuuuucccugucagacuuaaagcaaauuaaaauagaccuagguaaauucucaaauaacccugauggcuauauugauguuuuacaaggguuaggacaauccuuuaaucugacauggagaaauauaauguuacugcuaaaucagacacuaaccccaaaugagagaagugccaccauaacugcagccugagaguuuggcgaucucugguaucucagucaggucaaugauaggaugacaacagaggaaagagaaugauuccccacaggccagcaggcaguucccaguguaaacccucauugggaugcagaaucagaacauggagauuggugccacagacauuugcuaacuuaugugcuaguaggacuagggaaaccuaggaggaagccuauaaauuauucaaugauguccacuauaacacagggaaaggaagaaaauccuacugccuuucuggagagacuaagggaggcacugaggaagcauaccucucugucaccugacucuauugaaggccaacuagucuuaaaggauaaguuuaucagucagucagcugcagacauaaaaaaaaacacuucaaaaguccgccuuaggcauggagcaaaacuuaaaaaacccuauugaacuuggcaaccucgguuuuuuauaauagagaucaggaggagcagguggaacuggacuaacgagauaagaaaaaggccaccgcuuuagucauggcccucaggcaagcggacuuuggaggcucuggaacacagaaaggcugagcaaaucgaaugccuaauagggcuugcuuccaguguggucuacaaggacacuuuaaagcagauuguccaaauagaaauaagcugcccccucguccaugccccuuaugucaagggaaucacuggaaggcccacugccccaggggacgaagguccucugagucagaagccacuaaccagaugauccagcagcaggaaugagggugccuguggcaagcaccagcccaugccaucacccucacagagccccggguauguuugaccauugagggccaggagguuaacugucuccuggacacuggcacggccuucucagucuuacucucuugucccggaaaacuguccuccagaucugucacuauccgagggguccuaggacagccagucacuagauauuucucccaaccacuaaguugugacuggggaacauuacucuuucacaugcuuuucuaauuaugccugaaagccccacuccccuguuagggagagacauucuagcaaaagcagcggccauuauacaccugaacacaggaaaagaacacccauuuguugcccucugcuugaggaaggaauuaauccugaagucugggcaacagacggacaauauggacgagcaaagaaugccuguucuguucaaguuaaacuaaaggauucugccuccuuucccuaccaaaggcaguacccccuuacacccgaggcccaacaaggacuccaaaagauuguuaagaaacuaaaagcccaaggccuaguaaaaccaugcaauagccccugcaauacuccaauuuuaggaguacagaaacccaauggacaguggagguuagggcaagaucucaggauuaucagugaggccauugucccuccauacccagcuguaccuaacccuuauacucugcuuucccaaauaccagaggaagcagagugguuuacaguccuggaccuuaaggaugccuuuuucugcaucccuguacauccugacucucaauucuuguuugccuuugaagauccuucgaacccaaugucucaacucaccuggacuguuuuaccccaaggguucagggauagcccccaucuauuuggccaagcauuagcccaagacuugagucaauucucauaccuggacacucuuguccuuugguacguggaugauuuacuuuuagccgcccguucagaaaccuugugccaucaagccacccaaacgcucuuaaauuuccucgccaccuguggcuacaagguuuccaaaccaaaggcucagcucugcucacagcagguuaaauacguagggcuaaaauuauccaaaggcaccagggccuucaguaaggaacguauccagccuauacuggcuuauccucaucccaaaacccuaaagcaacuacgaggguuccuuggcauaacacgcuucugccaaauauggauucccagguacggcaaaauagccaggcuauuauauacacuaauuaaggaaacucagaaagccaauacccauuuaguaagaaggacaccugaagcagaagcggcuuuccaggcccuaaagaaggcccuaaccgaagccccaguauuaagcuugccaacggagcgagacuuuucuuuauaugucacagaaaaaagaggaauagcucuaggaauccuuacacagguccgagagaccagcuugcaacccauggcuuaccuaaguaaggaaauugauguaguggcaaaagguuggccucauuguuuacggguagugguggcaguagcagucuuaguaucugaagcaguuaaaauaauacagggaagagaucuuaccguguggacaucucaugaugugaacagcauacucacugcuaaaggagacuuguggcugucaggcaaccauuugcuuaaauaacaggcucuauuacuuaaagggccagugcugcaacugcacacuugugcaacucuuaacugagccacauuucuuccaaauaauaaagaaaagauagaacauaacugucaacaggugauugcucaaaccuaugccacucgaggggaccuucuagagguucccuuaacugaucccaaccucaacuuguauacuaauggaaguuccuuuguagaaaaaggacuucgaaaagugggguaugcaguggucaguaauaauggaauacuugaaaguaauccccucgcuccaggaacuagugcucagcuggcagaacuaauagcccucacucgggcacuagaauuagaagaaggaaaaaggguaaauauauauacagacucuaaguaugcucaccuaguucuccaugcccacacagcaauauggagagaaaggaaauuccuaacuuccgagggaacaccuaucaaacaucaggaagccauuaggagauuauucuuggcuguacagagaaaccuaaagagguggcagucuuacacugcuggggucaccagaaaggaaaggaaagggaaauagaagggaaccaccaagaggauauugaagccagaagagcugcaaggcaggacccccuccauuagaaaugcuuauagaaggaccccuaguaugggguaauccccuccaggaaaccaagccccaguacucagcagaagacauagaauggggaaccucacaaggacauaguuuccuccccucaggauggcuagccaccgaagaaggaaaaauacuuuugccugcagcuaaccaguggaaauuacuuaaaacccuucacccaaaacuuucacucucacugcaccuccuccaugccacuguacuaccaguagcuccccuuaccaagagcuuccauggagaaugcagcuuccuggaaauauugaugccccaucauauaggaguuuuucuaaaggaaaccccacuuucaccgcccacacccauauaugccccugcacuucaggccauacauuucaaucccuguauguuuaagcuccuuguuaaguuugccucuuccagaaucgaagcuguaaaauuacaaaucguucuucaaauggagccccagaugcuguccaugacugagaucuacugcagaccccuggaccggccugcuagcccaugcucugauguuaauggcauugaaggcaccccuccugaggaaaucucaacugcacgaccccuaucaugccccaauucagcaggaagcaguuaagagcgguugucggccaaccuccccaacagcacuuggguuuucccguugagaggggguacugagagacaggacuagcuggauuuccuaggccgacuaagaauuccuaaaccuagcugggaaaggugaccacacccaccuuuaaacacggggcuugcaacucagcucacaccugaccaaucagguaguaaagagggcucgcuagaauacaaauuaggcuaaagcaggagguaaagaaagagucaaaucauauaucaccugagagcacagguggagggacaaugaucaggacauaaacccaggcauuugagcagggagcggcaacccccuuuggguccccucccauuuuaugggagcucuguuuucacucuauuaaaucuugcaacugcaaaaaaaaaaaaaaaaaaaaaacccugcagauccaagaaccucaaugaacaauguguguaagauaaacacaaagagaaccacaucuagguagcuaggcgaauugcugaaaacaaauuuaaaaggugaaggauuugggauuguagcuuacuuaaagcuuacaguuauccugacacugucccauggaaacaggcagaagacacaagauuccugcaucauaaacaaaagacuuuauuacucacagaacagcaagaagaaugcacaucaacauauuugccuaaguuccuuaugccuaaaucccacacggcccaugccuacccacacaguggguugcaacccaggcaaagggcccaacacuuuuugagcaagcagcaaauccaguuucccugccucuccuuagguagugagcagggacacaguaccacucuauggucaccuugaccagcuaguugacuauaugacuagcuacagaaauggcucagugucagaagacaaauaaagcuugccaucugucacgcucagcaaggauaugcauguuucaguucauuuuacauugcuauaauggaauaccugagacuggguaauugauuuuaaaaagaaguuuauuuagcucaugguucuggagacugggaaguuuaagacugggaagccacauccgacaagggccucacguugcaucauaacauagcagauggcaucacauggcaggagcacacaugacaguggcaagcaagcauguggaaaagagacaaaacaugagaggaaacuucacuuuauaaccaccugcucucucaguaauuaauccaguacugcaagagacagaacucacucacucccacaauauggcauuaauccuuucauaagagcagaucuuucaugacucaaaugccuuuuaaagucuuaccaccucucaacccguuacacuggggaccaagccucaacaugaguuuugguggcgacaaaccauacucaaaccacagcaaugcaggaacaaauaggaaccaaaggacugccguucgcaaccaaaaucaaaaggagagaacugagcuauaguggagcaaaguugccauaucuuaucacagguaaaccaccauuaaccugaaguggauuuuaaguuaaaguuaugaaguucaagaaaaauaaaaaucccuagaguaaccacugaaaaaugaacuuuaaaaauauacuuaaaaaugagcugggcacagcgguucauaccugcaauaccaacacuuugggaggccaaggcaggaggauugcuagagaccaagacuuuaagaccagcaugggccacauagugggaccccugacugcacaaauuuuuuuuaaauuagcuggauguggugucacacaucuguagucccggcuacucaggaggcugagguggaaggauugcuugagccugggaggucaaggcugcagugauccaugaucacaccacugcacuucagccugagugacagaaugaaacccugucacaaacaagcaaacaaaaauacaaauauaaauaaguaguugucaggggaugagggagagggaaaugguaguggcugcuuauagauacaggauuucuuuugggaguaauuaaaauguucugaaauuagauaaugacucuauaaauauacuaaaaaccacugaauuguacacuuuaaagggguaaauuuaaagguaugugaauuauaucucacuaaaugaauuaaaauauugauuuaaaacaaaagaaggcaguaaaaggggaacagaggaaaaagaagaaauaagacauauagaaaggaaauagcaaaauagacaaauccaaacauaccaauaacuacacugaaugugaaugaacuaaacaguuuaaucaaaagacaaaaauugucaggauguauuaaaaaaaaaaacaagaucuaacuacauguugccuaaaagaaacacaguuuaguuuaaaauauacaguagguugaauagcaugcacaaauagcugcuaugaaagagcuggaauggcuauaugaauauaagaugaaauagacuuuaugacaaggcacauuaagacaaggaaggacaucuaaucauaauaaaaagguuaauacaucugaaaauauaacaauuauacacauauaacaccuaaccacagagccccaaaauacaugaagcaaauacugacagaauugaaaggagaaagagacaagaggguaugacucaguuaucugaaaugacuccugauuaaguaaaguucacaaaaaauaaauauuguuaucaugaaguuccaggagaaaucaaaaaggcauaacaagaaucauugcauaaaccuuuuauuuaaacaaguuuauaaacuauaauguuuccagauuccagggauaaccgaggggaauaacucucuccagugaaaacuuaacgauucuuuucauucccguuguccuuuugcaaaacaauuccaaggcuuacugaaacaguaagauaguauccagaauguacauucucacaagauguaagaaagcagaccugaaaauacuauuuugauaauaugugggcuaaucuuauucuuaaacuguuguugcugcugcuguuguaguuuuacaaacacugcauauucuaaaaaaaaaaaauuuuugaaauucuguuugaaaaacaaauaaaugauaaauauauuccuuccaugaaguaaaguaaugcacaaaugaauaaauaaaugauagcauuugugcaaagauuaagagguuguaaacuuauuuaguuucaucucuguuugguauaauacauaauaucauaaaguguuauaagcuauucuauuuuucaacauaaucuuaaacucaggaaaaaauuagcuucuuuacugcuagacugcaaguuggcaacaaacacaugguuugguagacaaaauaauacauuuauuaaggcacuaugccuccaaaagagaacagugguuaguuacaauccaaaacugagaccugaaaagaaguaauguauuacuaauuaaauaagaaaaauaacugguaaauuaaguuuucaaacuuuaacguuuauuuauuuauuuauuuauguaaauuuuauuuuuauuccuuuuucgagacagggucucauucuauugcccaagcugcaguaguaguggugcaaucauauaguucacugcagccucguccucccaggcucaagggauucucccaccucagccucccaaguagccaggaccacaggcccauggcaccacauccagcuaauuuuuguauuuuuuguagagaugggguuucacuauguugcccaggcuggucuugaacuccugagcucaagcaaucugcccaccucugccucccaaagugcugggauuacaggagugagccaucaugcccaggccucaaacuuuaacuuaagaaaaauguagaugucauuucugugauaauggugacauuauucuagacuaaauaaauaaaauagagacuuacuacacuuugagcuguacaaaaauuuggacuuaugccaaaauagcuguaacuauuuaaauugaugaauggauggauggcuauauggauggauauaaaaauaguugauagauuuuuuuuccuuucugcugcugcuucaugguagagcuaacccaccccuugucucucacuccagcugcaguggauauccugucuaccuuuuuuguggacauuuguccaucaauaacaaauggguaccccaaaagucaagagucacacaaauauuaaaccaaguuuuauaaauguuugugcuguugaguuaaagagcuuacaaguacuacagggacugauucucugacaaggaaucaaacccaggccacaggugugaaagcacagaaucuuagccacugcaccacaagguggaaugccuuauuuguaaaucccacagggaauucaaagcaggcaguuugaguguacaaaggauuuuaauuuuguuuuggguuagauuuuugcauuuuaauuuugucaagagaauuucuaagccaagacacuauugugucuuucuuuauuuugauugucccauaaauacaaguaagacaauuguuuagaaugagagaucuccaaaaucuucuuuuuaagaaaaaaaaauuaaaguucuuucuaauuuaaaggauccaucuuuuggccacugaugauuagaauuuccaaugguuuacaaauuccaguagugacucaacaauaagccucuucaugaaaaguccaggagauaauuuuccagguuuagaauaaguuuuuacuauauaaacaagagguguuccuugagagcauauggaggagacagucuccaugauccccgaaaauucacugagaaguagacuuaagauaacaaagacucuugccgccacagccuauuuuuuuuuuuuuuuuuuuaagacagaaucucgcucugucgcccagucuggagugcagcggcgcaaucucugcucgcugcaagcuccgccucccggguucacgccauucuccugccucagccucccgaguaguugggacuacaggcguccgccaccacacccggcuaauuuuuuguauuuuuaguagagaugggguuucaucguguuagccaggauggucucgaucuccugaccucaugaucugcccaccuuggccucccaaagugcugggauuacaggcgggagccacagugcccagcccaccacagacuauuaaggcugguguuugugcauauggugccacuaguaaccaacaaauuugccagggaccaccagucacagacccguuaauccacuggcaccagguaggcccuccugggauuagaauuuucccagccuaaccaggcaacaggagccccuuacagauggaacuuaagacaaacuccccugagagcuugacauaguuggaacaaaaaguauaccacuuaaaaucuuaugugaccagccauuuuuagacuggucaccuaaugugaccugaaaaucaugcucccuaaaaucgcaaggaccaagagaaaaugcucucaaaagucaaggucuuauacggacaugaaauaagacaauaggagaacuucaucugguuuuuauuuuggggacuacagcaaaguuuauagacacaggucuagucagaaccgcaaaacugaucagucugcagugccagcucaaauagagaguuuauggggguuuaggcccauguccuacccuauggcauccuucuuuaugacacaacaacacggaaagacaaagacuauuucuggaaggaaagggaccgaacaaugugaauauucauaccaaaaaaggacaccagagucgcuacacccaaaacuagucacacaaauccuuuuuucucauuaaucaagguuuuggagaugaaaaugagacaaacagugauuuuuaccaucggcucuaccagauuccacagagggagagaggccgggagccugacugguaagaauuucuuacccuucugcuggcuugucagguccuugguucccuucauugcagcuuccagaagaacagagcagcuuugguauccuguucacagcaccaaaacuggaggggccaaggaaaacuuccccuuugcccucugaaguuucacugacaaucgcugacaaaaaaggcagguuaauaggagaaaaggcauacaaauuuauuugaucauaauuuuacacguacac

SEQ ID NO: 192794 - RNA, 35745 nt, Homo sapiens
cggccgcgagcgcagugguguggagcgcgccgggucccggagccggcugucugagggauggacgagacgagcccacuagugucccccgagcgggcccaacccccggacuacaccuucccgucgggcucgggcgcucacuuuccgcaggugcccgggggcgcgguccgaguggcggcggcggccggcucgggccccucuccgccgggcucgccgggccacgaccgcgagcggcagccacuguuggaucgggcccggggcgcggcggcccagggccagacccaaaccguggcggcgcaggcccaggcucuggccgcucaggccgcggcggcagcccacgccgcucaggcccaccgcgagcggaacgaguucccggaggauccugaguucgaggcgguggugcggcaggccgagcuggccaucgagcgcugcaucuuucccgagcgcaucuaccagggcuccagcggaagcuacuucgucaaggacccucagggggugagugcggggguggggaccgccgccgcgggcugagggccggcggcgcuccuggggaguugggggcuucgcacagccagagggaaaagggagaaacuucacaguaccagccccuggcaggauuuagggaugccacugaggacuggagcuggggacgcucugcggaauggagaaauaaaucagaaccuacuuggugggggaggagugagcggaaaaugaaaagaggaaauugaccagauacgggccgggggcucagcggugugguggggcaauccgccgcuggacagagacugcuuucuaguaggguacuuagcuucacacuacugggacagcuauucggccgccgacuugcagauuuggggcuuuaggccuguucucucuuuuuggaccgaccgaaccagugugucgcuguucacggaggaggaugggugaccuaucaggggaucugagaauucaguuccagccuucuauguugugggggauguccccugccaccgucccagcucuuauuaacagacguugaagaaagaaugggcggacucaccaguuucaucugcccuggguauugcucacuucugggaaaggguucaaauacuuuuugacgacuccaaaguuuagauagaacuuggaguuuuagaaacauggggccaucagcuacuuuuucuuucauuucucucccagggcuaucaacagccugcuuuucaacuaaggcagagcguuugccgaccuuuauuuuguccccugccuguauauaaagggggaugguuauaggauggggcauggagugaccaggguaucugagaagugaccuuuauccuuuugagaacugcagaauuuaagaaauaccaagucuucccuguuuucagggaaguuucagggaaauuuucaggugugcugcaaugggucauuggaaagauguauuguuauuuaaauuaugggugucaaaguuuccucagauuuucccugacaucucuccugugugaacucuuuagauggccagggugcuguuuuaauaggaguccugaguggccaggacgggcuguuacuuguagcucuugguucggcucauugaaugaucuaguuauucacucagaguuugagucgucccugaauuaaucaagaauuagagaacaauucugccaugaacucaguuucucaguuuacauaaacugaguuggggaaagcuuugcgaguaauaagucuuucgaaguuucuuuuucuuuuuuuuuuucuuuuuuuuuugagacagagucuugcucugucgccaggcuggagugcaguggcgcgaucucagcucacugcagccuccgccucccagguucaagcaauuauccugccucagccuccugaguggcugggacuacaggcgugcaccaccacacccagcuaauuuuuguauuuuuaguagagaccauguuggccaggauggucucgaucucuugaccuugugaucugcccaccucggccucccaaagcgcugggauuacaggcgugccaccgcgcccggccuccaaguuucuuaaauaaaagagcuugcaagcucaagugggaaccaucauuucuagaagcaaagaaaugugagugcccugagguuuaaaugucagccagaggcuugcuugcuuucucuuucuuccuuccuuccuuccuuccuuccuuccuuccuuccuuccuuccuuucuuucuuucuuuuucuuucuuucuuucuuucuuccuuccuuccuuccuuccuuccuuccuuccuuccuuccuuucuuuccuuucuuucuuucucuuucuuucuuuuucuuucuuucuuucauucauucucucuuucucgucuuucuuucuuucagagaaggucucacucugacacccaggcuggagugcaguggugcagucucacugcucacugcagccuugacauccagggcucaagguccucccacucagcuuccgaguagcugggacuacaggcacgcaccaccacacccggcuaaaaauuauuuuucauggagacaagagucucgccauguugcccugguuggucucagacuccuggcuucaagcagucauccucuugccucagccucccaaagugcugggauuacaggugugacccaccaugccuguccuuuuuuugugggcagaggguauuuuuaguuuguuggcaaauguaagaaggggcuaagauuaucuuugauagguacaggagaaggaggaauauuuuuguuuuucuuucaugacacuguuagagcugcauuggaaguggguuaggucagcugagaagugagcuggugcuuugacagauggaaguaauacgaucucuuaauucuaccuggcagguaaaguacuaccaucucaguacauaggccacagagaaggacagaccauagguauguuacuuggugauuuagggauuccagucucuaaaauuuccuggccacuauccuuucucauaggggaaguccaaacacagaugcccugacaaaacuuuuugacguacucauacugcuuccagugaagaaaaugugauuuagaacaaagggcacuuucuaaaugcuugcgguggguuagacuggcccacagacuuacuguaguuggaauugucaucuuuggcucuccuccaaauguauuuacuuuauuaaacaaauacuuacauagcauuuacuauauuccuuuaagugcuuuacaaauaauaacucacuuaaucuuuauaaccacccuuggagguagguacuguuauuauccccgcaggugacaacacaagcccaugguauaacaaauuuuuccaaggucucacaccuaguaagugguagaggcaggauugggccaaggcggguuggcuguggaguucauguucucaccacuauccuuugcucccucagagucagucaucagaauuuccauauucuggacaggugcgguggcucacgccuguacucucagcacuuugggaggccgaggcaggcgcaucacuggaggucaggaguucgagaccagccuggucaacauggugaaaccccaucucuacuaaaaauacaaaaauuagccgagcacuguggcaggcacuuguaaucccagcuacucgggaggcugaagcaggagaauugcuugagccugggagguggagguugcagugagccgagaucguaccacugcacuccagccugggcgacagagugagacuccgucucaaaaacaaaacaaaagaaaagaauuucuaaauucucuucucagcuacuauauugguuaguauugaauuugacuauaugugacagauauuuuaaaauaaugaugacuugaaaaaagguucauuuacaccucauguaaaagaagucuauaggcuagcugcucaggcaugcucagggcuggcaugacauuucacuuuauuggagacauaggguucuuccugccagcugaucagccaucuuuaggauauggcuucuacuacaugguccaagauggccgcucaagcugcaaacaucuugucugcuuuucagccauuuggaagaaggaaagggagagggugaauaugcccccauccuuuaaggcacuucguagaaguuguaggagacucuucuacuuacauuccauugucuaaaacuuagcuguaguaguggcugggaacuauagucuuuuuucuuuuuucgcccagguaaaaaucaugggucuugugucuagggaacaagggggaacagagauugggagaaccagcacuuucugcgacagccacuuuuggaucuuagacagucugaaagauucuugaagauaacagcccuggucccauuucucaauuuuggaugguuucugucucagugggguccaagaacagauggaaaaugcuagaagucauggggagaguauacacauaccccccucacuuaccuccuugugcuucaggucucaugcucacucaacugcaaaaggguuuuuugagcuuuuucucuuuugcguggaguaauacuagauuuucacauugccaagaaucauaggacagcaugugacucacuagguuaagaggauuaaaugacauaucacacaugaaagcccugacguaguuccuggcacuuaguuggggcagcucaaucagauuuuuaaaaacauuccuacuaacugcuuaauuaggguucuugggguacaugguaucgaauaaggcuauaagaguugguagauggggcgcagugguucacgccuguaaucccagcacuuugggaggcugaagcgggcggaucacaaggucaggagauagagaccauccugguuaacauggugaaaccccaucucuacuagaaauacaaaaaauuagccgggcgugguggcgggcaccuguagucccagcuacucgggaggcugagguaggagaauggcgugaacccgggaggcggagcuugcagugagccaagaucgugccacugcucuccagccugggcgagacagcaagacucuaucucaaaaaaaaaaaaaaaaaaaaguugguagaugaugcuuaaaaucucgagaccuacauguaugacaaacuugacugccucuuaacguuuuaguaaaauaauuuuauuauauuuuauuauauauauauuuuugagacaguuucucacccugucgcccaggcuggagugcaguggcacaaccuuggcucauugcagccuuggccucccaguguugggauuacaggugugagccacugugccuggaugguuuuauauauuucaacaagcccuucccuuccuuuuguaagaaugaacuuguaaauaaggcuucucuaccuaaauagcuaaaucaaggacuacuauuuuccuccaaccuauaccauagaauacagcaguucuuagaguguggcccagggaucuugaccucugggaguuccuuuuugggguccacaggucaaaauuauuuucaucauaauucuaagacuuuauuugccuuuuucauucucauuuacuuaggaguggagaguggagauuuccagagacuacaugaugugugauauugaaacagauugaauacuaagauaugagauauagccuuuacccacauuaacaaaugcuuuuuggaguccuuaauaauuuuuuuuuuuuuuuuugagauggagccucacucugucgcucaggcuagaucaggcaugaucucgacucacugcaaccucugccuccuggguucaagcaauucuccugcuucagccucccaaguagcugggauuacaggugcgcccaccaccaugcccggcuaauuuucguauuuuuaguagagacaggauuucagcauguuggccaggguggucucaaacuccugaucucaggugauccacccgcuuuggccucccaaaguacugggauuacaggcaugagccaccacacccagccuaauuuuuaagaguuuaaacuuuuugagaccaaaacguuugagaacuauccacuuaauguuuaugaaacuuuaaaagaagacuuuuauaaaagguaauuucuguauauuucacugugcgaugugaaugauaugcuugaacugucuuacauuuuagguucuuggagaaaggaccucuuuuagcauagcaugacacccuccuccuugucauugcugauuagauauaggaaccccgcuggguuccagguuccaguaauuuuuuguuguuguuuguuuugagaggggggucuagcucuguugcccaggcuggagugcaguggugugaucuuggcucacugcaacuuccaccuccuggguucaagcgauucucccgccucagccuccugaguagcugguacuacaggugcaugccaccaugcccggcuaauuuuuucuauuuuuuuuuuuuguagagaugggguuucaccauguuggccaggcuggucuugaacuccugaccucaaaugauccaccugccuuggccucccaagugcugggauuauaagugugagccacugcgcugggcucagguuccaguaauugguuguggguucugacaccagcuggugcauggccucuugcuuucuugugugauuugguuuuuauucccaacuucauggacugcuacugcuuaagcuaucuguaccucaccccuccuuuguuaaaaggggagauuaguaaauggguguuaagaaaaguuguuuuuauaauauuggcaucaaacugaagcucucuccuagauauaauaaaggaauugaaaaucuauuaagagaaaaaaaacacaaaauauuaaagaagagaguggauggugaggaaaaauuaggcaguagucauuuucuuuuccagcuaaauacuggugggugucuuuccaauuugagugguuuuagaguuuguucuccaugaaugagaagaguauucuugauuauucaguagcauaguugauuuuaugaagugaacauuggaaauuaggccagaggguauuuuaccucucugucuaggaaagccaccaaaugccugcagaaugcuugcacaucguucuccacaggcuagguccugagcaaaugcuaacauaauugaauugaacugaggcuuacacuuaguccugaaaggcacuugucuccccuucugucugaaugcccuuuuguuccuccauucuucauacucuaacauucccucauugaucuaguccaggcaguauucuuuaauaaaaccccuguacuauugcauaaccauaauuacucaugcuuuuggagucauugaaaugcuucuuauucuccuuaugguagaaggaaaucaagauguuugagaggucagucuuuaaaugacacuugacugcaaucuuggccuucaaguucugcuugcuuuuuuuuuguuguuguuguuuaauuuuucuuuuuuagagauggggucuugcucugucacccaggcuacagugcaguggcaugcuucuagcucacugcagccuugaucuccuaggcacaagggauucuccccgccgaguagcugggacuacaggugcauaccaccacacuuagcuaauuuuuuuuuuuuuuuuuuuugagaugcuauuucgcucauugcccaggcuggagugcaauggcaugaucucggcucacugcgaccuccaccucccagguucaagcgauucuccugccucgccucccgaguagcugggacuacaggcaugugccaccaugccuggcuaauuuuguauuuuuaguagagaugggguuucuccauguuggucaggcuggucucgaacuccugaccucaggugauccacccuccuuggccucccaaagugcugggauuacaggcaugauucccggcuaauuuuuaaaaauuagugacagagucuugugguauugcccaaacuggucucaaacuccaggccucaggcaauccugccucauccucugaaagugcugggcuuauaggcaugagccaccaugcccaacuuuuucugucuuuaaguagaaguauuuaccaguugaccucagcccugguauuuuucagcccccaguaguaguaggagugucuuggccuccuuuucauugaggaccagcuuacugaacuccauaaugugccucaguugaacugacuguugcguucugggacaugcuucaaguugccuuuugguuucccuguccaggguccggaggguuacaguggacucgucagucauucucugaguugugagccuguugcuacugcugcuuuguuauucagaggcugggguuccaggggagcagagacagagaagacugcugaggacucuagcuagcugcuuugcauaagaaaguaauucugaagacuuaugaugugaauauaugcauuuugcauuugccaguaaauaaguuaguuugucuuuaagaauaaauugauucuuuuuggagggagaaggaggaguucuguauuuuucuuguccucucaaauccuuggaaggcauuuuuaaaggagcuggcuucaagaucgaccaguuauuguuagcgacauggaccuagcuaguuccuaauaugaguacugaguugguaaaagcagauggguguauguugucugcugugaccugccauucaggaagugacacccacagaaaaauaucuuaugacccagacuagcuugaguaggcuguggggugaggggacaaggagagucauaugauaugaggaugaaucacuuggauagcauauuugcuuuuuuccuuugaauuaccaguuuggggacuggagggaauuagaugaauguaaaacaaccucagagggcugacuggccuguugaagaaaacacucaggagggagggccauaguuucuaggcaucccauauuuccaaagaccuuagaagauuaaguuacugucugcuauagaagauggauuuaaucuguguggcaucucauguccugguuucuugccuaucagaauuacuuaagagagcuucauucuaaccaaguagcagagucuuuuuccugcugugauuuuucucuuuggauaauaaggcugcgagaggaaaucucuucaucauugaugaaggaauuuccuuaaccucauuccauaauagauuuuuuuuuuuuuuuuuuuuuuuuuuuuuuugaggcagaggcuuggucuugucacccaggcuggagugcaguggcgugaucucagcucacugcaaccuccgccuccugaguucaagugauucuccugccucagccucccggguagcugggauuacaggugcaugccaccaugcccagcuaauuuuuguauuuuuaguagagacaggguuucaccauguuggccaggcuggucucgaacucuugaccucagguuaucugcccaccuuggccucccaaagugcugggauuacaagcguaagccaccaugcccggcccauaauaccuucuuuacuuccuuccaguugguaaaguuuuuagucuuucuguaauuggugcagaacaacagugugcauaauguaacuucggaaauuagaguuuaugauguuaaauuucuggcauaccacauacagaaagaucccguaggauaaauagggcaggggugcaugcaaaaaaagagaacauauaaccugugauaaguuaauuccucauuuuuuugggggaaagauuacuuuagagcccucgauaugugcauuaggauauuguaucuuucuggagggcaggaagcaguaccauauuggcauuagaugcugccagugacucacgaucuaccacugaauuggcuucuguaccuuuuuuuuuuuuuuuugugagacagggucucguuuggucgcccagggugaggaaugcagugugggcaaucuaggcucacugcaaccuccgccccauggguucaagugauucucaugccucagccucugaaguaacuggaauuacaggugugcaccaccgcgcccagcuacuuuuuguauuuuuaguagagacaggguuucgccauguuggccaggcuggucucaaacuccuggccucaaauuauccacccgccuuggccucccaaagugcugggauuacaggcaugaacccuuguaccuggccugcuucugugucuugcuccuagaaauguagcaauccauuuaccuuguuuguuugaagcacaaaguuagagguagguacuuauaugagggaaaagagauggagaagagggaaaaaggagcaaggaagaaagagaagacuuaagauguucuuuggccacaacccuuucuagcagugggucucuuagcugcacacacgagcuggugucuuccccuuaccaacugggagaaaccugaguccaacuguaaguaggaauugucugccuaugcccugucauuucuuuccagauuccugcugacuuggucugugggcuauuuuggucaacucggauuuaacauccucuuuuucuuuggucucuguagaggaucauugcugucuucaaacccaagaaugaagagcccuaugggcaucuuaauccuaaguggaccaaguggcugcagaagcugugcuguccuugcugcuuuggccgugacugccuuguccuuaaccagggcuaucucucagaagcaggggccagccugguggaccaaaaacuggaacucaacauuguuccccguacaaaggucagugacccaucuccaggaagccuuacugccuggccacaguuuuccuggggccuaagcccugcuacauguuagugggaccuuggguccaguggggucauuuauacccuaagucuggguucucgaucuuuuuucgggaggauggcaggauuaggcuuaugauuugaucaccugaugaaggcuaucuuuugaaggauacacacacaauuuuugcauacaauuuuaggaaauucacaaacuucuacugcauguuuauggcucccuuggucuuugaaucccagcuaaccccaagcuaguuagaaaccuagugacuuuguggcuuacucucagacuucugagccaucccagcauuucgauacagucuaggacuggcugaugacagcuaagaacuucugcagggucugacaaggaagacuuuaggacaggcugaggguuagaacaauggucuggccugaacccuacagggaacugacauggaauauuucuaacuuaucuuuaugcugucgaauuuugggacuugucugaacacaucaaaauaggggugccagaucuaggcaaacucacacucagaauggauucauacacaucuuguauguguuauagacauaguugaggucucccccaacccccacccccaccaauaugcuugaauacagaauugauugcauacaauuugagggaguuuacugacaccaggcuaagaaccccugcacuacaagguauuccaugaaacucaccaaagguuaugaggggaaggaaucuacuggucagcauaugaacauguccggacacaucauucacugaguacguggcuaccugggguuuaguaacaacuuaggugggacucucaucugaugcccugaggcugcugagucaucuaaacaauccuggcuccgugcuuagucuuaacuagucuaugcuaguuuauuuaguuauuuacuaaauaacuaaaacuaaauuuauuuaguuauuuaguaaauaacucuuugagaaucugaugaaaccuauagacccccuuuccagaaaaaguacauauauuugcaauuauuguuuuguguauaauuuuagggcaaugguucauaaacguugcagucuaucuguugacaccccagggagcaugucucuagauuaaaaucccucugcuuaaaguuuucuuuucuuucuuauuuuuagagacagggucuugcucuguugcccaggcuggggugcaguggcaugaucacaacucacugcagccuugaccucccaggcucaagcaguccucccaccucagccucucagguugggacuacgggcaugugccaccaugccuggcuaauuuuuuuuuuuuuuaauuuuuuguagagacaaggucucccuguuuugcccaggcuggucuugaacuccugggcucaagcuauccuccugccuuggccucccaaagugcugggauuacaagugugagccaccacacccagccuuaaagaugucuucucagguuuagauagcagauucuaugagcaaagagauugaucagcaguagaaacuucccuuccguuugagaggaaaaugugacuauuguggauauuuaaccaugucugcuccuuugcuacuaaacuccaaacaauuagccaacuaguuuguaaguuauagaagucagagaccacuucucaagauuuccucucucauucucagcaccuagcaaaauacuauauuuauaguaagcauucaugaaguaccagcugagucaguaaaugaauaugaaaucaugagaaacaauaccaaaguucuuccaacuuuaggucuagcgagaaaauguuugaccaggcuucuaguucccauuucacaucuaauucacugccuggcuuuguacagcucauuccuucucuuuaugccuuacuuuucccucucugugcagauaguuuuacagcaugcuuugaacaucuuguaugauaauuaauguucuuaagucuccuaaccugaaaugcuucuacuaggcuccucuuagacucuagaaacuuuuacauucuccuugcuuaucacucuauaguuuucuuccuuuacuaggcaaauagcagaccgugucuggcucuaugccuaccugcucuguuggugcuucuggaguguggugcccaagaaucagaggacuugaguuugaauucuugcucugcaguuuuugauuuguguaacacuugggcaagucauguaaccucccuaggcucaguuuccuuacuguaaaaauagggauauaaauaguuccuacuuuguagaguggccaucaauauuacacaagacagccuauaugaagcacauagcugagugagugccaggcacaacguaaacccuccauauguuagccugugauauuuuuaucagcuauucuaaucguuagugucacccccacaaucccuuucgucccuaucuuuggucuuccucuuucccuguuagagaaccuucacgaggccugaggaucuuuugcaucagaaagucagcaacaacaaaaauacuugucuuggcugggcucauuggcucacgccuguaaucccagcacuuugggaggccuaaguggguggaucaccucaggucaggaguucgagaccagccuggccaacagggugaaacccugucucuacuaaaaauacaaaacuuagcugagcaugguggugcgugccuguaaucccagcuacuugggaggcugaggcaggagaaucgcuugaaccuggaaggcagagguugcagugagcugagauugugccaccacacucuauccugggcaacagagcgagacuccgucucaaaaaaaaaaaauacuugucuuccaugagacugagaugagacagaacuuuggaagcuuaacauauagcugcuggagaauaguaagaggacuccucucccugucuccccaacucuugugacaggacucuauccaguugaucagagcaucugucauuauagaaacaagguucacauugcauuggaacuucaaaugguaaggcucuaauucucacucacuggcugucucugcucucugcuccuaugagguuucagguuaugauaguuucauuagucauggggaaaaagugguuuguuaggaagaaugauagaaaauaaauaugaugggggcaaaaggggauuuauggcuugagagagccaggaguuucacuguggacacuggcaagguagccuuaggaaagcucuuuuuccuucauuccuaugccugaguuuucugauuuguaaggcagggagugccuacuacaguaccaugcacauccauuuuagguagucuauuaauacuagaugguagcauggagcgauagaugagaggcaguuauuuugccucucagguucaugggaaaaaaaauaguuauuuguaauaaauuuuacaaggcuuaggaaaauaccuuucuuauaaguuugauuuuagguauuuauaugcuaaaacucacuuguugcugucucugaaagaagcuuguaacucauucuucauucacuuaauaaauauuuaaugagcauaugccagcuacuguguuaggugcuguggaugcuaauauaaauaagauguucuccgcuuccucaaaucucauucauuuuaaaggaggaguuagauauacaaauggauaauuacaagacaaugugauaagugugacaauagaugcauauguggauuacaauuacgucacugcaauuugacuuaaguauaauauugauggcucauaaaaauuuuuuuuagaauaaguaaugcaugcaucuaguauaaaaaucagaaggcacauaggguaaacagagaaaaguaauucagacucccugcuaccccuaucuccuggccauucaguuuccuuccucagaggcagccaggauuacaguguauagccuauacauaaaaauagcaguuaauuaaaaugaaaaccaauuuuaauguuuguguuuugaauacgaauaauuucacaaaguaaaaaaauucaaaagggcccgggcacaguggcucaugccuguaaucccagcacuuugggaggccgagguaggaggaucaccugaggucaggagaucaagaccagccuggccaacauggugaaacccucucucuacuaaaaauacaaaaauuagccaggagugguggcacacaccuguaaucccagcuacuugggaggcugaggcaugagaauugcuugaaugcgggacuuggagguugcagugagccgagacugugccacugcacuccagccugggcaacagagugagacucugucucaaaaaaaaaaaaaaaaaaaaauuuuuuuucaaaaggaaaugaagggguacagaguaaauugcaacuuguuugucucuggaaagaagaugggcauuuggccuaaucuaacccaggagaugacaguguuaauccuuguacuucauacuagcugcuguaacaacccuuaaaucuaagugguuuaauacaauuggauuguauuucuuuuuuaucauauuuuuuuugggacagagucucccucugucacccaggauagaaugugcaguggugcgaucuuggcucacugcaaccucugccuccaagguucaagccauccucccaccucagccuccgaaguaucuaggauuacagacgugcaccaccaugccuggcuaauuuuuguauuuuuaguagagacgggguuuaaccauguuggccaggcuggucucgaacuccugaccucaagugaucugcccaccucggccucucagagugcuggguuuacaggugugagccaccacgccuggccaggaguguauuucuugauuacaucucagacucaugccagauaggcagcucuccuagauaccacaucacucauguaguuacaagguauccgagguucuuccaugguguggcucugcuauuucccagcccuucuuuccuagcugcacagacuggagaaugugaauuaaggauugugggagauuuuaguugccagcaguggaaguguuguacauacauaauuuugucauuauuucauuggcccaaacuaguuaucuucccucuccuaguugcugggaaggcugagaaauguauucuuucugugcccuggaagaggaauaggauuugugaacaucaagcuauuuauucucugccauagucuucugguuccuuaaacuugacucuaaccuuaguaucucuucucuuucacuguagguaguauaccuggccagugagaccuucaacuauagugccauugaccgagugaaguccaggggcaagcggcuugcacuagagaaagugccaaaaguuggacagcgguuuaaccgcaucgggcuaccaccaaagguauagacgcaccucuggcuuaucaagggucaugauuuauagugacauagucauccaaguggugaagcaaggugccuacaacucaaauaugggcacgugaauaaccugcccugaggauccugucuuccuuauuucugucaaguggcuaagguuugaaaaguugagaccuaacuuuucacuuuacuccucugguucauuuggauagguucuuuaauuuggauggaugaucacuguuacaucucuuuucuccuguacuugcaagaaaugaggaaguaaagaucuugaaaaguuuuccuucucugauacaaacuccauagggccuuaauggguaucuggcauauacuccaaaggucuuuggauuugggcaguagggaaaaaccuuuguuccuuccucuugguuccagguugguucauuccagcucuuuguugaaggcuacaaagaugcagacuauuggcugcggcguuuugaagcagaaccucuuccugagaacacuaaccggcaacuacugcuccaguuugagcgguugguggugcuggauuacaucauccgcaacacuggugagcagcugcagguggucccaugcccugugccagacuguguugaggcauggggaggccuggaggcuugcagggcuugggagucagaguaccuuguccagacacaucauguguaguuuucagaaguggugaggccuggaguuaguauuugcauuuuaucuuacacucuuuccugguuccagacagaagacacuuaacucuuccaaagcacugugaagaguacucuuauccuugaucccuagucauucuuguagccucaagaccuguaacaggacaguuuugucuuccucugacuucuugagguagauguuuagaucauugauauuuaaaaaaaauuuuuuuucagugcaauuuaaauucaacuaaccugguaaaauguacauguauugaggacaaaagucuuuaaauucaggcuggaugugguggcucaugcguguacucccagcacuuugggaggccaagguggacagaucauuugaggccgggaguuccagaccagccuggacaacauggugaaacccugucucuacuaaaaauacaaaaauuagccgggugugguggcgggcaccuguagucccagcuauucaggaggcugaggugggagaaucgcuugaaccugggaggcggagguugcagugagucagaauugcaccacugcacucuaaccugggugacagagcaagacucuguuuccaaaaaaaaaaaaaagucucuaaagucaccuuauuggagcuauauuuuguccgauauuuuaaucauaguaaaaugcauguaacauaaaauuuauuaucuuaaccauuuuaaaguaguaugaaauacauucauauuguugugcaacugucaccaccauccaucuccagagcucuuuuuguuguuguugagaccgagucuugcucugucaccuaggcuggagugcaauggugcgaucucagcucacugcaaccccugccuccuggguucaagugauuuucucaccucagccuucugaguagcugggauuacagacacccgccaucaugcauggcuaauuuuuguguuuuuauagagaugggguuucaccauguuggccaggcuggucuugaacugaccucaggugauccacccaucucagugucccaaagugcugggauuacaggugugagccaccaugccuggccuccagaacucuuuucaucuuguaaaacugaagcucuauacucauuaaacaguaacucuucauucccccucccuacgucccuggcaacaaucauucuguuuucuguuucuaugauuuugacuacucuaaguaccucauguaaguggaauaguacaguauuugucuuuuggugauucgcuuauucacuuagcauaacguucucaagguacaucuaugauguaguauauaucagaauuuccuuccuuuuuaaggauaaauacugauccauuuuauguauauaccacauuuugucuauccauuuaucuuucagugaacacuuggguugcuucugcauuuuagcuauuacgaacaaugcuacuaugaacauggguguacaaauaucucuucaagacccugcuuucaguuuuuuugaguauauauccagaaguggaauuauuggaucauauaugguaauucuauuuuuaauuuuuugaggaaccaccauacuguuuuccacagcagcugugccauuuuacauucccaccaacagcacacgaggguuccuuccaauuucucaccagcacuuacuguuuucuguuuuuuccuuuucauauuuaaucugcauucugcugaauguuuucuguuguuuugauaguaaccauccuaauggguguaagauguuaucuuauaguuuugauuugcauuuccuuaaugauuagugaugguaagcaucuucuuaugugcugauuggccaaucauauaucuucuuuggagcugucuauuuaaguccuuugccuauuuuugaauuuuuuuuggucauuauuguugaguucucuauacauuuguuuaaaguucucuguauaucuggcuauuaaucccguaucagauauauaauuugcaaauauuuucucucaaucucuugccuuuaguuuuauuuuuuaaagagacagaguuaugcucuauuguccaggcugaagugcaguagcacaaucauagcucacuacagccucggacuccugggcucaagugaucuuccuaccucugccacccgaguagcugggacuacaggugugaggaccacgccuggcuaguuuuuaaauucuuuguagagaugaggucucacugcguugcccagacuggucucgaauuccugggcucaagcaguccuccuaccucagccucucaaagugcugggauuacaggugugaacaacugcgccuggcuugcaacugauuuuuuuguggauugacuuuguaugcugcuacuuuccugaauuauuaguucuaguaguuauuuuuuuguguggaaauuuuaggguuaugcaccuacacaaucauaucuaugaacagacauaauuuucccucuuuuuuuuuuuccaauuugggugcuuuuuauuucuuuuuucuugcuucagugcucuaagacuuccaguacuauguugaauagaaguaaaagcaggcaucuuuucacuguucuugauuuuagaggaaaaccuugcaaucuuucaccauuaugauguuaggguccuuuuugcccaccuuggcacccucaagcuauuugcaagcugcuccuggaacuugugcacaucuggcugccauguggcugaagggugggggauggguagcugcuuguggggcuaagagccaaaauugaaugaaauuaaccacaauuuacuguccaggcuuuccccugcaaguugcaggcccuccauagacuccagagcuccaaaauaauuacaucagacagauuuuugccacuacaauuguuguccacguggggagacagauuucuguuguuuccuacuccaccaucuucccagaauccucucucuuagaguauugauuuuuaccuuuucuccuuucccuuccuuuucuuuucuuuuucuuucuuuucuuuuuuuuuuuuuuuuugagacggagucucgcucugucacccaggcuggagugcaguggcgcgaucucggcucacugcaaccuccgccucccggguucacgccauucuccugccucagccucccgaguagcugggacuacaggcgccugcuaccacgcccggcuaauuuuuuguauuuuuaguagagaugggguuucaccguguuagccaggauggucucgaucuccugaccucgugaucugcccgccuuggccucccaaagugcugggauuacaggcgugagccaccgcgcccggccuuuuuuuuuuuuugagacggagucucacucugucgcccaggcuggauugcaguggcaugaucuuggcucacugcaaccuccacuucccagguucaagugauucuccugccucagccucccgaguagcugggacuacaggugcaugccaccacacccggcuaauuuuuguauuuuuaguagagacaggguuucaccauauuggucaggcuggucuugaacuccugaccucgugaucugccugccuuggccucccaaagugcugggauuacaggugugagccaucgagcccgggcucuucuuuucuaauauaugcacuucagacuuuaauuucaucuuaagcauaguuuaguuguaucuuacaaguguuuuuuuuuuuuaccauaaucauuauaaaauauacugaaauuuuuuuuauccucucaguuuauagauggagacuguauuuucuaauuuccauuguucauuucuucucugacccauaguuuacuuaaaauaguuuuuuagcugguuaguaggaaaauuucaaaauacacaaaaguagagagacugguauaauaaaccccauguacuuguuaccaccuucaacaguuauuauguaaggucucacuuccugcuacccccaucccugcuggauuuuuuuuuuuuucaacuaaggcuuugacuggaacugcuggauuuuuuaaaauuuauuuuuauuuuauauuuuuuggagacggagucucacucuguugcccaggcuggagugcaguggcccaaucucgguucacugcaagcuccgccucccggguucacaccauucuccugccucagccucccgaguagcugggacuacaggcgcccgccaccacacccggcuaauuuuuuguauuuuuaguagagacgggguuucaccguguuagccaggauggucucgaucuccugaccucgugauccgcccaccucggccucccaaagugcugggauuacaggagugagccaccgcgcccggccacugcuggauuauuuuaaagcaaaucugagacaucauuuuauagcauccauagauaccuccauauguucuugaagagauaaagacuuuuuuuuuuuuuucaguauaaucaguauuuaaugucccaucaguguuuggauuaccccaguuguuucauaaaaaaagauuuuuauaauuggcuuguugaaauuaugauauaaagguccacauauuacauuugguuaauaucuuuccuuucuguuuuuuuuuuggagaugggaucucacuauguugcccaggcuggucuuaaacuccugggcucaagcaguccucccaccucagccucccaaaaugcugagauuacaggcaugagccacugugacuggccagguuaauauguuucuuaaaugucuucaauuuagggaaaguuucacaucuuuuuuuuucccuugccuuuuauuuguugaagaaacuggauauuugcccuauagaaguuccacauuguggauuuggcauccccaauucucuguguuuccuguaaauuuacugcuugaguuuaaaggcuugaucaaauucagguuugauuuuuuuuuuuuuuuuuuugaggcagggucucacucuguugcccaugcuagaguacagugguaugaucauagcucauugcagcagccuccaacacuuggcucaagcuguccugccucagccucccaaguaguugggacuauaggcacguaccaccacaccuggcuaaucuuauuuacaauuuguuuagacauggggucucgcuauuuugcccaggcuggucuugaacuccuggccucaagugauucucugccuccucagccucccaaaaugcugggauuucagguacagccucugcugauauucuuaaucuugacuuuuaucuuuuuaaacauauuaaggauuuuguugugaacauuuuaaagucuguauauuuuuauuguuuggagccccuacagaucuguuuuaauuuucaguuguuucucuuuuauuccugucaucuuguuucuuuguguaccugguuguuuuucauugucaaauacugccuaucagaaaucguagagcuguauaaaggccuaagaugucauuguaaauccugucuggaggaagauuucuuuuggcaagcaucuagggcaauagcaauccaguaucacuuuaauuucagguguugaggggagcuuaguguauuuccaagguguagugcuucaggucguaacccaaagcauagaugauauacgagggucccuuaccccugaucagucacuggauuauaguuuuugucucucuagcuccacaaggcucuuauaauuguucuaccucucaagcucuuagccagcucuuuccaaauuggcaggugcucuaggggaaaagaagccacagugcugggcuccacguccucccauggauuuccuuucucucccauaucuucacucuuaaauccuuuguggucuuauuaaaaucuccaguaccuuaaaaaagaucuaaaaauauuuuauccagcauuuguagucauucucaguagaagcguuaguccgaguguccagaauaccuaguccaccauuacaaaaauggaaaaucauccccccuuuuucugcuaacuuuauauuucuguucacagaucgaggcaaugacaacuggcugauuaaauaugacuguccaauggauaguucuagcucucggguaagagacugagauaaaucuuaaagagaaugaagaguauuugcauaauauagaaacacauaaaauggucagagauguaguucauacaaguucagaagaaucggggggcgcauauguuuaaaauuaauagguuaauauuugguaaaguuuuucucaauauguguuucaaggacauccuacugacacauguuaauaggaauagcaugaagaaagggucaaguaaauuuggaacauauuauguacucuguucuuugagcuucuuauugcacaguagcauaguaaaggucugagaaguacuacguuaaacaaaccuauuuaaauuugauuucuaccccuuuuaaaccaugaaccacuuuucucacaacagaccgcaaguccacagaacauaaguuuagaaaaagcugcuccugcaacuuucuuuccuuucucauuccuuucauccuccaccauacuucucuaucacuguucagucuacauguuuuacaaaauuagcagaaggcugccuaggggagagugagauugguuuuauuucuuuuuucuuuucuuucuuuuuuuuuuuuuuaagaaacaggguuggccgggcauggugacucacgccuguaaucccagcacuuugggaggccgaggugggaggaucaccugaggucaggaguuccagccuggccgacauggugaaaccccgucucuauuaaaaugcaaaaauuagccgggcaugauggcgggagcuuguauuccuagcuacucgggaggcugagacucgagaauggcuugaaccugggaggcugagguugcagugagccaagaucacaccauugcauuccagcccagacgacagagcaagacucugucucaaaaauuaaaaaaaaaaaaaaaaaaaagagacagggucuugcucuguugcgcaggcuggaguacaguggugcuauccuagcucacagcagccuuggacuccugggcucaaagcaguccucucaccucagccuccugaguagcugggacuacaggcgcaaaaguuguuuaauguuuuguagagaugaggucuugcuauguugcccagggugggguuuucauuccuuauaacuuuuuuacuuucucuaauaguggcucucaaauuuugugccugaaucuucugaagaguuauuuaaaauaguacacagauucuucaggccuuucccuuagaaacugauucaucaggucuggaguaaaacucaggauucugcacauuuaauaagguaucucaggggauucagauucaggcauccuggaaccacaguucuuguuccugugauggcacccaugaaccugaagcauggagccacauagucagugauugucucugacaugggcugucacaggugacaugcccacucuuuuuacauucaucucuuguccuuuuccuuuucaugcaccacugaagcaggagaacagacucccuugugcaagagcagccagcuguuaucuuccgaggcucuguuuucucacuggaaaauguaguugucaccagugaaguaacaucugagucaagguccacacaaaaggaccuuggccaacugauauggauuuuauuucuucuguucugcuuucaggauucucauuuucuuucccuaggaggaauggcuuauaguuaucuuuauuauugucauuuccuucuuaccaaggacuguagcaacucuuggggaaguguaccuuuucuaagauaagaacaggacucuugaacuuugaacaagagccaggucagaggcaccaaaaugugcuaaguucagauaacaacauggaagccaguucagagaguagcucaagauaaguucaauaagaauucuucucuugagggaguugggaugaguugcuuugcuacuaauuggaagggccugagggagauggguuuccucagucauuagucuuuccuugcucuucaggacacagacugggugguggugaaggagccuguuaucaagguggcugccauagacaaugggcuggccuucccacugaagcauccugacuccuggagggcauguaagucuccagacaaugguggucuggcucuucccuugcucaguauauuuucucacugugcaguggagaugauaaugucucuaucauaggauuauucuaaaaauuaaugaaauaauggaguucaggcacuuuaacacaauggcuggcauauggcaacuauuucauaauguaagcuguuuuucuaauuuuugucuucuaugauucccauuacaagcauaaaggugauuagaaauuagaagcauaaagaugaguuuucucauugucucuuugcauucuucucguucuuucugaggacuuuuuuuuuuuggaaauggaguuucgcucuuguugcccaggcuagagugcaauggugcgaucugggcccacugcaaccuccaccuccuggguucaagcgauucuccugccucaaccucccaaguagcugggauuacaggcaugcgccaccacgcccggcuaauuuuguauuuuuaguagagacgggguuucaccauguuggccaggcuguucuugaacuccugacuucaggugaucugccugccucagccucccaaaaugcugggauuacaggugugagccacugcgccuggcugagggcuauuuauuuuuuauuuauuuauuuuuuuuuugagacggagucuugcccugucgcccaggcuggagugcaguggcgcgaucucggcucacugcaaccuccuccuccuggguucacaccauucuccugccucagccucccgaguagcugggacuacaggcacccgccaccaugcccagcuaauuuuuguauuuuuaguagagacaggguuucaguguguuagccaagaugaucucaaucuccugaccuugugauccacccgccuuggccucccaaagugcugggauuacaggcaugagccacugcgcccggcccuuuuuuaauuuuuuaauuuguuauuuuauuguuuuaguguauauuuccugaaauaucuuuuuuuuuccuguuaucugaggacugucuuuccauaauuuauucuaauugugccucuaaauauaagcuuccuaucaguguucugucuuccuuguuccaucuccuacccuguuguaacugagaagcuucuggaaaggaggagaaauaaauguagggagucaguagccccuuuugcagcauuagucuuccuuuucagaaggaccaucucagcgucucaguggcaaguaguugcuucuagaccuugcaucuuggaaggucauguaaugucugagaaugagcucugacauuaggcagcccuggguuugaacccugguuccucuacugacuagcuguguaaccuuuacaguuaagagcacuuguaaguuuuuguuucuguuguaugucagggaagagggguucuccuuuagaaagugccuugacugguggaggacacagaugagcagggacuuuuccaacaccagcuuugccuuugacuuuuccucuuuucagauccuuuuuacugggccugguugccccaggcgaaagucccauuuucucaggagaucaaagaucugauccuuccaaagauaucggacccuaacuucgucaaggacuuggaagaggaccuauaugaacucuucaagguuagcccugggaaccucagcccuauuaucauaugggagaaggaauuuuuaaugguuuuuuuaauugguccugacaaaagccaagaggaaauggcuaacaccuuucugacuugaguuagccaacgaauagcaagauuuccacauguggacagcaggaccugguuuggauggguuugagagaaaugggcaggggugagaaaucacacugaugugucucuccuguccaucauguggcugcaauguaucugcagggcuuucauuuuaauauggagcacuggagccuagaguuugagaugcagaggaagauauugacuuguuuucuguuuccucaucuguaaagcagggaguucuugugggaguaguugacuucacaaagcugcagaagccuuaugcagguuuuccuucuuagaaaguuucuaacugggggagaaaauggguuccugugaggcauucacacagguuccaucuccuucuggucuucuuuugcagaaagauccugguuucgacaggggccaguuccauaagcagauugcugucaugcggggccagguaagccugggacauccucccaguaucuuuggcgucucugggaguguugugugcucagguugagcaaauguuugaaguuuguguuuuauaccccccccuuuuuuuuugagaccgagucucacucugucacccaggcuaaagugcaguggcaugaucucugcucacugcaaccuccaccucccagguucaagcaauucuugugccucagccucccaaguagcuaggauuacaggcgcaugucacaacgcccggcuaauuuuugcauuuuuaguagagacaggguuuuaccauguugaccaggcuggucucgaacuccugaccucaagugaugcaccugccucugccucccagagugcugggauuacaggcgugaggcccugcgcccggccguguuuuacagcuuuuuuaaguccguuguguacauuauuuuuggcuguaccuuaacaccuaggagaggaaaaguggcccucccaauucucccaccucuucccugguauccagugcuuguugaagcacuuaaugugcacucaucucuaugcuaguugcuagguaauucauugguaauuaaacuaaugcucucuguccuagaguugcucaaggcaggcuguauguuuuggugguuaagaucugggcccuggagccagacugcuucacuacuuggaagcucuguggccuggggcaaaagccucuguuuucuuguucauaaaacaggauaguaauaauacguugcacaguuggcuggagaauuucaugagauaaugcuuaucaagcguuuaguaaaaagaguacugggcacaugaagcacucacauauugauuaugguuauaauuuuguuguuauaggugcaacuuacauuauuccuucuccuuccacuucaccuucaaagggagcuaaggaaaccaaggggauuguugaucuuccaaagcauaguaaagaaaugcuugaaaaaugguuugaaaacucuguaggguacugguauuaugccuaucacuuugaagucuucuuaaagagaguugggaugaccuagugguuaagggugcaaacuguggucacagugccuggguuuuugaagccuggcucugccauuuacuaccugugagauuuugggcaaguuacuuaaucucuccuucccuuaguuuccucauguuuaaugugggaucaauaauaguagcugagaccaggcaugguggcucacacuuguaaucccagcacuuugagaggcuuaggugggcagaucacuugagcuaaggaguuggagaccagccugggcaacauggugaaaccccaucucuacaaaaaacacaaaaauuagccaugugugguggcgcacgccuguaaucccagcuacucaggaggcugagguggaaggauugcuugggccugggaggucuaggaugcagugagcugagauggcaccacugcacuccagucuaggggacagagugagaaccugucucaagauaauaauaaugguacccaccuuacagaauuauuaugagauaaaugauuugaaacaguuagaguaguaccugguauacuaaaauacucaauuuguaguauuaauagcuguuaggauuaugauuuuuguauacagaaaauucagcuucucccaucuuuaaagggcaagaggaucuucucagccuuaauucugcauuuacuucuuccugccauuuaucuaaagaccucugaugacagcaccuccuggguuugcugagcccauuuuucccuggaaggggguuggacagagguuuuuuuuuucuuuugagacagagucucacucugucacccaggcuggagugcaguggugcgaucuuggcucacugcaaccuucaccucccagguucaagugauucuccugccucagccucccaaguagcugggauuacaggugcauggcaccacaccuggcuaauuuuuguauuuuuaguagagaugggguuucaccauguuggccaggguggucucaaacuccugaucucaggugaucugccugccucggccucccaaagugcugggauuacaggagugagccacugagcccggccuggacagagguuuuaagaacuacaauuauuguagcugucugaauaccaguaacaugguauuccuacauuucccaaguaauguaagggcccaauuaggcuggcagaauuuuuggaagcauuaaaagccaugugauagacucagauguuauggaacucagcauaaaggaguaaacuggcuucuccaguugauauaggcugugccucuguccguauugcaaugucuuaucuaauuccaucccagcucagucccuugccaacccuucucccauuacucagauagugccauuauucaggaugguagggagguugggguagugcaguuuuauuuaucuccaucuugugcuccuaaugucuucagaggagcuuuugguaucuuguaaccuaaagugccuacuaccuuagggugaccauccagcuccuuccaacauguacauggccaguauaucacucaugugcuuacuugucuaccauucacacaucaaagcaaaaugugugcacuacaaaauuucugcacuacagaaaucugacaaagcacagagaaaagaggucauaacccugucuacauagcugagccauuauugcaggaugggcuguaguacaagggcccugagauguagggaaagagugaagaggccccacagggacacagucaggugauagaaguuguuacucaacuuaaaggcuucucaccgggaguuaaagaaucuagggucugagagaaagccucuguaacauuuucuuuuucuuuucuuuuuuuuaaagacagggucaugcucugucaccuaggcuggagugcaguggcccaauuguagaccacugcagcuuugaacuccuagguucaagaaguccuccccccucagccuccugaguagcugggaccacaggcaugcaccaccauuucuggguaauuuuuuuuaagagguggggucucgcuauguugcccaggcuggucucaaacuccuggccucaagcgauccuccugccuuggccucccaaggugcugaaauuauaggcaugugccaccacauccagcccaacauuuucaaagauaguauuuauucuuuaguauuaugugacugcuauaauuuuucuucaaauuuaaaaaauaauuuuucuuuuuaaauucuuuauucuccuuucuuuucaguccugguuccaggcuuaucuucagcuuuuuaauuuggaaauuuucaaaccucaguaaaguugaaagaaugggaucuucuagauucuucaguuguuauauuuaaccacauuuaucucauaugucuacguauuauccagugauguaucugaauaauaucuauuuaauuucucucccuagauauucuuuuuugccaaaucuuuugaaaauaaguaguagacaauuugacauguuuaccccagauacucccgcaaucuccuuuuaguucuucaccccaauauugugcuucagacuauuuggaacaguguaggaugcuggcaaguaccaaaacaauuaaguaaaaaagaaauuuguuaccaauaggguaacaaaugaccccuguugcaguuguaucucugcuccuuuauaggcagcaguuguguaagaggauauuuguggcuugagggcugugugucugugugauuucagggugcagccuagcuuaccccuccauguucugugaccuggccaugaaaucuucaacaucuaguguuuuaaagaagauagggccaggcgugguggcucaugccuguaauccgagcacuuugggaggccgaggcggguggaucaccugagguugggaguucgagaccagacugaccagcauggagaaaccccaucucuacuaaaaauacaaaauuagcugggugugguggugcaugccuguaaucccagcuacucgggaggcugaggcaggagaaucgcuugaacccaggaggugaagguugcugugagccgagauugugccguugcacuccagccugggcaagaagagcgaaacuccgucucagaaaaaaaaaaagagagagagagagaagacaggacaccuucagcuuuuguacucuccuaccagagaagauaaaugguggugauacuaauuuugacaaagaggagaaacuguguccucauggacacauaacugaaauaccuguaaaauacugacaaaagauggugaggacuggacucaguggcucaugccuguuaucccaacacuuugggaggccaaauugggagggucauuugaggccagaaguuggagggugcagugagcuaugaaugugucacuguacuccagcuugggugacagagugagacccugucucagaaaagaaaaaaaaaaauuaggggaaacugggcaaaugcuauauaggaacucuuuguacaaucugcaacuuuucucuaaauuuaaaauuauuccaaaguaaaacauuuauuuaaaaaaaaaggugaugaagagauaguguuagaaggagaauccaaauaaaauguuggcuuuuuacuuuuuguuuguuuguuuguuuguuuuuuugagauggagucuugcucauuugcuuagacuggagugcaauggcacaaucucaccucacugaaaccuccgccucccggguucacgugauucucccuccucagccuccccaguagcugggauuacaggcacucgccaucaugcccagcuaauuuuuguauuuuuguagagaugggguuucucaaaauuuuuguauuuuuguagagacaggcugaucucaaacuccugaccucaggugacccgcccacuucggccucccaaagugcuaggauuacaggcaugagcuaccacgcccagccagcuuuuuacauuuuacauuuauaucaucuuuguaggaaaaucauaaaauagggaugaacaacaauaaauaauuaaaaccaccuauaauuucuuucuuuuuuuuuuuugagauggagucucgcucucuugccaggcuggagugcaguggcgcagucuuggcucacugcaaccuccaccuccuggguucaagcgauucuccugccucagccucccaaguagcugggauuacaggcaugcgccaccaugccuggcuaauuuuuguauuuuuaguagauaugggguuuuaccauguuggccaggcuggacuugaacuccugaccucgugaucugcccaccucggccucccaaagugcugggauuacagacaugagccacuacgcccggaccaaaaccaccuauaauuucuugagacccagagaugaccacugccaacugccagacuuuuuucuacacuauaguuagauagaaagauagaauuuagaaaguaaaaguggggucacaaucuaacacugguuccuuuucugcuuuccuuugcaucuaacacaacauugugaucgcuucuuugccaauacauuuauauauauauuugauaguucccugguuaaauuucuauauauuuuaggauaauuguuucuuaucccuucaaguauuaacuaguuuacaucuuuucacuguuauaaacaauauuacauuuguuuuuggaacuaaauguuuuaugcauauccauuaguguuucuuaaaaauggaauugccgagucagagggucuguucuuuuuuuuuuuuuuuuuuuuuuuugagacagggucuugcucuguugcccaggcuggaguacggugacaugaucucagcucacugcaaccuccaccucccagguucaagugauucuuaugcccagccucccaagcagcugggauuacaggugugcaccaccccaccuggcuaauuuuuuuguauuuuuaguagauacagaguuucaccauguuggccagguuaggaucuguucauuuuuaaguguuuuuuguguuuuuuuuuuuucuuuuuguuuuuugagauggagucucucacucuguuacccaggcuggagugcaguggcacgaucucggcucacugcaaccuccgccucccggguucgagcaauucuccugccucagccuccccaguaguugggacuacaggcgugugccaccacggucggcuaauuuuuuuugguauuuuuaguagagaugggguuucgccauguuggccaggcucgucugaaacuccugaccucaagugaucuaccugccucagccucccaaagugcugggauuacaggcgugagccagcgugccuggcaaguauuuauuuuuuugaauucuccccaacucugcgucguucuuuuguaucuuuacuaacuggagggcaaaaaaauaaaggauuuguuuucauuuguauuuuuuaaaugauuagagagguuuccauuuucuguuuugcuaauuuuuacuuuuguaaauggccuauuugcaugauuuuccauugguauuuuaaaaaauugauuuguaggcguccucucuacugaucuccuuucagaggcagaucuggaaugcugaggccucucccucacccaucuccuuuuucccacugcagaucuuaaaucugacccaggccuugaaagacaacaagaguccccugcaccucguccagaugccaccugugauugucgagacggcccguucccaccagcggucuucuagcgaguccuacacacagagcuuucagagccggaagcccuucuuuucauggugguagcuccagaggcaggcagaggaaauauugucagagacuggugggaggaagccuggggaguggggugcaggaaaagccagagaagccgguggagagcagcaccuuuaagagcccucucucucugcuugccacccugcucagagcuuuccacccacagggagaagcacaaucaggaacagugagugcuccucgcccuucugaugugggggaggcuggagcuccaugcacguaguccagaugccugggaaggaacaucucccuuccagcaucugcugguagcaggcugggacagucccuuccuucccugaaacccugcucuauugcaauucccuauuauauucugcaucagaaaaacaaacaaaacaaaaacaacuuuaaaugcuuguagcagaaccccgggucaucucaugucagaaaccuuuaauccaggccuaaauuugcauagaccugacauucagcugccuugcaguugcuuccucccaugagccaagguggugucagagggcaacuggaugacucgcaguaccacagcacugggacagacagaagccacaccuuucuuuuggguuuuugccaagccuccuccaucucccaucagugcugugggcuggcugcaagccucgaaacaguucuccuggaagggagguuuuugcuuuacccccgccagcacuuccgcacacaaucauagagaaccucucugcucucugcuggccuacagcuugucuguuucucaagcagaggcaggaagagcuagucuuagcauuuauauuuuaauaggaaguugacucccagcauguaaaagugauccacgcagccggaguguaugccgggagcuaaguggucuaugggugaacauaucccaccuugcuuccugaguccuuggucccaaucuucucauuuguuccucucguuuuaaauuuuuuccccccaacucuuuugauguaagaguucaguuugucuucgggagugggucucugcaagggcucugggaugagucuuggcuuccaagaggacaggcuauuagguucuuggacuuuuuucugugcuaccgcugcugcuugguggaaguaacaggacguggauucugccucauaaguggcaguuucccuuuucucucugacuuguccuaggccgauuucucuauggcuucccugagaaaggugaggcccaaaggagagaggccuucaaacugucccagguccugcgcagcucagugcguaucuucuugcuuccaugugucuuuuccccugcugccucacuccccacccccacuugccagguguuugagccauuucuacaccaaagcaaaguacggccucaggagggaguaaaaagggugccaucugugucuggaggggcagcuguguucaugcccugugcuacuggacauuucacaauucuggcaccuugcgauuggucagucaaccucagaaaguaacuaucuugaagguuugaaaaacaaccaaagaaagggagugaggacuauggcugcauguccucugcuugcccggcugcagagcagagaugugcagcccucuggucagcugguccaggcugguccccgccgguccccuuccaguccagccaccaagaguccacuugucccgggcuuccaccuggcugacaggaagaauuucugagagcuggaugugcaugcccuguggacgaagguacagcucgccugccugccccaaucccagccccgacaaucacaugcagcugacucggacacuggccuugggaacaauguucgagagaacacuugccccuugacuguaggagccagaaggggacccaggugugcauagcucucuguagacauuuuuacccaaaccuguugguaaagugcccaucuggugcucaagagagccugggggucuaacagggagcccggcugccucaccuggccacagccuccacaccagaucuccacauugucuugauccagaccagcucugugaucagaaggaaauuggguccaguguaggagagagcugguccugggccuggcaggcaagagugugggcauccuuuccuggccuuucuccacucucccucaagccugugcucagguugccuugaauguggacucuggaagagccaggggcccagaaugccgggggaggcuucugaguggcacucauggaacaccgucccucugccagccauaggcccugccuccagugucagggaauggaggcugggcugcgagaguguugcugcccccugugucauucuucuaauccaauguagaaauuguacguaauguauuuaaaucaacgcaaauguaugaauaacaaauacaguucugaccuuuuuuguccaguuucuuugggggaaggaagacaaagaagguaggaacggaauuuugagggcaaagaaaccuguguuuccauggaauugcugagacguggcuccuggggcuauuucucccuaauaaaggaugauccagguccucauuuccaaagucccaaugcucugaaaaccaaaaguauuuucauaacccauuugaaaccaaaccugaccugaacuuacacugauaggaagcuauggguaauuaugauguguuccuuuuagugugauucuuuguugcagaaaugucaauauauuuuaugacaugguucccuacuagggauuauacaguauuugcugacuacuuccuaagagccaaaaauaaaaaaucugaauucc

SEQ ID NO: 192795 - RNA, 137402 nt, Homo sapiens
gcgcaguuaccaggcagcgggcuagacugaggcuaguuaccacgucagugagcugacagggaagguacccggcucuacugcccgucccggacgacucauccuggcggacugugcagucccacccugacuucggccucaauuuccaggaaacaggcuccuucucuucucccaucugcuaccagagccgggagagcugcucggagacgccuccggggugcgggcuggacaugagcagcggcugccgguccugggacuaggccccgccauuuuggauccgcugacaggucagcgaagucucuuccuagaguuccggugucgugaaggccgcccugacaucgcaauagggaauuagugggaagggcccuuaaauugggcgagccaaggugggcuaaggacgcagcggacaggaauaagacgagggaaggguuguugugggagggaacagggagguaugcaggggcaaaggucaugccucugccgcaggaggggcgauuucugcucucauuacugauccuuugcaggugcccaaaucuucuguuuucccaggcuugaccuaguauuuagcuucuccuuuccagcgcuuucugcauccugaagagcccaguacucaaaagcugaaagcaaaccuaaggagcauugugucuacuuuuauggguuuucagacuuuagaugugaaagucucucuagauucuguacagcgucuacuucuuugugauugccucacuaauacaaaggaacugcuucauuaauaaugaugaacuagugcacccuagaaucagguugucagcagagggacguguggaaggcuugagguuauagcagcgcagggaacugggcuaugagaaggcuucccucuuacaggacagcucagcugccagucugggucuguauguaaacacuauacuuaucuucugggccuguuuguuccuuuauacaaucuuucacaggcauucuuuuguaguguauguuuuuguugacauuuuucucucagaucuucacuaaggagaugaggcuuaaucauaaggaaaccacucuauuaugacauauuugacugacagcagagagagauauuugaauacuggcaaaguuugguauugucggccuauuauguuuagugggcaaaaagagucaugagagauuuucagccaauuguagggucagagccccagagugaaugauggaacauaacccuagagaguaguuuauggcacugugaugaccuuugauaaacugcuguguuguaaagcuauaaaaguccaccaaggguaacgaaugcuuuuagaaauaaggaauaguguagaugguguuuuuuaaugcacaauguggaaacuugugcauuaauucagguauaaaaggcacucuaggcccuguggaggauacaaauggaaaggucugcuuugggacugcucaguuaaugcacuucuuaaaaguaguagcauguaugugcaguggccuagcuagagcauguaguagguuaagagcaggaucaaccuaauaccuuuugguauguagugggcacucaauaaacguuaucucuaucugggauuaguuucaguaugugaucaggacuuguggccugcuuuuggcccuggcagucaggaacacuuugcacuuuugcaugaugagguaguaacaaggaggaucaaaaccucauagugucagaagagaaaacuauuuaggaucuuggaaugacuaacucaauuuuuccuaccuuuguccuuaugaaauugaaauuucauaauuucccuuuucccuuccuaccuucguccuuaugaaauugaaauuuuuguguguguugggagaagggggauggcauuauuuaugcuucaccuguguugauuuagauggaaaugguacaggaaacuauuugcauuuuaacuugcugaucuaaguuguagaauuccuccccucuccccgcccccaagaaaguaguugaacgcagcaaaugaaaugacauaccucaggagguacccagguuugaugauccugccuugcucacuugggccauugcccuguugaguugauaugcuuugcauaacaggcaaucuagucucuggguaggcagugugaucaauccaggauccagucauccucaguugagccuaagggugacuauagaggcaucaaaacguuuucucuuucucucucuuucuuuuuuuuaauccuaaaugucauuucuagauaggaauaauuuucuagauaggaauaauucccacuccuacccacaaaucagaaaauucauccuucaaauacaagucccaagcuuguauuugagcuucuuuuuaaugguguuuguagacaguauguuccagucuugacagugaugcucauuggcacagugggaacucaggcuauagacauaucuccucaguagcugggcaccaaucccaguuucagcucagaguucucaaaguuacacuacuauuuuauuucccucuuuuccagaagucaggaugacugccacuuucacauaauaaccucauugauaggguacuuagacuggcugcugugggcagcuaaagaggaagaagacacagcucuugcuuuugaggagacucuauuuauagaguacucacugcaaggaucacccuaaucuuuguaugacacuucucauugauugaucacacacuauaucccuguggcucugugugacugauuagaaugauucuguuguuggguuaauggugggauugaauuuaaggguguauguuuuuguugacauuuuauccucaggcuagaagagcuauguaaauauaaugagcugcuguuuagcuguuacucuuuuuuuuuuuuaauauuucaguauguucaacugcaguuguuuaacuaaaugaaaauauaauaaagcagugugcugauuuggaaccccaauaauaauagaagugaucauagaagugauuauuuguucuaguaguaguggaaauuacgauagaugcaauaguaguguaaaugaucauggaaguaugauggcaaaguaaugguuugccaaucauauaaaccagggguuacgagcucaugugccuaaaugccaggcagguaauguaaaugaguuaauugagucccaugggaauguauuaggauuaguggggacuguuguguacuggacaacccaugccuuuauuuuuuuuuugucuuuaauuuuaauuucuuuuuauugagacagggucuugcucugucaccccggcuggagugcagaggaacgaucacagcucacugcagccuugaccucugggcucaagugaucuuccuaccucagccucccaaguagcggggaacacagaugugcgccaucaugcccagcuaauuuuuuaauauuuuguagagacaaggucucacuguauugcucaggcugguuucgaacuccuagacucaagcaguccucccacuuuugccucccaaagugcugggauuuuaggaaugaaccaccaugcucaacccauuccuuuauuuagaagagccaacugcuccuuuuucagcagauuguuacuguuuuagagugcaggcacagaaugaccacucuuucuauuuuucaggagaaacuggaaauuuagaucauuguguuuucuaauuguuggaaacuaguuaaaaguauuuuuaagccuuuuucaggccaaagaaaauaugucuguggacuggauucugcccaaugguuacuggaugaugacccucaauaaacaaaaugggcaggccuuaugagacuuaaucacugcaguucucuauacauaaucacauagacuuuuuuucuuuguccuacucugccagcugucaccuuuguaccuugggugcccugaguggcuaaaagauggagugagauagagaagguuuguuuuauuuuucaucuccaagcuggcagaagggacagcuuuggacauauuaguagcuuaccuuguaaacgguuuuugagauacucucagaaucuccacagggggaggagauggcaugcuagagcugagguacccuggucacccgauuaucaggucugggaggauuuuccagugaugcauugucagggcaccagcuuuuuucccaguuuaaccuucuuuuacuuccacccuuuaaguaaauuucuugagcucaguaaguuguuuccuaguuuaguaacuuugguuauucucaauaaagcacagaacuaugauguguuccuaggccagcucuggaaauguuaaaagcucugcaucuuuaguguuucucuggcuuuuuuuuuuuuuuucucugauggagucuugcucuguugcccaggcuggagugcaguggugugaucuuggcucacugcaaccuccgccuccuggguucaagcaauucuccugccuuagccucccaaguagcugggacuacaggugcacgccaccacacccagcuaauuuuuguauuuuuaauagagaugugguuucaccauauuggccaggcuggucuugaacucuugacuucgugauccgcccaccucggccucccaaagugcugggauuauaggugugagccaaugcgcccagccuucucuggcuuuuaaagguauugagugaacauaaaccuuagaagggccuauugcugguccuuuagcucccuacuaccaucuaccuuuucagaaaguccaucaguuuuucuugguuugcccagcucuguauuagacacaaaggcaucaugaaaaagaaaaacaaaauugcgcuuuugccuuuggagaauuuauuugcuaguuggauaagaauaauuuuuuuuugagacagagucucucucugccacccaagcuggaaugcaguggugugagaucucggcucacugcaaccuuugccucucaggcugaagugauccucccaucucagccuccugaguagcugggacuauaggugcgugccaccacgccugccugauuuuuguguuuuuuguagacacaggauuuuacuauguugcccagaguccaguggugucaucauagcccauugcagccuugauuuuuuuuggcucaacugauccuccuaccuuaggcucccuaguggcuggaacuacaggcauguaucacuaugucccacuaauuuuuuuuuuuuuuuuuuuaauuuauguugccuaggcuggucucugacuccugagcucaaccauuccuccugcuuuggccuccuaaagugcugggauuaaagaugagagcuacugcaccuggccaaggaaauguuuaaaagugauuaagaggccgggcgugguagcucaugccuguaaugccagcacuuugggaagucaagggaggcagaucaccugaggucaggaguuaaaggccagccuggccaacauggugaaacgcugucucuacuaaaaauauaaaaauuagcuaggcgugguugugggcgccuguaaucccagcuacucgggaggcugaggcaggagaaucacuugaacccuggagguggagguugcagugagccgagauugcgccacugcacuccagccuagacgacaagagcgaaacucugucucaaaacaaacaaccaaacaaacacaaaaccaaaccccauaaaagugauuaagaaaaaaaaaaaaaccacuuaaacacuaguguacuaaaaacagcuauuuagagccaaagaaaauaaggcauauaugaagaauugacaguuacauuaaaaauuauauauuucacaaaaaugugaaugugcaaauaacacuuaaggagaugucaggaagauagacgugaaaaaagaagcauuaugauauggcugguagguaaauguggguucuuuuuaccuguauggaagguuuguaacuucugguagagaagcaaauauauauuaucaaaaaaagguuugccaguguggcucagaguuauugucuucuaugaagucauuuuucucaugagguggaugugugcuguaccacucuugaagagucagucuugauguuauuucauuuguucaucuaguauuuauugaucauuuuucuuacuaugugucaggcuuuggagauaaaaggguaaauaaaucauggucuuucccccugagauagagccugauagucccaugguggugauacacuaaauaaauaauuauaaauuaguauaagauguguuuauuuuuauuuucauuuauuuauuugaggcagagucucacucugucacccaggcuggaguacaguggcacgaucauaccgcaaggcaaccuggaacuccugggcucaagugauccuccugccuuagccucccaaguagcugggacaacaggugugcgccaccacaccuggccaauuuuucuuuauguuuuguagagacagggucucgccauguugccuaagcuggucuugaacuucuaggcucaacugaugcucccuccuuggccucccaaagugcugggaucacagacaucagccacuguccccagccaagauauguuuagagauaacuacaaagugcuguggguggccgggcaugguaguucaugccuauaaucccagcacuuugagaggccgaggcaggcagaucacuugaggucaggaguuugagaccaggaguuugagaccagccuggccaacauggugaaaccccaacucuacuaaaaauacucugcuaaaaaaguggaaaaaagggcugggcgcaguggcucacaccuguaaucccagcacuuugggaggccgaggugggcagaucaccugaggccgggaguuugagaccagccugaccaacacggagaaaccucaucucuacuaaaaauacaaaauuggcccggcaugguggcgcaugaauguaaucccagcugcugggagguugaggcaggagaaucgcuuaaaccugggaggcagagguuacggugagccgagauugugccauugcacuccagccugggcaacaagggggaaacgcugucucaaaaaaaaaaaaaaaguggaaaaauaaauaaauaaauaaauaagugguuuuaagauuguucuuagaaccacugugauauucugacucccucauugacuuuuggauggaaugaguaaggguuuaucagguggacaagagugagaaaaaacauucagaauagaaagggagcuucauaugcaaaggcaaagaggcagcaaagaccaugacuuuaaaaaguaggaaugauguggcgugguggcccacaccuauaaucccagcauuuugggaggccaaggcaggcagauugcuuugagcucuggaguuugagaccagccugggcaacauggcaaaauguugucucuacaaaaaauacaaaaaaauuagccaggcauggugacucaugccuguaguuccagcuacuugggaggcugaggugggaggaucgcuugagccugggaagcagauauugcagugagucaagauuguaccacugcacuccagccugggcgacagaaugagacccuguuucaaaaaaaaaaaaggaacuuuuuaacuuuuuagggucuuuuauuuuauuuuauuauuauuauuuuuugagccggugucuugcucugcugcccaggcuggagaccagugaugcaaucuuggcuuacugcaaccuccaccuccuggguucaagcaauccuccugccucagccuccugaguagcugggauuacaggccccugccaucaugcccagcuaauuuuuguauuuuuaguagaguggggguuucaccaugcuggccaggcuggucucaaacuccugaccucaguugaucugccugcuuuggccucccaaagugcugggauuacaagcaugagccacugcccccagccgaggggcuauuuuagacaaagaauauguguagcuuauauggggcaccaauggcugccacccagcuugaaaaauaacaucaccaaaacugaggcugcauguauguaugcccuucccuguuaguucccccacacucccugccgcuugccacuauucucaauuuuuuugugugagcuucucugggguauaguccuagaaguggaauugcugaaauauaggauaugaagugcuuuagcuuuguaagauaaugccaaauuguuauucaaauucauauuaauuuagauacauaccagccacuuggucugcauuuuuuaccaacuuaaaaacaauuuuuuuuuugagacagggucuuacucuguuguccaggcuggaguacaguggugugaucguggcucacugcagccuugaccuccuaggcucaagugauccucccacuucagccucucaaguagcugggacuacaggcacaugccaccaugcccuacuaauuuuuaaauuuuuuguagagauggaguuuugcuaugaugcccaggcuguucucaaacuccuuggcucaagugauccuccugcaucggccuccuaaaaugcuggauuauaggcgugagcaccuggccuuuuaaguauuaucagauuuaaaguguuuugcuauuucaggaauguaaagugguauaucauuauaaucuuauuuuguaauuuuccugauuauuaaugaagcuaauaaucuuuucauauauuuauuugcuguuuauguuuccuauucugugaaacaccuauucaucucuguugccaauuuuggggagggguuauaugucuaguucuuauaguuuuguagcaguuauuguauacucuggauauuacuccuuuauauuaguuauaugugccucaaauauuuucuucugguuugugccuuaucuuuucccucuuuuuuauguugucuuuugaacaggcauuuuuaauuuuaacaugguugaauucaccaauuuuuuaaagagguuuugcuuuuuguuucuuguuuagguacuucucccuuaugcugaguuuauaaaaauacucuccuguagccaggugcuguggcacacaccuguugucccagcuacccaagaggcuguuguggaaggauugcuugagccuaggaguuugaguccagccugggcaacauggcaagacccuaucucuaaaaaaaaaucaaaaagaaaauauucucauauauuagcuucuaagagauuucaaguuuugcuuuucauauuuaaauaaccugagauauauuuuugguauuccauuaaauaagaauacaauuuauuguuucuuuuucuccugcuuuuguuggauauagacagaguugccaagugauacagugacuccucuuuggauccuguugagguaacugggaugccacaaagcacuaggggaauguucuagacccagcuuuaaauggacagugguuucaaggguacauguuacucagagucucugggccaguggcuuaucuggcuaaggguguuaguugguauuuauuuaguuguucccucucuuauuuauuuuuuucuauuaauuuuucauuuguguggguacauaaugaauguauuucucuuguuauuucugacacaagauaaaucuuaaguucguuucuacuauacuuuuaugagguuucugcaggccuuuaugaccuugugacaagggauuucuuggccauuggcuaccaggcagcaagugguucaucaguuucccaucugaagcugaagggcacaacuguuuggagauucccugagugaggggacauacucagagaccuagaaggagauuaggcagcucugcauaguacuugaaaauaauuccucuucauucccuagauguuucuuuuuuuuugagacagagucucacucuguugcccagguuggaaugcaguggcgcgaucucggcucacuguaaccuccaccuccuggguucaagugauucuccugccucagccucccaagcagcugggauuacaggugugugucaccacaccuggcuaauuuuuguauuuuuaguugagguggcguuucaccauguuggccaggcuggucuugaacucccaaccucaggugaucugcccaccucagccucccagagugcugggauuauaggcgugaaccacugcgcccagcccuagauguuucuuuuuuacaaugauuuuuugcuuagaccuuugcugucuuagaaagugguuacuucuuuucuaaagggcuuauucauuuuuagucaaucagcugauuaaaauuuaaaaguaguuaauagguaauauauguuugugacacaaaauucaaaagguaaaaaagaauauacagagaaaaguuagucuuccuuucacuccuccaccacucaguuccauagucauccaguuucuuucccuggaggccguaaccucuuagcauuuucuuacaaguccuuccagagaccuagagcauauucaucuugccuacauaauuuaaggaaagggaaauaccaggaaagauuuaaucuuuucucuucugauacuuuaaaucauuuuugaauauaucuuucuucuauuucuaaguucuccuccuccucagaagagagcgugguuguacauucauaucauugacacuucucagaagagaacguuguuguguuccuagagcauuuggaaagcagauagucuucugagauuaaccuaguuuuuuaaauugucauuaauauaaaucuuguguuggauucccuuguggacuggggagcugucaugggcauggacacauuauuauuauuauuuuaagacagagucucgcucuguugcccaggcuugagugcaguggcacgaacgcgguucaccgcagccucaaucuaccggccucaagcaauccucccaccgcagccucccuggcaacugggacuacaggugugcaccaccacaccuggcuaauuuuuguauuuuuuauagagacaggguucgccauguugccaaggcuggucucgaacuccugggcucaaaugaucugcccaccucagccuuccaaaguguuagggauuacaggugugagccacugcgcauggccccuggacaaaauuuguaccaguuucuuuuuccuuuaucauggugguuuucaugcuuuucacuuucuuggggggccucaucuuaugcaaaauaugcaaauugagcuacuugcuagguacauuucuuucucuauuaucucuggcugugucuguuuuuguaucuauuccacuaaacuguauaaaugccucaaggacauaaauuauauaccucuuaucauuauuaauguuuaauuauauugauaguacaguaauacauucucuuuguaaaaaaaaaaaauuuuuuuuuuuuugggauggagucuggcucuguugcccaggcuggauggaguacaguggcaugaucucggcucacuuuaaccucugccucccagguuccagcgauucuucugccucagccacucgaguagcugggauuacaggcgcccuccaccacaccugcccaauuuuuguauuuugaguggagauggguuucaccauguuggccagguuggucucgagcucagguuaucuaccugccuugacacuccugaagugcugggauuacaggcaugagccacagugcccgaccuucuuguaaaaaguuaaaauauuacagauccagccugggcaacaaagugagaccccaucucuacaaaaaguacaaaaauuaguuggguugguggugugcgccugaagucccugcuacucaggaggcuaaggcaggaggauugcuugagcccaagaguucaagucugcagugaggcaugacagugccacaggacuccaaccugggugacagagugagaccuugucucaaaaaaaccccaaaagacaaaacgauuacagauaaggcucaaguauccucugauugcacccuguuuucacagcaccuucucuaggaauaauuaugguuauaaguuuggguauauuagcacagaccuuuuauuuuauauuuacauaucauauuaaugcuuucuugcugucaguuaauaugaguuuucagaacuuuucaaaggucuugucacugucacuguccaguuuucuggagcugacugggcagauuggaugcagucauuuguuuauauuuauauuuauauauuuuuagagauagugucuugcucugugacccaggcuggagugcaguuguggggucauagcucacugcagccucgaacuccugagcucaagugauccucccgccucagccuccccaguaacuagaacuacagguguaugccaccaugccuggcuaauuuuuuaguuuuguuuuuuugguagagacugggucucacuguuugcccaggcuggucucaacuccugggcugaacugauucuccugccuuggauucccaaagugcugggauugcaggugugagccacuucaccuugucuggaugcagccuuuacgcugacauugcaacugugguucuaaaccaacacuaugcuuccaacaaccuuuauucuuuucuuuaacuugaaucuuuaaauucaaguuaaauuuuuauugaguagauuaaaaagaacaaagggaagacuauauacuuaggagagagcgagagagagugucucgauaugcugcccaggcuggucuuaaauuccugggcucaagcaauccucccgccucguccucccaaagugcuaggauuauaggcaugagccaccaugucuggccagaaauauuguuuuuaacaagcugacauuacaguuguaucuguguacuuaaaggcaucauaggacuuugggaacaauugacuuugaagaauuugacaugcuuccugaggauuguugaggugccuuugaaaaauguucuggauugacucgcuuugaguuguaucuugaacuaccuugaacuucuaaagacccccaggagagccagauaguuggauucauaacauaagauggacuucaucucauuuuaguauuacagauuuuuuuuuuuuuuuuuuuuuugagguggaguuucacucuuguugcccaggcuggagugcaauggggcgaucuuggcucacacaaccucugccucccagguccaagcaauucucccaucucagccucccggguggcugagauuacaggcaugcgccaccucgccuggcuaauuuuuuguguuuuuaguggagagaggguuucuccauguuggucaggcuggucuugagcucccgaccucaggugauccaccugccucugccucucaaagugcugggauuacaggccugagccacugcaccuggcuaacagauuuuaugaguauagaaaauuuugguacuggccaggugcaguggcucacgccuguaaucccagcacuuugggaggcccaggcggguggauuaccugaggucuggagcucgagaccagccugaccaacacagagaaaccccgucucuucuaaaaaaaauacaaaauuagccagauaugguggcgcaugccuguaaucccagcuacucaggaggcugaggcaggagaauugcuugaacucgggaggcagagguuguggugagccaggaucacgccauugcacuccagccugggcaacaagagugaaacucugccucaaaaaaaaaaaaaaaaaaaagaaagaaagaaagaaaaucuugguacugaaaaguuaaaucacaauucuaaccuuaucagguacugauuuuuaaacuuggguaugcuuuggguaaccaaauauuaaccagacuauuaucuuaacuguuuugguagguuugccaagaugguggauaagaauauuuacaucauucaaggggagauuaacauugugguuggggccaucaaacgaaaugcccgauggagcacccauacaccacugguaagugggaaauggauaaauagccuggucacuaaguuuuuauaggggaucuguuggcaugguuaaaagaguaaucaaauuccuaguaauaaugagaauaguaggaauucagaguuguucuugauaucuuguuuuuuuguaucccaacuagcaucagauauauaggcuaucuuuuuuucucugggacccaaaagaugacaccauucuucuucuaaauauuuuuguaaacagcuuaagcuaguccugugcuugggaccucuuuaguaugccuaaaaguaucagaaagauucuuuauuuucuaauucuuuagggcuauaauuagcuaucaaauuuauuuaaaucaggguaguuauugauacauagaacaugacuuagugaugguacuccuucuuggggguucagcaaacuuccauauauagaguaggccauaucuuaccaaucagaugaguaagaaacuuaccuguuauacaguuggcuuucuuugcuauauauguuugaggacuuuuuuuuguagaauuguguaaaacaauuuuuggcccaguuguaaaagcaaguuuagaaauugccaacuugggaguuuauaugaacauaguugguaagugcauuuggaaauuucucaaguucuuucauaaaaauguauugauuuaaaagugagcauggcaucaggaauaucuuugaaaugaauauguaugaugacauaguggguaugaaaagggagagaagacagaauaauacacauauaaaggaccuggcaaucuguaguagcuugaguguuauggugaugauauagauuagcacuuaagaauucacuauuuuguauaagcccagaguaucucuacgaaauaagagauuaggguacagaaaaauaugaacuauggcuaauuuucuuuuccucagaaggaaaacuuaaaugauuuucugauuggauucauagaaagagcccuugaucuguccuuuauuuuccuuuuccucuuuuggcccaauaaugacuuacuuuaaucuauguguucuacaggaugaagaacgggauccucugcugcauaguuucggucaucuaaaggagguuuuaaacaguauaacagguaagucuccauauguauguggauuacuaaucuugguaaaaaauauguguuugauuuauugaaaggauagacaaacuuuuuguauaaaggacuuuauaguaaauaauuuaggcuuugugggccauacacaacugcaacuacuuaacucugccuuuguagcucaaaagcagccauagauaauauauaaauaaaugagaaauauauauuuucuuuuuguuuauuucauagagacagggucuugcuauguugcccaggcugguuucaaaugccugagcucaagcaauccuccugucuuggccucucaaaguguugggauuccaggcuugagccacugugccuggccuauauuuuccuuucuucuuuuuuuuuuuuuuuuuuuuuuugagguagagucucuguugcccaggcuggagugcagugucaugaacucagcucacugcaaccucugccuccuggguuuaagccagucuccugccucagccuccuaaguagcugggauuacaggcgcgugccaccacaccugccuaauuuuuguauuuuuaguagagacgggguuucaccauguuggccaggcuggucucaaacuccuggccucaggugauccacugccucggccucugaaagugcugggauuacaggaaugagccacugcgccuggccuauauuuucuuuaaaaaaaagaaucugcaagccagauuuggcccaugggugcaguuuuccaauccuugguuuauugcauugguuucagucuucaugaucuuucagucuucauguguucuagaaucauuugucccuuuguuugcccccuauuuuccuaaucacgguaaccuuauauaauauauucauauguuuagaauuuucaaagccauuuucacauuuauuaccuuauugaacuuuuauacaacccugugagggaggcauggcagcuauuguccccuuuuugugaaagaaguuaaagcccagaggaguuuaaagugauuuagcugaggucacacuaauccuaagagguggagucaaaacuagaauucaggccucuguugccugguuuagggcucuuugcucuauauugcuucuguacaugugauuagaagagaauguacacauuaaguaccuuauauuuguguguguguguguguguguguuuauuuuauguauauauauacacacacacacacacauauacacuggcaggaaaggaggaaagugucaaaaccaaggggauguagauacagacugaaagggacagccucagagcuauguuccuuuguugaccacaaagggcuccugcaguguauaacccuggaaugcuuuuggcuagugacauaugucagacuguaauuggauaguguuuaggcuucugcaaauuaaacaaacaauaagaaaauuucuucuuuucauuagaaauaugggagaagaucuggagaaaaaaucuauuuuacuuuccuaaacaugggcuaaaguuaucuaagaguucccuacauauuuucuuucuuucuuucuuuuuuuuuuuuuuuuuugaaacagugugucucucuguugccuaggcuggagugcaguggugugaucucggcucacugcaacugcaacuuccgucucccagauucaagcgauuuucgugccucagccucccaaguagcugggauuacagacgugcaccaccacacccgacuaauuuuuguauuuuuacuagagacggaguuucaccauguuggccaggcuagucucagacuccugaccucagaugauccacuugccuuggccuccuaaagugcuaggauuacagacgugagccaccgugcucagcccauauuuucuuuuugugcaguggcgugaucucagcucacuguaacuucugcuucuuggguucaagcaagucuucugccucagccuccugaguaacugggauuauaggcgugugccacuaugccuggcuaauuuuuguauuuuuaguagagaugauguuucaccguuuuggccaggcugguguugaacuucugaccucaagugauccgcccaccuuggccucccaaccauauuuucuuuaaaggagcaaauuucacucaauugaaacagcuuggaaauguuagcuaagaaggaucaaguauagaggaggcaauuguugacuaguuagcagggcaaaugcugcuacuagguggcauguucuuauuuuauggccuguaccgacugguacuugagugcuuuagaauguuggcuacuugcacagauuuuuuuuuuuaauuuuacagauaaagcuuacauaucccaauuagaaaggaaauauaaugaauggagauuuacaguucuuuuuguuugguuuugaauucagaguacugucuucuuaagagauauuaagaggaucaaacaaguuaauauaauuggaaacacuugguaaacaucuuauacacagugaaggauuguuguuauaagugacugggaauacccuaaaaugacugagaucacccuggccuuguaggccuuuuggucauucugcaaaccuugaggagcugagguggugcugcuauccugacagagccacauuuccugccugcuacugaauccagaucccaugcuuauuuucuucaugcuaacaugucccaagauuuuaccucagagaccauaccuguggugaaugaugcagucuaggaauuguagacuauuuaagagcuaucaaaguugagucugacgccugauuuccuuacguccuugggucagaaauccagccagauuaucugcucuuggaacuaguaaaaccagaguguguucaggagccauuucucucauuggugguaggaacaucucuggguguugcuaagcuuuccccuggagugagagggaagggaguaguguuuuccaaggccaacagcuguggcaugucuugaaauggugccugccaagguugcuacauuguucuugguuuuuagcauauuaccugccugagaaaaugacagaauagaccuaaaauagagcauuuauggucuucauauugcuucugaccccacacacagugccggcucccaggagcagguuuaugggucagcugucccugugguccuggacucugcaacccaugacuaauuucuuguuucuuuuacggaaacaaacagauuuuucugauuggcagugucaggaggacugcuuuccuggaagcuuauuaaugguaggaggcugggaaaggguuuuuaacuuggagagaaaacugaagggaaugugcuuguguuagaugaccaguuaagguguaccacuuagauuggaggagggauagcaggaauucuaggacuucuacccaguuucucaugaaacugacuuggacaugguccuuuuuugcaaaggguuucuguuugcauuuuucuaggcuuucugcuggcuugauugguaagacuaucacuguuggaaaugggugguucauuggacauugucaguaaaccaaaaugauuuuuuuuucucuuuuuguagaaagaaucuuuaaaauguauaaguacuaccuacacuacuccuccaggaauauuaucucauuauugugaaggaaauaaguccuuuucuccaguaagguuggcuaaguccauacuaguuuuucucacagauguaugucauuggaccacauuuacagucaguauuugccuaaacuguaugaugacuacaaggucuauagcauuuagaguaauaagauauucuaauaauaccaaauuugaaaagaggguugcucuuggaagaaaaaggguguccaagagcaaaguuugcauacuguuacuuuggauaaagcuuuagcuuaccaccagugagagagacuugacugcugucccucauuuggucuugaaguccucucaggacuccuuuuagauuauucugaaggaguuaaaacagaugugugguuaccaggggcugggaggggguauggagagugacugcuaauggcuacaggguuccuuuuugggguaaugaaaauguucuagaauuagauaguagcgaugguugcacaacuuugugaguauacaagaaaccacugaauuguauacuugaaaaggauaauuuuauaguaugugaaucauaucucaguuuauaaaggaggcaaauguaggcugcagaagugauggauuugccaguuuuuucucaggucucagaacuguggagggaagucucuguagucacugcugugcuuuggacccauuacccagcaaaggcagcauaaggcucuguucagcuucuggcccaguuuguccuuuuaugucucucucauuaacucaaggaagcacauggcuuuuauauuuaaauuuauucaaacuguaaucuuugacauuugaguuagcuuuuaguacaguuuugcauuuauaguaauauauauuauguauuuucucuauccccaaagaauccguuuuaaucuuuuccggaugcaaauuucaggcugucuugucccaucuucccucucuugcucucuuuccccuccccccacggaguguguuugaucagguguggcaggaauauccacugucaagcugcgcccuuuauauuagucaauauuauccuucuccccccucccugucugucugccccuuugggcuuucccaguugauuuauaauuuuggaauucucauuggagucuguaauacaguuuguucauuauuuaaccaaaaccuguuuaaugagcagagagaggcaauguaaauguuaggcauguugcagugauguaccuuugugcuucucagagcggguggguaguuaacucugugcugccugcagggcugggguguccuggccuuaggggcagaagggccacugccucucucuuacaucugcccaagcccugccauggguuuagauuccaaagacacauuuccuuuuauucuucuaagaaucuuuuggggcucuugcauaugggaguuaucuucagucucgcagcuagaccuugugguaggaucuguggcaugggauggggcauggaagggaaagugaaauaucaggauacuugauauugcucuugguuuuagaucugacaagaguagacaguuuaugggaaugcuucuagccaauauggucuguggucuuugaucucuuuguucccagacuagauaaauucuugcaagccuuaguucccuucauccaguauagcuuuauggaaagggcuauagucaguugugaguugugguguuugguuguagucauuugccuccagauauagucugucuuuguccuuggucuuuaaacuuagaucauuacaaagagauucuuuuccagaaaauuuuugguuuaaaacaggagaggaacagucuaaaaguaucacaaccaggcuaggugcagugacccacaucuguaaucuagcacuuuggguggccaagacagcaggauuacuugaggcugggaguucgagaccagcaugggcaacauaccaagauuccccccaucucuacaaaaauaaaaauaaaaaaaauuaguuggguaugguggcguacaacuguaguuccagcuacuuaggcugaggcgagaggaucacuugagcccaggaguucgagguuacagugacccaugauugcgccacuguacucuagccugagugacaagagugagacccuuucaaugaaugaaugaaugaaugaaugaaugaaagaaaguaucacaaccaaaaucuucucuuaugggaucaucuuuuaaugacuuacuuuaaagccuucagggccagggcuugaggaagacuucuuagggugugcgugugucuaugugcgugugagggugugguggugaggaguuugccuuuggagauuuagucccaggucuuuuuagcucugaggaccuaauguccaguuuugguuaucaggacugggguucucaguguaagacuaagguggagggccgggugcgguggcucacgccuguaaucccagcacuuugggaggccgaggcgggcagaucacgaggucaggagauugagaccauccuggcgaacacggugaaaccccgucucuacuaaaaaaauacaaaaaauuagucgggcaugguggcaggcgccuguagucccagcuacucgggaggcugaggcaggagaauggccugaaccugggaggcgcagcuugcagugagccgagaucgugccacugcacuccagccugggugacagagcgauacucugucucaaaaaaaaaaacuaagguggucuugaggcccaguauagguacccauauuaacuauaacauuguucuagcuucuuagaccuuuucuuuuggggauucuccaagauuuggauuccuucagggccuagcuuauugaguugcuucuaacugauauuuauugacuaucugguaugugccaggcauuuuucuuagguacuuaggaagugggucuguaaugguaaacaaucagucagacuuccugcccucauagccacugguuugacaggacuaaugacucuagcugaucauuccaaagcuaacauuuuguagccucuacuuuaugcuauauggucccuaucaggcauggaauggaugaccaugagugagagcaaucugcugccagcuuuucuuauuccugcucuuuccuuaaggaacaagccaaagaaauaaguaaaaacaauagcucauauuugcuuauuuggcuuucacauguaaagcuguuauggccagaguuuagcuauucccaaagacauugguggguugcauagcguaauucugggggauaggauauuucuuuacagagcuuacugggacagcagguuauggcgugcuugaguuuaagagggagaagcacgugccaggagaaaguggaugugucaggaguuuauuuaaguauaguuuauccuggacaaacacaccuguaggguacugucugucucaagcuuugugaauucagagucugagcuaggagguuugaguccaucuaaccuccagagguuugcagagaacauuuaaacagagucuggaagccaacuugggaggaacuaugacuuaacaccugucuggccugggccucuuagcaguagccgcuuagguagaaaagaaacuguuugagaaugccugauaccucaaguuuaaucuguuucauuuggaaaauggggagguguagagaaaagagauuuuaguagucauugucaggaaaaagauugaauaagaguauauuauaugugccaggcaugguggcucacaccuguaaucccagcacuuugggaggcuaaggcggguggaugacuugaggucagcaguucgagaccagccuggccaacauggugaaacccugucucuacuaaaaauacaaaaauuagccaggugcgguggcgcaugccuguagucccagcuacucaggaggcugaagcaggugaauugcuugaacccaggaggugagauugcagugagcugagaucgugccacugcacuccagccuggguggcagaucaagacuccaucucaacaacaacaacaacaacaacaacaaaagcgaguauguuauaugaaaaaaauuugcuggaguccuauugauuaagugccuacuuuuauuuuuuccuacaggggucuauaguuuagggaguaaaguaauauaucauuauuaaucagcaugagaagaagguugaaugggucaucagcuuuuguuccacuuggaauugagcuugugaauuguucaaggccuaaguaggaacuaaaagaaccaaaugugauaaaauuuggcagacaaauuuugugaagggcugaguguuaggaaaggcaaugggcacacuuaaaaguauccauuuccugugcccuguuuuacuuucuugguuuauaauauaaaacuauaguugaguaauacauuagaaugugacuugaauuugagucagacugacuuuggcaccuuagaaucucuguaacuugaguggccacagacuuguagacauuucagcacaguuagagugaauaaagguacugugauucuuuuuuuccccagggacuauucauauuaaaaggguagcuccaagaggccuauauuuugaugacuugauuuugccauuucuuuuuacuggggccuuccccagaugauuuaugaaugcucuucauuugacacuuuuaaaccaagaaguucuuccaaacauuuguuuguacucaagguuaggaaaugaagacucuugagaagaaacagcucugcauaaucuguccucucauggguucagcucucucuuuuucucuuccucauacccaggcacacuuagccaucagaacuaguuuccuggcuguugagggggcacauuuucuacugcauguaucagaaaaggaauuguguaaaaagagggaaaagcauucuuaauaguuuagcucucaaaaacagagaaaccuaauuucuuuguagcaaagguuagggggcaguguaacagugugguuugugguggguaucaaaguugcugguguuuuuauugcauuuguccucuuuagcacagcuaccucuugaggccugaaacuucugaguauaugcccaacuuaccaugacagcagucagaugaguaaaaagaaagccagcugcuguuuuuuuuucaaacaaggaggcaggcagagucccuuccugcuuuuccacccauucaaacucaggacaagugccaaaaggguuucagaagaagccaaaugcuugaaauucaauguguuguuuugauuaggagagauagugaagaguuugucucagccuugccccccucugacuaucucucuauguucauagauacuuaguugauaacccaguuucugaagugauaguggauauguuuauggaaagggugaguacauuugucuuuucucuccuggcaucuguuagaagauggaguuggcuauagagcaaaauggagauaagaucauuucagcucagaucacuucauuaagaaaggguaauagauggagagcaaugacuacuuuaggcucucaguuuuacucuaggaaaccaggagauaauuugcaccucaccaguuuaggggccuuuauuccuuuccuuuauucuuugaagauccuaaagaacuuagauggacaagcacuucuggcugucuguuggcuggguucucauggcaugucucuucuguaacaucagcauucuguuaccacuguuaccacuguaggucgaguugugaagggcugccacaugugcacagaucacaacugaccuuuccuuguuccacgcuuauugagcaauuacuugcccguuuguggaacucacauuauugucuugcauuucuggcccagugugaagugggggcauccaggaaguggccuaauggacuguacaucagagggcaauaaauuggcauaugauuugguggaaaggcagggccagauguagugugggagcuagaguuuuucugcagucagccaugcagcuugcuuccagguguccuggaaagcagcuugggaacuagaggguaagaguaguugaggacauucacuggggaagaaaaggaucaaaagcacuucaguguuaucugggauuggcccugaauugaaaaaaaauccucuaaaaguagagggacaaaugagauuucccugacacugacagggacuuuuccacagauuauuuuuuguuuucaaguaaagugaguuauuguaagaaaaaaaaucuaaaauuugagagacccuugacaagaggauguagaaugagaaagccucauuccaaaugaguuuuugcauuuaagaaaacugguaccaaauugauuaaaugaaaugagagcugauaugguauuacaacugcccugggcuacagugguguuuuucagacuguagguugauuugcauuagugaauuacaucacuguaauggguugcauggcauucucuccaauuuuuuuuuuuuuuuugagacggaaucuugcucugucaccgcggcuagagugcaguggcgcgaucucagcucacugccagcucugccuuccggguucacgccauucuccugccucagccucccaaguagcugggacuacaggcggccgccaccaugcccggcuaauuuuuuguauuuuuaguagagauggcguuucaccauguuagccaggauggucuugaucuccugaccucaugaucugcccgucuuggccucccaaagugcugggauuacaggcgugaaccacugcacccggccuuuuuuuuuugagacggagucuagcuccaucacccaggcuggaguguaguggcgcaaucuuggcucacugcaaccuccgccuccuggguucaagcaauucuccugccucagccuucugaguagcugggauuacaggcacgggccaccacgcccagcuaauuuuuguauuuuugguagagacaggguuucaccauguuggccagguuggucucgaacucccucggccucccaaagugcugggauuacaagugugagccacugugcccggacugcucuccaguuuuuuaugaugaaaaauuuuaaacuuagcaaaaauugaaagaauaccauaaugauuacccauauuucacauuuagagucaaaauuacuaacauuuaggcauauuugcuuuauccguauauguguauuaucauuuuuuucaugauccauuugaaaauaaauugcaaacauguugacauuucaccccuaaauacuucagcaugaauccuaaauaaggauguucuccuacauaauaccauuaucacaacuaagaaacaacaauaauuugccaauucuaguuaauauccaguucauauuaaacauuuuccguuuguccccaaacuuuuauagcuauaauugguuuuagaaaccaaaauccaagcacaauucucauuucauuagguaguuaugucuuuuuagacguuuuauuuuauuuauuuuagagaugggggucucacugugucacuuaggguggagugcagugguacgaucauagcucccagcagcucaagcgauccuccugccucagccuccugaguagcugggacuacaggcgcaugccaccaagccuagcuaauuuuuuauuuuauuuuauuuuauuauuauuauuauuauuuuuugagauggagucuugcucuuucgcccaggcuggacugcaguggcgcuaucucagcucacugcaagcuccgccuccuggguucaugccauucuccugccucagccucccaaguagcugggacuacaggcgcccgccacugcgcccggcuaauuuuuuguauuuuuaguagagaugggguuucacuguguuagcccagauggucucaaucuccugaccucgugaucugcccgccucggccuccccaagugcuggaauuacaggcgugagccaccgcaccuggcccaugccuagcuaauuuuuaaaauuuuuuguagagacaggaucuugcuguguuucccaggcuguucucaagcucuuggccucaagcaauccucccaccuuaaccucccaaaauuguugagauuacaggugugagccacugcaccuggcccuaggcuuuuaaaagacaauuuucuccaccuuuuuuuuuuuuuuucuuuugcauuggcuuuuugaggacaccagcccauuuauguuuagaauguucuacauucuggauuugucuguguccuugugguaucauuuaacuuguuccucuuucccguauguuauguacuaaaaggauuaaaagcuugauuagauucagguuaaauauuuuuggcaagaguauuuuauagaugauacuauguaauucauauuauuacuauuauuauuaucaucauuaccauuauuuuuugagacagaguccugcucugucccccaggcuggaguacaguggugugaucucagcucaccacagucuccaccuccugggcucaagugauccucccaccucagccucccaaguagcugggacuacaggugcaugccaucaugcccagccaauuuuuuguauucuuuguagagacagggucuugccauguugcccaggccugucuugaacuccugagcucaagugauccacccaccucagccuaccaagguacagggauuacaggugugagcuauugcgcccagccuuauuucauauuauaucaccacaggaagcacauccugucagguuguccugcaauuguugauuuuuuuuuuuuuagacggagucuugcucugucacccaagcuggacugcaauggugugaucucagcucacugcaaccucacucccagguucaagugauucuccugccucagccuccccaguagcugggauuacaggcacccaccaccgcacauggcuaauuuuuguauuguuaguagagacagaguuucgccauguuggccaggcugguuucgaacuccugaccucaggugaucugcccaccuuggcuucccaaaaugcugagauuacaggcaugagccacugcacccggccgcaauuguugauuuuaacaguuuuguuacuugcuucuuauggugacugccauaucuccuaauuuugaaauacguuaauuuuucuuuuuguaauuuuaaguaaucugugaaguaauauuuuugcaccuuguaaauauccuguccucuaauauccuuuuaccuaaugguuauccacugauuaauauuugacugaaucuuuuauuucacuggucacagaaugauuuuucuaauucugucauuuuuuucuacauuuauuagcuagcauuuucuguaaagaacuauuuucccucaucaacuggaggauaaaccaauuucuucuaaaaaggcaggauaaaugcuuaauucauucccuuuaauuggcaguuuucagauucagaagugaguguuaauaaugaucacuagugguggcaaaugugggucugccuccuccuaggggcuugugaguauuuuuuaguguuuuacaauuaauuacagauauguuuuuuuccauuguuauuuuuggugcucacauuauuucaaguuuggccagugugcguccccuucagacugguuccuuugucuuuugacaugacaucuuugaacacuuccuugcuuucugguacaaucaaccagcaauaaaggggaaaaaagaauagaauagaaauuaucaguguaucuggccgagugugguagcucaugccuguaaucccagcacuuugggaggcugagaugggugcaucaugaggucaggaguuugagaccagcuuggccaacauggugaaaccuugucucuacuaaaaauacaaaacuuagccaggcaugguggcacgugccagcuacucaggaggcugaggcaggagaauugcuugaacccaggaggcagagguugcagugagccgaagucgcgccacugcacugcagccugggcgacagagcaagacugucucaaaaaaauaaauaaauaaaauaaaaaauaaaaaaaagaaauuaucaguguaucauacuuaagaaagauaaguauuguuuuucgcaacuuguuuuaguuagaaaccuguauuuucuggguuguagcguaagcuguaucuucuccuauccaucauggucaaaaaaguuugaaagcacugguagaaaguuugugauguacuccuguucuagcacugguuugaauuugucugucugcaauguuauuucaugggcaaggagucaaggaggauauugagucagggugcccuucucaccauuuucuugacauucugugaaggacucugugaggcaccuuagcccccuugacuuuugggaaugaguggauucuucaucccuaucaacuuugauuucaguaagacaguucuauuuagaugguuguuucuggaugaaucagcuuuugccaggcagagauuaauuugagccuauuugagucguuauaauccuggaaaauauuagaguaaguauucuuccccaaggaaauaagaauuguggaaguaauuaugacugauuagucacuuugcaccuuaucccuuuuaugugaugcuauacagauuguuuagacauaucauguuagacauggccacccuuuugaaucaucuuggugagcugagggaaucauuuguccucgaaagacuccaaaagagcaucuucuccaggaacuuuucuguuaguggaaguucaacaaauauuuguugauuacuuacuaugugccaggaauggaacuagguucuagggaccuaguuuucaaggagacugacacaguuccuguucucauaguuuauggucuagugggcuggugauuugagaagcucuggaauuugagcagacaacugggcacuaguuugaagucugccaguuuccacacgugaccucaggaaauuguuguaugcuuugguuugcugaaagagguucuaggauggucaaaagaauagcauugguguuguccacauugucugucccaccuccacccugugcccuagcccugccugcuuggcagugacccuggaaauucugugcauggcagcuucauuagcugcuuuuagggccuugaaugucuuauaguugauuagucuauuaaaaaaauuuuuuucaccuauaauauguucuaugauaugauuagucucuuuauauuggccuuugauuaaucagucugugcaucacagacugaccacaucacagacggaccacaacugaccacaguugaaccauaggauaaguuaucaauggcugauuguuuuuucuaauaaaauucaacuuugcauuugaguccucuuuggcuugggcuucugacacaauuuuuaggacauugaagucuacaggugcaaaacaaagauuuuuuuuuuuuuuuuuuuuuuuuuuuuuugagagggagucucacucugucgcccaggcuggaguacaguggcgugaucuuugcucacugcaaccucugccucccgggcucaaguaauuauccugccucagccucccaaguagcuaggauuacaggcacccaccaccacgccagacuaauuuuuguauuuuuaguagugacaggguuucaccauguuggccaggcuggucuugaacucccaaccucaggugaucugcccgccuuggccucccaaagugcugggauuacaggugugauccaccgcgccaggacuuuuuuuuuuuuuuuuuugagacagaaucuugcucuguugcccaggcuggagugcaguggugcaaucuccugcccucaagugauccaccggccucagccucccaaagugcugggauuacaggcaugagccacugcgcccagccaaaaacagauuuuaguagcuguuuaccuuauguugcuaaaagaaugaggaaagcuguuuuuuccagccagggucuaauagucccaguucacaaauaacaaaaguguuuuuuaguagcagccuacuaccuuuagcccaagggucucaugugaggaaaguaguaccaaaacccuuguaacuuugaacaggauuuagcuucauaaucaauaggacauuucaucauauauuugucuuuugaaucccagagaaagcaccuagaaguagccuuugggagcauugagaccucagagagaccguccccuuguguaggaauaguauuccuaggauuuucaaggguagaaagagguggugaggcagugaaacaguuaaacagugguuaagaacuuucuaaaagagaaaguuggagugaauguuggaguacaaauguaguccacagaaagaccugugaccugucauuugcuugaauggcuuaucguguucugaauuuaaagugcaauucuuucuccuuugccucuuuuuuucugggaugaaucuauauccaaguuacauuauuuaauaccuacuauagcuaaauacuuuuugugaccagaaucuguugacucugauaggauccuuguucccucuggccugggaaaaaaaguucuugguucaguccaccuggacagaagcauuguagggaaaauagucaaaggaaaauggacuucgguucucagacuccaaguagguuucauuaauccucccaagugagccaagacugcaucuuaaucaguuucauuucagggguuuuaaauaauguuucugggcugggcgugguggcucacgccuguaaucccagcacuuugggaggccgaggcagguggaucaccugagguuaggaguucuagaccagccuggccaacauggugaaaccucgucucuauuaaaaauaugaaaauuagccgggcaugggugugagcgccuguaaucccagcuacuggggaggcugaggcaggagaaucgcuugaaccugggaggcagagauugcugugagcugagaucgcgccacugcacuccagccugggcaacagagggagacuccaucuccaaaaaaaggccuggcgcgguggcucaugccuguaaucccagcacuuugggaggccgaggcaggcggaucacgaggucaggagaucgagaccauccuggcuaacacggugaaaccccgucucuacuaaaaaaacaaaaaauuagcugggcaugguggcgggcgccuauagucacagcuacucaggagucugaggcaggagaaucgcuugaaccugggagguggagguugcagugagcugagauugcaccacugcacuccagccugggcgacagagcuagacucugccucaaaaaaaaaaaaaaaaaaaauguuucuguugccaagguucuauaaggaagaaaaugaguagugcuugccuuugguagaacugcuuuuuauuuagagaaugggagauggugccaggguccuaaguaauccuggguaggccguaggcucaauagucaacaaaauggguugugugcauguaguaaaggaagguagagaaugggaaauauuuggguugguaauagucuaacaaaagcuccaaagggaagcaaaaaguuggcuacuagagguuguuuuacugcuauuuagaaugugaauucaucccuauuuccuuuuuaccuaauugguaucaggacauugaaucaaaugaacagauggugaauuuucuugaauuuuuauuuugaaauaauuucaaauuuaaaggugcaagaauaauaggucucccauauguccuuuugcuacuuacacacacacacacacacacacacacaugcacacacguauguauguauguauguauauauagacauaaaauuauuuuuuggcugggcacagugguucacauauauaauuccagcacuuuggaaggccaagaugagaggaucacuugagcucaggaauuugagauuauccugggcaacauagguagacuccaucucuacaaaaaauuaaaaagccagguguaguggcaugugccugcuguuccagcuacuugggaggcugagguaagaggaucacuuaaaucugggaggugaaggcugaagugagcugugaucaugccacugcauuccaccaugggugacagaguuagacccugucucaaaaaaagaaaaguacauaaauaaauaaauuuuucuaaaucauuugagaguagguuauauacauugugacuuuuuuuuuuuuuuuuucagacagucucgcucugucacccaggcuggagugcaauagcgugaucucggcucgccucccggguucaaccgauucucccugccucagccuccugaguagcuaggauuacaggcgcccgccaccacgcccagcuaauuuuuguauuuuuaguagagacaggguuucgccaugauggccaggcuggucucgaacucaugaccacaggugauccgcccaccucggccucccaaagugcuaggauuacaggcgugagccaccgcacccagccuaucaugaucuuuuaucccuuaauacuucagugcauauuuccuaagaacaaggauauucucuuacuaauuuaaguauaguuaucaaauucaagaaauuuagcauugauacaauaauuuacuauucauauuccaauuuugucaauaaacuuuuauuauuuguuuuuuuuuuccccuucagccaaggaucacaaauuacauuaguugucauguuucuuuagucuccuuuaaucugggaccguucuuuagcuucucuuuaugcuucaugacauuagcauuaaaaacauuuuuuuaaaauuuuuucagccagugguuuaugccuguaauucuagcguuuugggaggccaaggcaggaggguugcuugaggccaggaguuugagaccagcuuuggcaacauagugagaacucauugcuucaaaaaauaaaaaaaauuagcugggcaugguggcgugugccuguagacccagcuacacaggaggcugaggugggaggacugcuugagcccaggauuuggaggcugcggugagcuaugaucaugccacugcacuccagccugggugauuaagaaaacaaacaaaaaaacauuaaacaaaaacacuuuuuuuuuuuuuuagaguuauggaguuaucuguaacuccauaacuguuuacagagucugguggugggaucguagcuuacugcagccuagaacucccagccucaacugguccuccugccuuggucuuccaaagugauggaauuacaggcaugagccaccacagccagcugacauugacauuuuuuauaacuacagaccaguucaugucuguguucuuucuuuuuaaaaaauugauccauaauaauuauacuuauguauugguuacaugugauauuuugauacaugaguacaauguguaaugauuguauuuaggauaucuaucaccucaaacauuugucguuucuuuguguugggagcauuucaaaucuucucuuauagcuauuuggaaauauacagcaaauuauuguuaacuauagucucccuaauuuauuuauuucuuucaagaauauuucucauuuuggguuugucugauguuuucuuaugguuagauucagguggugugugucuaucgugaaucuguaauauauaccacuacugauauaggguccuucucaggguaucacaacugcaggugcuguucauuggugauacuaauuuugaucaucuggucaaguguuaaucugauuuauuuacuguguagauguuauuuccccuugcaacuaauaagcaaucuguagggaaacauuugaagaucauacuccucuuuaaacuuucccucuaauaccuaacauacauugauaauucuugccugaaccaauuucugguugcaguuauggugaaauuugagugguugcuuaaaauacuuguucuuagguggacacaaacugucuuucuagcuugcuucuguuuguuucucuuccuauaagaaacacaauugcauacccuaaagaucuauauuuuuuuaugucuaaaucuaauaacuaaaaagaguuugaaaauuggaaaaagguuuggcucaaugaggcuugacuuggaacuugguaauuuccuagaauggccacaucacccaguggaauuuguucuccacucaaccaacagcauaagugcuuuuucucuaagccagacugacaacagccaugugaaguggauucuuuuuuuaaaauuuacucccucuuuuaauaagugggauuugcuaugaauucaucauuauauuucagcuuuuguucucaaaucuauuuuaauagcuugauucaucuuauuaagcacuuccacuuaagcuuuaacaaaauccauaaaguuuggaaaugcccauuguccaggagcuuuaagagagaaaagguuaggagaaacguuuuccuauucuccuuuucuaucauuuuuuucuuuccuucccucuuauuuuucuguauuuuuuccuugugccuuuccuuucauuccuuugaagcaugauuaggaugcaugacugagccuccaaaagcagagagaaaaagaaguauugcuucuugagacucagguuuuuuauuguuauuacuacggagaauaggcuaaugauaugauaauuaugaccauuacuaaugaaugccuuaucagcuaucaguuguuucuucgagggaaccuugcccucaaaaaaaguggcuuacgccuguaaugaccagcacuuugggagggcgacgcaagaggauugcuugagcucaggaguuugaaaccagccugaguaacuagugagaccucaucucuacuaaauuuuuuuuuguuuuaauuagccaggcaugguggcacacaccaguagucccagcuacuugagaggcuaagacaggaggaucucuugaaccccagaaaucaaggcugcagugaguaauaauggcaccacugcacucuagccugggugacagaggagucccugucuuaaaaaaaaagagagagagagagagagagagaaauaaguagagacaaaagaaaacaacuagagagucagaaagaggaaaggggcagaagcaaagaacuuggggauggggaggcaaggguaggagagaaggacagagaauacagaacuccuaaaauaggaaaaugggagucagcucuaacauuuaccuuuacccaguccaguguguggguuuuccccuuucaguagaauguucuaugagauaggaugagauggggugaaugaaauugucccauccuugacuccuuggaucuguuuacauggaacugaagguuuuacccuguaaugugacuugauagccugauccuaguggguuggguaggaagaggcuauuaagugauguuuuuuggcuugcuagcauuaacagaguuauuuuuaaccucccauuucaaucucuucguuguucagguuccucugcuggcuaccaugagagcagucaaaauuagcaacuauauaaaaugaaguaccucuugucuccccagucacuuccaaaauaaacagggaguaauacuguccauauuuugucucacuuuacucugaaggcuagcaauagaggaagcauggauuaguguguagugauuuccaggcucugcccucuggacagauuccccucugagugcuccaguugagugacaggaccauguggcaggagugcagcuggaaguauaucaucggcagauuuggguuggguaaauauagcaggagcaggaugucagugugggagauggauuguucugggaaaggaaguguugucuuucgucugagaaacaauuuccugcacuucugggacuuuugcuuucuucuuuuucuuuuuuuucccagggcagagcaggaguuggcaggggauggguacacuugcugaauucuaucucuggaugucugcauguuucuacauuugaaguugggaguagagaucagaucuguuucagccaguuaggaaauggaccuaauaaauuaucguacccaugccuuaaguuucacuuuuugaaguuuuaaauuaaagcaccuaucugcuuaaagccucuuuuuaaaaaguuacuguucuuuuagugaaauagacggguugagaggcaaaaauaauuacguaaagaaaaucaacucuauugcaagucagacaugaggcaccagcuggcaggaaacagcugggauauuucugggggcuagacucuuccacaccagcacuuaacucuucaagugaucucuguuaucugagcuacuuaagauagcuaccuaccuuaccaacaaucugcauaaaauacuaaaucuacuaaauuaugugauauuuuacaauugacuagaacuuuauaauuuauaaagugguuuuucauuauagccuuucaauuuuagaaucuauaaagcacauaaauuauaaucuauaaauuauauuuuuauaaauuaucuauaaauuauauuuauauaaauuguuauauuauaacuuagacucauacauaaucuauaauagauuauuucuauaaacauauuuauagaagaguuguaaagaaguucucaucuauccaaugcccaguuuccccuguuauuaacaucuuacauuaauaugacacauuugucacaauuaaugaacaaauauugauucaucauuaauuaaaguccauacuuuauucagauuucauuagguuuuuacuuaauggccuuuuucuguucaaggauuccaucuaggauaccacauuacauuuagucaucacaucuuguuagguuccacuuggcuguaacaguuugccuguauucuuuuucuuuucuuuuuucuuucuuuucuuuuuuuuuuuuuugagacagagucucgcucugucgcccaggcuggagugcaguggcgcgaucuuggcucacugcaagcuccgccucccagguuccugccauucuccugccucagccuccugaguagcugggacuacaggcgcccaccaccacacccggcuaauuuuuuuuuuuuuuguauuuuuuaguagagaugggguuucaccguguuagccaggauggucucaaucuccugaucuugugauccacccgccucggccucucaaagugcugggauuacaggugugagccaccgcgcccggccgccuguauucuuuucaaguuucacaaaaacucacaagauagacugugccuuuauuaauauuccccuuuuacagauaaaacucagguuccagaaaaauuaaguaacauuuucaagguuauacaguaaaagcuucuuuuaaagugugauuaugauuuggaaaaaggcgaugagguuauuuauuugcuuuucacgugaauaagggcagacuuacagcuaaccuucaggugggccauuuacugaagaggaacaagagacagaggugagucuagcuuguuccuggacucuucugucuugcuggagacaaauuaacauuauuauuuuaaucacaauuauuuugggaaaaccccuuucucuuugauucugcuaugucuaccaaaggaacugauggcagaaaauccugaguuagccuuguucccuggcaacagacuucaggcugcuuacuggucccuguuguuggauaccagguucaguaggaaagucugcugagaguauagcaugaacacuaacccaacuagccuauuuccagcacgugugguguuaacuaucugggaauaggaacaugaguuuuuaaauuccagucucuaauuggguaggcugaaguucuggcuuggaguaaggagauucacagaacugcagugcuaagagauaguagaaaaauuuaaaaauucaauaagacauggcacuuaacugacucugaaugcucuguccggagggaugaguaaaggggagaggugagaggagguaaaguagcggguuacuaaugauccuagauacuauuaaaagauuaucacaaggagguggaaacuauugagguacaaaccaucagaucuuaagguaaggagucacucaucuugcccagagaaguaguagugaagauaguaccuggauccuaaaagguaacuuuuaaaguacuucaaccuaagaugacagaggguaggcaguuuauugauacccuuaacaaccacuuguuaguagagccauuuuaauuaaugggaaaggggaucauucuccguuuaugcuuuuauuauauguagcuaugagcauagaagcuguguuuggacccucuggugacuauugcccucuucuaguuguguccaggcacagguaaauucuugaggccaggaagggccuggcuuuaucuccaaaaggaagcuguggaaauagcaaugagcaaaacaaugagaaagagcuuuagaaaauuugcaaauauuguguaucuucauggcaugaugaagugggauuaggacaggggagaaaguauaaaccaccaauuauaggagucuuuaagggcuugggugacugaggccuucugcuaggaggcugggagguuguugaugacagcaaagauguaacagguauugaauacuagaggauagaccucauacucugaaaaugcuuuugccucaacaauuugaaagagaaauaugaaagacaaagugacaauaugaagaaugacuauucaaagugcuucuaccaguaagucuugucuguuggcaaguuuuaaccuguagguaggggaaaaacgugggaggaucucuuauucagaaugcaaaacaggagacagugaaguaccuguguuuccaaagaacuccgaauugagcugugguggaagaggaggaaauuucuuacuguggucuuguauaaugugaaaucuuugugaagucucaauagauguuaagucuccaaggaggggagacuuuuuagcugcuaaagaagcuuagguucagugagccuccagugggaauacagacauagacguccacugacauuucugcaaccaguuuuggugaguggaaagcaacuagguaaguuucacuuuuugcaagaaucccaagugacccuuugcacuauggacugagguaccugcuugucucuacaaaaacuauagaggagacacgacaggcuuuaacuggaaauuguucaugguuucuuagaagggaagcucauauccuguuaaagcacuuuagaaaaauaaagucaaauuagagauaagaggaucuuuacuuguauuuucaagagcuuuuuuaaaaaacugaagugaaaugcauauaacauaaaauuaaccauuuuaaagugaaacaauauaguggcauuuaguacauucacaauguacccuaucuaauuccaaaacauuuucaucgccccaaaaggaaauccuguacccauuaagcaguugcuccacacuuucccuuccccuccagccccugguagccauccaucugcauucugucucuguaaauuuaccuauucuggauauuucauauaaauggaaucauauaauauguguccuuuuaugucuggcuucuuucucuuagcauaauguuuuugagggucauccaugcuguaacaugaaucagcacuucaauucuuuuuaggauugaauaauauuccauuguguguguauaccacaauuuguucauccauucauucguugauggacauuuggaccauuucuuccuuuuggcaauuaugaauagugcugcuagggacauguguauacauguauuugaguaucuguuuucaauuccuuuggauauauaccuaggacuggaauugcuggguuguaugguaauucuauguuuaacuuuuugaguaacugccaaacaguuuucuauagcagcugaaccauacuacauucccaccaagaaugcaugaggguuccaguuuuuccgcauccuuaccaacacuuguuauuuguguuuguuuuguuuuauauagcuucaaaagcuuuugagacuggauaggacuuugaugauaaagcuccuuucaggucuuauggaucuucugacaugcuucucuccugaaauaacuggauggcucuucugggccaaauaagguauugagauuuuagcuuuuauacuaaaggauuacuuucuuccaaaauuuccaauaaacagcgaacacagauuuuacagauuuuacagguugccuagacagggucgaauucugacuugccaaaagaagagugucaguuacacuuugggucuugaaaguagaugaugguauuucugguuucauuugccaucagaauccuggaccaggcaauaggcuaggucuugcugacuauacagguagcucaguuugcuuacacauuaccagcuuaucuuccugcucacagaauaaccuucuggggagggaguuaacucuaauuccugauaaaugacuggcucuuuuuaaggugcuauauaaacugaauuuggauguuacuucgccacuacuuacaaugauacuauguacagauauuaaaacucuaauguucccaucuccuuacuguguggcugggugguuucuuauuuugaugucuucuacaucaaacuguugaguuccuaaguguucucuucuuaccccucucuuuuuuagucucucaguuucuacuucuugcaucuauauauuuugugauuugucuaauagucacugugauuaauguuuuaguuuguuuuucuuuugugaaaauuauuuucuucuugugaaaggugaaaauuaguuucuucuugugaaaggagaaaacugguacagaaaucuaggacgcuggaacuucuagcucucuccguuuuuucuagaauuguagcuuuccuucuuuuuuuuucuuugacuguuuucuccaguuuauauguugagugguagguuuuucuaacuuuuagaaaaaaauuauuuugcuauuuaauguguuugcuguaucuccuugaaauauuauaaaucagaauacauuuuaguguuuauugcugccauugguugcuuuaaaaaaaaagguugaaccuguuuucaaaguaaacaaaauuguagccucuacuuaccuuccuccuuuccccaccacaauacacaguguuguuggguuugcaaauucauccuaaccauuugaucaaagucaggcuuugaacaaggcuuuauagugagguguggugaaugacagguaugucuggauuuggccuugagagauuuggggauguaaaagcauaaggguuuuuuuuuuuuuuuuuuuuuuucugucuuucuuucucuucuccuaauguacuguggucuauaauagguugaguuguaacauucauuaaaccacuccucgcauucccuguuuucaaagcuuaucaggaugacuuugauuuaguuauuuggaaccaaaaaggcaguuuguggagccuggucuggagcuguguagcaguaauauaucagagaucagacuuaggucccagugggauuauuccucgggauuuauuugccuggaaguacacacaggagccaaaugguauguauggaaagcuuugcuggaaugcaaauuggacacauuuuguugggaccuguaggggauuuucacugcuucauaauuuuucaaagguuuguuauacaucagacagucacugccucuucuuuaaaucuuuaaauccccccucuuuuuccuguuguaaaggucagauuuuuuuugacaacugugugcaggaacaagauuugcuaaaucccuucauuuuuauucauacaaauaucggaauucagugagcaucaguuauuccagcauuuagagguaaggaaaacucagggagaaucuugugaaucucagcuuugugcuagacauauaucucuggggauaaauuugcugccucaacuuuaaccccuugacugcucugaugugagacgacacccuuacaguggcugccuuguaugugaaaccuacccuuaacuaacccccauuuauggcuguaggauauguaauauaauuacugggaggggacuguguuggacucuucugauggggccuuuuuggcugugacaagccuuagauuaguguuggaagagaaggacaauucauucccuccaguggagccccuucuuuaggcauauuuagcuuuuaaugguaucauaggcaauaaccacuuuuaauuugcagaugauucuuucucaaccaguagaugaaauaaugauaucaaaugguacauuuccccaucaaacuugcuuaguuugauguuauguuauuauguuaucgauugcuggguaacaaauuaccccaacaaauuaccucuccuacccaucuauugcuggguagcaaauuaccccccaaaauguggcagcuuaaaauuaaaaaacaaaaaaaauuucacacaguuucuuuuauuuuauuuucuuuuuuuuuuuuuuuuuuuuuuuuuuugagaugaggucucacuguguuucccaggcuagucucaaacuccugggcucaagugauccucccaccuuggccucccaaagugcugggauuacaggcaugagccacugcaccuggucuauuucacacaauuucuaagggucaggaaucugggagcugcuuagcuagugguucuggcuuagggucucucaagaugucagccagggcagcagucauuugaaggggugggcuggaagauccauuuccaaguucauucaugugguuguuggccagaggccucaguuccucacaaugugggccucucaauaggacugcucacagcauggaaacuagauucuccauaggugaaugaucugagagagagcagaagccacacuuuguuuucugacccaaccucagaaguaaaccucaggaguaaccaucacuccugcuauauuauauuagucacauagaccaaccuaaauacauaaagauguaaucacuggggacaucacugggagucaucuuggaggcuggccuugcaggaaguuaaauggaaauuuuuagauguucacugggacuucaagauugauuuuuuuaauuugaaaaauuuuguucuccccagucagcccugucucccugucuucucccaaaccuuuaugucucugaaauuguccaauauguauauggcaaauaucucuuucucuuccuuugcugucucagccauaagcgcuaguaaaaacuuuccguuuuucuaaagcaagccaguaagcaugaucgaucuaccuccucuacccguuuugcugggacauccauggcagcuggucaaaggaggcuucugcucaugagagcacuucaacuggauucagauaauccuuugugguuucuccaccuauuuacuacugauccucuaaaauuuggugcaaaugaacuagacugacuagaguuacaguguuaccauguuuuuuucagacugagauauauaaugauauaaugauaugagcucuuuuuggauucuauccaggaucuccaaaauggagauaaagaccuaaugcucgggagugauuuaaaaacgaaauuacggccgggcgcgguggcucacgccuguaaucccagcacuuugggaggccgaggcgggcggaucaugaggucaggagaucgagaccauccuggcuaacaaggugaaaccccgucucuacuaaaaauacaaaaaauuagccgggcgcgguggcgggcgccuguagucccagcuacucgagaggcugaggcaggagaauggcgugaacccgggaagcggagcuugcagugagccgagauugcgccacugcaguccgcaguccggccugggcgacagagcgagacuccgucucaaaggaaaaaaaaaaaaacaaaaaaaaaaaacgaaauuacuugucacuagauagauucaucugguccuuuguauaccagucagauaagagccuuaggaguuggccgcaugugguggcucacgccuguaauugcagcauuuuggaacgcugaggcgggcggauuacuuguggccaggaguuugagaccagccuggcuaacacagugaaaccccaucucaacugaaaauacaaaaaaauuaucugggugugguggcacacguuuguaaucccagcuacuuggaaggcugaggcaugagaaucacuugaacccaggaagcagagguuacagugagccaagaucaugccacugcacuccagucugggugacagagcaaagacucugucucagaaaaaaaaaaaaaaaagccuuaggaguuauuuacuauucuucaccuuucuaggacaagcaagucgauagccacagugaugaggacugcacaggcagacccuaaagcuaaccagggacacugucuugccucuguguuugguaaucauuccagcuaugcaguuucauugaugucuuucccuccuugguacauaccuuacucuauaccugauaauagaaauccuugugagaauauacuuauucagcucuuggugacaggagguggguggaaguguggggcagagaacaggggugagguuguuacaauggagaaucaguuuacuuuuucaaaaauucuggaagccagacaugguggcaugcgccuguaaucccagcuacuugggaggcuaaggcaagaggaucauuugagcccagguguuugagacuagccugagcaacauagugagacccuaucucaaaacaaacaaaaauuccagagcaucuuuggcuuccuaggaaauagccuaaggcuguaaauaaacccuggccucauauuccuguugucauuuacuggcguaguagacaauucauaacugggaaaauccuuuggguguuuuuuugauguagguuuuauagaaucagagagguuccaaaauuguguuuaacugauucuauagaagacuauaaaaguaacaaagcaggcaaacaagaacaaaaaccuuugugccauaaaaucacuauuuaggccaggugugguggcucaugccuguaauuccagcacuuugagagaggccuaggcgggaggauugcuugagcacaggagcucaagaccagccugggcaacauagugggaccccgucuguacaaaaaaaaauuuuaauuagcugggcgugguggcaagugccuguagucccagcuacucaggaggcugugacaggaggauugcuugagcccaggaggucaagacuucaagugagccauaaucaugccacuuuccagccugggcaacagaguaagacccuuucucaacaaaaacacaaaaaucacuguuuaccuucucuaacccuuaucauuauguaaacauaauuuaauaguuuaaucaguaugccuuauuauuauuuuuuccucuuauucauuuaguaucauuuuuuaaaguauauuuuuauaggcacuauagaaccuugcugaaauuggcugaggauacucuucaguggggccagaaguucuuagcauuauuucauacagaauuuuccaugcauuuaccuaauauauuuaucaucuuuaaugacauuauaaaaauacauugaaccagaaugccauagauuaacuauccuuuuuaaauuuugauucauuauauguaguagaaccuuaucucuguguugauaacaguuuuucuuuuucuuuuuuauauuuuuaauuuuuaauuuaauuuaaauuuucagacagggucucugucgcccaggcuggagugcaauagugugaucacagcucacugcagccuugacugccugggcuuaggugauccuccaucucagccucccugaguagcugggacuacaggugugugccuccacuccuggcuaauuucuauauauuaauauuuuguagagauggguuuuugccauguuucccaggcuagucucaaacuccugggcuaaagcaauccaccugccugagccucccaaaguguugggauuacaggcgugagccaccacacccagccugcuuuucuuuuaaauuauuuucucgaaguaauagucccauaaguagaguggguuuuguagcuaugcugcauccuauauugaguuuucuaacuucucuuuaauuuugcuaauuuaauugacaaagugaugcuuuuauaauuuguuucacauuucuuuaauuacuagcauuuucucaaguguuuuacuguuugggguuuuuccuauugaauuaucuguucuuaucucuuggccacuuauuggacagaaguuggauaggaaccuuucggauuuguauuacauguaucagguucuuucauagcuggauaguguguuuuuuauugccaagucucuuuuuuuuucuuucuauuacuaugagcuauucacugcuuuguuuguuuguuuguuuguuuguuuguuuuaaauaauacccagacuggucugagacuaugggcuauuucaaaccuaaauagguagugguauuuuuuuauccuuacagagaagugcaucaacuaguuuauuugcauuugaaguguagaaacgagagguccuggcugaacuuuuggcaugggagcaguguguguggagagcaggcuguccaugauaggaggggaguugaggacaaggcugacaccaggccuauaaauacccuaagguuuagcuuuguacuuugaaauaggaauuaggucacuuuuauugucuuccccagacuuuuuacugguuggcuguggagaaaaggcaucaggacuuuuagaggaaauguuacuguuuccagcucucagaaagguggaaagugcugauauuggucagcucuuacucuuguuuucucauuucuguuagacugaggugaccaaauggaaagcgugggaguggagacuugauauuuggcuuccuaaguaagaaguggaauucugaacagcgaaaggccuugccuguaucccuuugccguggcaccaugccuuggacagauggauggggagcuaguuacccagcaucugucauucuccuuaccauugacaaagguucucuuuuaccuuuaucauaggcugcuguguccagucauucuaacugggcuuucugcagagggacccaaaccccuagaacuuuucuuuuuuuuuuuuuuuuugagagggagucucgcugugucgcccaggcuggagugcaguggcacaaucucagcucacugcaagcuccaccucucggguucaugccauucuccugccccagccuccugaguagcugggacuacaggcgcccaccaccacgcccagcuaauuuuuuguauuuuuaguagagacgggguuucacuguguuagccaggauggucucgaucucuugaccucgugaucugcccgccucggccucccaaagugcugggauuacaggcaugagccaccaugcccggccccuagaacuuuuucuaagguccuaguuucuaguauucucuuuggccuuuccauuuucuucucuaaaauaagaaaauucuggaaucucugggacaaacaaacagaaaagaaaaaaaaauuuaaugauaaaaaaaauaagaaaauuggaccaaacgaucucucaaguaugauguauguauguacuuguuaauuaaagacagggccuugcugugacgcccaggcuggagugaguugcacaaucgugcaauacuucacuacagccuugaacuccuggguucaagcaauucugcuucagccucuccaauagcuggggcuacaggugugugccaccauucucggcuacuuuauuuuuucauauuuuuagagaugggguucucgccaguucugcccaggcuggccuugaacuccugccucaaguuuucuucucaccuuggucuccuaaagugcugggauugcaggcaugagccacuaugccuggcucaaaugaucucuaaagucccuaaaguccuaagauuuuuuggaguuugaugucuucccacacaaguuuggaaauacuuucagagggauucuauuccauaugaaugucauuacaauuuuaaugaaaauuuugauguagcaauauuguagaauauauuuuaaagagguaaauauacacagucuucugugcauuuugagauagucugacuuuauaauuuuccuuugucuuucuguuguccaguugucaguuuucagauaaauucugcuucaaacuuguuauguaaguuucuauugggcauuuaguuucaaauuacuguuuccaaaaucuucguauuucuuuaaauuuucaaucauucuuaaaaauagauuaauauugcaugaaugucaagagaaccucuucuauuuucauuuuaaaauuuuaaucauuaaaauauacugcagugucucuauauuaauuuaucugaagaugcaucaguguacagucaggugcugcauaacaacauuucgguuaacaauggaccccauacaugauagugggcccauaagauuauaauggagguaaaaaaauuccuaucacuuagugauguuguagccaucauaaugucauaguauaacguaucacucguguuuguggugaugcuguuguaaacaaaccugugcugccagucauauaaaagcauagcacauaaauuauguacaguauauaauacuugauaauaaaugaccauuacuaguuuaucuauuucauauauuauauaucauuguuuuagaauguacucuuucuacuaaucaagaaaaagaguuaacuauaaaauagcuuuagacaggucuuucaggagguauuccagaaagcauuauuaucauaggagaugacagcuucauggguguuauugcccugaagaccuuccagugggacaagcuguggagguggaaaccagugauauugaugauccugacacucuguaggccuaggccaaugugaguguuuguggcuuaguuuuuaacaaaaaaguuuaaaaaguacaaaauaaaaaauuuaaaaauagaagaaaccuuauauaauaaagauauaagaaaauauuuuguacagcuguaguauguuuuguguuuuuuuuuuuuuuuuuuuuuuuugagauggagucucacucugucgcccaggcuagagugcaguggcgugaucucugcucacugcaagcucaaccucccggguucacaccauucuccugccucagcuucccgaguagcugggacuacaggcacccaccaccacgcccagcuaauuauuuguauuuuuuaauagagacgggguuucaccguguuagccaggauggucucgaucuccugaccucaugauccacccgccucggccucccaaagugcuggaauuacaggcaugagccaccaugcccgggcuguaguauguauguuuuaagcuaaguauuauuauaaaaguccaaaagcuuaaaaaaauuuaaaaguuauaagguaaauuaugguaagcuaagguuaauuaaugaagaaagaaaaaucuuuuuaaaaauaaauuuaauguagccuaagcauaguguuuauaaaguuugcagcagcauacagcaauguccuaggccuucacauucacucacuauucacucacugacuuauccagagcaacuuccaguccugcaggguccauucauucuaaguacccagcacaggguugccauuuucuuuuuuuucuuuuucuuuuuuuuuuuuugagacagagucuugcucugucgcccaggcuggagugcaguggcgcaaucuuggcucacugcaaccuucgccuccuggguucaagccauucuccugccucagccuccugaguagaugggacuacaggcgccugucaccacgcccggcuaauuuuuuguauuuuuaguagagaugggguuucaccguguuagccaggauggucucgauuuccugaccaucugcccaccucggccucccaaagugcugggauuacaggcgugagucaccaugcccggcccauuuuguaucuuuuaugcaguauuuuuacuguacuuuuucuguguuuagauauacaaauccuuaccauuguguuaaaauugcuuacaguguauaguauucaauacaguaacaggcuguacagguuuguagccuagaagcaauaggcuguaccauauagccuagauauguaguaggcuauaccacguagguuuguguaagcauacucuaugauuuuugcacaacaaugaaaucaccuaacaaugcauuucuuagaauguaucucuguccuuaagcaaugaaugcauaucaguuaagccugugagguaggccugaggauguggaauagcagacaccaauauauccuaaucccaagaggcaacuucuuucaucucuuuuaguagauucuuuuggaauuuacucccauauuucuaauuaacaaguguguauugcugcuucuuaguuuuucagauuaaaggauagagcuccacucauuuguuuuguuucucugucaauauuuacaagagucaaguuaucuuagaacuggaagagacuucagauccuccagagaacuaaacucaaaaacugucaagggcuuggcagauaacuuaaaugaaaagaauagggaguaguauggacuguggcagacuagaauucugugccaucuaaggacauucaauucaguuuuaacucugcacauaucaaacaguugcaauauauggaccuuguuuggauagugauuuauacaacaaacuaucuuuaaaaguuuauggcaguuauagaaauugaauaauugcaaauugagcacuaacuaaaauuuuuauauuaaagcaauauuacucuuuuagaugugaugauaaugauauuaagguuaaagauguaugaaaugauaugauaggcaagauuugcuucaaaacaauaugggaauagaagggaauagaagggaaaaaacaagauaagcccuaaguugcuaauuauugaggcuggguuugggauauuugggcguuuguuagucuguuuacauaauuuacauuuauauaauuuugaaaauuuucauaagcuuuuuuuaaaagacuuauguggguaaaaccuugucuccuucgaagaggaauauuagaaugaggagaaaaggaauccagauuaagcgagaauagaggcaguucuguuagcuauacugauuaaggguugucaccagaaccuuacuaguauauuccauugaauaaauauguauuuguuauuauacauauuuauuuguuuggcauauucuguuaaguuuauuuguauacucaaauaaauacuuauaucuuaaguagcggacaauaacauucauuccaaaaugugguuucacuuauucucaauaaacucauuuauugcuauuaaaaaaauaaaacacaauauaauacuaagcaaaacacaucuauggaccagcccaaauuuguaagcuggcuuucaguuugugauuucugagucuauucucaccagcuuguuucacagaagaaacuaaaacuuaaaccaaggucacauagcuuaucagggggaaagcuagaacucaggucuccugauuccccauucauugcugcugcuuaugaaaaaaacugcccaacugacuuaaauaagaaagaaggguuaugguuuugccuggcaauugucuccuguuuccuaaccuugacuauuuuuuuuagaauauagguuugagauuugucuucucucuuuuuguaagaugauagggauaagagauucagccuuaaacuucugguagaaauccaggucuaaggauaguuauauuucuuugaaugauaaagaauuguaggccagacgcgguggcucacgccuguaaucucagcacuuugggaggccaaggcggguagaucaugaggucaggaguucaagaccagccuggccaagauggugaaaccccaucucuacuaaaaagacaaaauuagccgggcuuaguggcggaugccuguaaucccagcuacucaggagacugaggcagauaauugcuugaacccgggagguggagguugcagugagcugagaucgugccacugcacuccagccuaggcgacagagugagacucugucucaaaaaaaaaaaaaagaauuguaggccaggcacaguggcucacaccuguaauuccagcacuuugggcagccaaggugggcggaucacuugaggcuagaaguucaagaucaagcuggccaauuuagugaaaucccgucucuacuaaaaauacaaaaauuagcuggaccugguggcgcgugccuauaauuccagcuacuugggaggcugaggcacaaggaucguuugaacccgggaggcagagguugcagugagccuacgucgcacuacuguacuccagccugagcaacagagcgagacugucucaaaaaaaaaaaaaggaaaaaaaagguaauuguagcauuuaagcaaguuauaagcauaagacuuaagaugaggcaggacuggaaaaaugaaccccuugguucuauuugguccccaagugacauuucacugccacuaaaaauugcugcugugugugggcuuuaacauuuauuuuuaaaauuuaauucuuuucucuaaguccagagcacuaagcaagcagcauagauguacagacuugccagcuauuggggauguguugcuaaguagcugugacagccuucguuagaugcuuugcuguacaguuaucacuagacuuugcucccaggucuaauugggaaauaaggauucaggcaguuuuguuuuauguauguuuuguuagcaugcuuaauuuaaaagccuaauaaaccugagcugacuuuugaaaaaccauuucuguacuagcaaagauucacauagcaaacaucaguugaggagagauuacuagaaagcaccagaagaaauuagaaugacucuuguagauagauuugaauagucuuucuacuauuccagcuuauucucuucuuuuuuaccuucuuauacuacuccuguuuguuuauauauuuuuccacucagaccaaauggaagcagaagggaaagaaaugaucuuauugaauuccuuuggacauagaauuugaguccuucuggaccuuuucauaaccccuuugaaguauacucuguuuuccuaaagaacuugaaaauuuuauaaaccaaucacucaucaaguaguauaaaacucaggccuuuuauagaauuuuuuuccuuucauagguaaaaaguuguuagaacaaauaccacuuugaaauugaugcagguaccuggaaugaaagaguugaaacuaguaguuuuguuuuugguuuuugguuuugguuuuuuugagacagagucuagcucuguuacccaggcuggagugcaguggugcaaucucagcucacugcaaccuccgccuccugguuucaagugauucuccugccucagccucccgaguagcugggauuacaggcgcccaccaccacgcccagcuaauuuuuguauuuuuaguagagacgggguuucacuguguuagccaggccagucuugaacuccugaccucgugauccccccgccucagccucccaaagugcugagauuacaagcaugagccaccaugcccggccgaaacuaauaguuuuaaaaauguauucuagaugucgacuaguaaaggcuuugcuguuaucuauaccuagguaauguucuagacuagaugacaagucgaguccacaccugaguguugauuuugacuuuaaaaaauuaaauagaaaguuaaagcuauuggcuaaaauugugaguuuaucucuauauuuguagauccagucacacaguuuagcaucauauuauaucaugacauuaguucuacuuuuagaaaaguguaucuuuuagcuagaauaugugcucuuuguagucagggaccaugccuucuaaaucuuucagagauuaauaaauacucguauauuucguaagcauuuuggccucucuuuuugucucuacucaauauaggugguaauaauacucuguaucaggaacuuuguauguaucaucucauugaguucccccaaggauauuucaagguaauauuauccccauuguauagaagaggaaacagagguuccaaaaagugaagaacuuguguaaggucacauacuuaguaagucacagaagugggacuguaaaccuaggccuguuucacugauuauaccuccuacucuuaccucuacaucaagaucccuugagagcuuuggaauugucacuagaagucuugacuauucucauccucauuuuugguaaauaugaaacucauuuguucuguuguucuagaaaagcucuuaauguuuaaaucaggaucauggacuacuaucccccucuucuaagagcuuagauuaauaggggcaguauaacauagugguuaagaguguauauagguucuaaagccaugcagacuggcuuugaauacuggccucaccuugaugaccuugggcagguugcauaaccuugcuguacuuuaagugccuuaugaggcacuuaccauaaaaugaggaugguauggaauacuacucagcaauaagaaagaacuauugauacaugcaauaaccuagguggaucucaaagucauucugcugagugaaugauuccaguuacauagcauucuggaaaaggcaaaacuguggugaccaggaacaagcaugauugccagggguuggugguggggaaagcgugugacuaccaugggguaguaugaggugauuuuugaggagaugaaacuguucuguauccucauugugguagugguuacaugaguuaguacauguguuaaaacucauagauaauacgcuuccccaaggaauccauuuacuauacauuaauuuguuaaaaaaauaaauguaaaaagggccaggcgcaguggcucaugccuguaaucccagcacuuugggacgcagaggcggguggauuaccugaguucaggaguucgagaccagccugaccaacauggagaaaccccgucucuacuaaaaauacaaaauuagcagggcaugguggcacaugccuguaaucccagcuacuugggaggcugaggcaggagaaucgcuugaacccgggagguggagggguuguggugagccaagaucacgcuguugcacuccagccugggcaacaaaagcgaaacuccgucccaaaaaaauuaaaaaauaaauguaaaaaauggggcaguaacaaaaccuacacauaccuguguacuaccuacuauacaguacauaacuauauacuaaauuauuuuuauuauuguuauuuuaucauuguuauuaaaaguaugauauuaaauauggugacauucauuuaaaguaggauagaauaaacuuucacaccaucugcauggguauggucaguaaaugugagaaaaaugaguaacuguugagucagguggaguauguuuucacaugauuuggcaggggaucugagguuuucuggacaguggaggauuaggccuaguauuucuggaguaucuugcaacugacuucuugucuggcugcauauacaguucccuugauaguauucuucaacaaaauagcuuuggucuuagaagccacagcucuuuucacuggcuucagauuagaucugaaauuuggacugagcaaacuggucaaagaaggagcuggaagugguucuuauacuuggaagaugguagcuguucuguauaacagcuguagcuuccagaggcauuucuuccugccagccauagucucuggauuagacagugauagcaguagggcaagcauuauucaacagcuaaaaaaaaaguuaaggucgcaguggcauuguaguuacacuagcagugaaaaagagguucuaaagugaaaccaugaccuuuccaucaagugggguggugcuuuuguagaggaacucacaaccugaaucaaaacaaguuaaauaaaugguaaaaaggauucugaccuuagaaugcuugcuauguuaguuggcacuuacuggucuguauauucauuuuuaccuaaugacgccagaauucaggaagcaggggggaaaggggaauguuugugguuccugguacagggcauugguuuagcagugacuuaacuuuuccuaauuucuuuacaacagugacacuaaauuucaagcaaagcuccgucgucauucaguuugcuucuuuuauagcuuguuguacauaugugacuaaguuauugauugcuguugaggaacaucacucuuuuguggcuuugaggagacaaugccaaauugacuagccuauuguuuuauuuugguuuuguguuuuaguucucguuaauuaugcuaagaguaguuuguuaggacagugguuuaaaauauauaagagaaucaguauuuucuuuucuuuuuuuuuuuuuuuuaaguauuuauugaucauucuuggguguuucucgcagagggggauuuggcagggucacaggacaauaguggagggaaggucagcaaauaaacaagugaacagaggucucugguuuuccuaggcagaggacccuguggccuuccgcaguguuugugucccuggguacuugagauuagggaguggugaugacucuuaaugagcaugcugccuucaagcaucuguuuaacaaagcacaucuugcaccacccuuaauccauuuaacccugaguggacacagcacauguuucagagagcacgggguuggggguaagguuauagauuaacagcaucccaaggcagaagaauuuuucuuaguacagaacaaaguggagucuccugugucuacuucuuucuacacagacacagcaacaaucugauuucucuaucuuuuccccacauuucccccuuuucuauucgacaaaaccgccaucgucaucaugacccguucucagugagcuguuggguacaccucccagacggggcggcugccgggcggaggggcuccucacuucucagacugggcagcugccgggcggaggggcuccucacuucucagacggggcggccgggcagagacgcuccucaccucccagacggggucgcggccgggcagaggcgcuccucacaucccagauggggcggcggggcagaggcgcuccccacaucucagacgaugggcggcugggcagagacgcuccucacuuccuagacgggauggcggccgggaagaggcgcuccucacuucccagacugggcagcugggcagaggggcuccucacaucccagacgaugggcggccaggcagagacgcuccucacuucccagaagggguggcggccgggcagaggcugcaaucucggcacuuugggaggccaaggcaggcggcugggagguggagguuguagcgagccgagaucacgccacugcacuccagccugggcaacauugagcauugagugaacgagacucccucugcaaucccggcaccucgggaggccgaggcuggcagaucacucgcgguuaggagcuggagaccagcccggccaacacagcgaaaccccgucuccaccaaaaaaauagaaaaaccagucaggcguggcggcgcgcgccugcaaucccaggcacuuggcaggcugaggcaggagaaucaggcagggagguugcagugagccgagauggcgggaguacaguccagcuucggcuuggcaucagagggagacuguggaaagggagagggaaaggggagaggggagagguuaguauuuucaaaaaucaucauauaguacgugguuacacaacucugaauauacuaaaacacauugaauuguauacuuuaaaggagugaacuauaucucaauauauaaggggugaguuauagcucaauaaagcuguuaacaacaaaacaaaaaugccauaccaaaaaaaaaaucaucauacugaucugugaccuuccaauggaaggaauuaaacuaaacuuuucaaaauggggcuacuggcccuuaggcaagguccugagauuauccuaaaauuauggauuuagaguauuuaaugacuuuucugaagaauucuuagaauucaucuacuaagcaaauaaccauucauguaguuaugauguagucauugucaauuuuuacaagggaggaggauaaggaucaucacuaagacuaaaacaaugauucugaacugggugauuuugccccccagagaaagucuggcaauaucuggagacauuuuugauugucauaucucaggcaugcuacugguaucuaguggaucaaagccaggagggaugcugguaaacauccuacaaugcauaggacagcccccaugaugaagaauuacguggcccaaacugucguuagugccaagguugagaaacucugguacaaaauguacaucuauguuuucuuucaagaguuuuagcuuuuacauuuagaucuuugauccauuuuaagcuuuuuuuuuuuuuuuuuuggagacagagucucacucuguugcccaggcuggagugcagugguacgaugucaacucacugcaaccuccgccuccuggguucaagugauucuccugccuccaccucccaaguagcugggauuacaggugcaugccaccacacccagcuaauuuuuguauuuuagguagagaugggguuucaccauguuggccaggcuggucucaaacuccugaccucaagugauccacccaccucggccucccaaagugcugggauuacaggcgugagccaccaugaccagcuuuaauuuuuguauaugauaugagguagggguccaguucauuguuuuacauguggguaucgaguugucccagcaacauuuguugaaaaggcuauuccccauugcauggucuuggcauccuugucaaaaucaauugaccauaaauggcccugguguaaaauggcuaaugucuguaccuauuucuccuagaaaaagccuuacacagccucccugaggucuuagaaaaucuugaugacuuucuacugcuauggcugccuaaagaauaauucagguuguuuccauaugaauacugcuacaccugagugagaacagguuaaggauuacagugucuguaagccuccugucauauauucaggcagcucacaccacgcagcuucaguucuccaggcuaaggcauggcauuaaaauugugaaggacuucaaaaauuuaauccgacuuucuaccaaguacucuaaauuaucucaaauauuauuguuguuuuaugauaaaucucaauauacaaagcagguacccucucaguacuuacuuuuucaaaaauuuccuuagcuauucuuaucugaauguuuuaaauacauuauuuuguuuaauuaucaagccgaggagguaggguugugcuauuuucuuugucauuuuacagaugcagaaacugaggcuuagagaaguuuauuugcuauggucauaccaggacugggauuuuaaucuaguuuuuuuuuuacuccaaaggcauugccuuuagagagcacauaaugaauuauaugugaagucuccaucuucacauauaauuaaguucuucuaauaggaauaaaauaacugcaaaaauauauccaaacagaaaaaugguacauaagguuuaagcuuaagccaauauauacuuaaggggaaaaucuaaacuauauuuaagauucauuggccuuuuauaaucuauauucugacuuagaaaggggauauggaccguucuuugaauacuuacuuguuuuauagcuaaagagguccucacagucaugggccacaucguauguaauuuugaaaacauuacaacaugcaaagacuucgaaugccguaugugguucugguugcagcaucuaagaaagauauauauauuuuuuaaaucugagaaaauuuuggagugguaaaauaaaauacuuuccagucuuagaauauuaggauuuaggaacauaaucuucaaggugaaauuagguaaaaggggccgggcaugguggcucaugccuguaauucuagcacuuugggaagccaggguagguggaucacugagaucaggaguuaaagaccagccuggccaacacagugaaaccccaucucuacuaaaaauacaaaaaaauuagccaggugcgguggcacacgccaguaaucuugcuacuagggaggcugaggcaggagaauugcuugaaccugggagguggagguugcagugagcugagauugugcuacuccacuccagccugggcaacagagugagacuucaucucaaaaaaaaaagaaagaaagaaagaaagaaauuagguaaaaggaaaaguucuuccuuauguaguaguaaguaaauuuuuaaaauuuuauacaagccgggugugguggugcaagccuguagucccagcuacucagaagccugagacaggaggaucguuugagcucaggaguucaagaccagccugggcaacauagcaagacgcacaucucuuaaaaaaaaagaaagaaagaaagaaagaaagaaagaaaaagaauaaaaaauuagcuggguguggugguucauaccaaaauaaaaauuuuauguaaaacauugguuccagaaggauugagaucaggcauucugaucugggauccagcaaugggcuucaggagauuaaugaaccuucugaaauuauaugcagauuuguguguguguguguguguguguguguguguguguguguguguguacuugaucaccucagugaaauaauauuaagaggugaaauaauauuaagagguaccacuguacuucuaauucuggacaaaucuuucuccuagcuauagaaauuggaguccuggccaggugcaguggcucaucccugugaucccagcacuuugggaggccaagacaggcagaucacuugaggucagcaguucaagacuagccuggccaaccuagugaaaccccauagugaaaaauacaaaaauuagcuggguaugauggcacgugccuguagucccagcuacuugggaggcugaggcaggagaaucacuugaacccaggaggcacagguugaagugagccaagaucaugccacugcacuccaggcugggcaacagagcaagacuccaucuccaaaaaaaaaagaaaaaagaaauuggaguccuuucacuguguuucuuuugagacggaguuccguucuugucgcccaggcuggagugccaugacgcaagacucugucuccaaaaaaagaaaaaagaaaaaaagaaauaaauucgaguccuuucauuguguuucucuccuaaagagucauuucaauaaauuuguauugaauaucuuuuguaugccagacacuugugggugcuuuguguaauacaaacaugaucacuuuaaaugagugugaaguacuguucugggcaggugaaggguaaaaggagagcaucccucucaaaaugauggaaauaggaugauagguuugggggagagcagggaucuccagagggagagaaugaugaauagguagguuggauucauguuguggaugcccuuaaauaccaacugagcaagguuacuauauauauauacaauuaaaggauaccuaagaagaagccugaagacuugagauauagacugggcuuuaucauaauuagcuguguuacccuuagguaagugauuuuaccucucuugaccucagcugcacuacucaaacacacacauaaacacaaaugagacgggaaaugagcugggugucuguuuccuuacagcucuaaauucuguuauuccccuuaauucaguuuuaauagaagugggaaaucauucauugaagguuucugagcaugggaguucucuucaacagaauuacugcuguuucacuaccugguugcucuauuuauuaaugcucuuucuuccacccuuaugugauugcucugggagggacugucucuuuauuuguuuuuuuguuuuuuugagauggaguucugcucuugucgcccaggcuggagugcaauggcgcaaucuuggaucacugcacccucugccucccagguucaagcgauucucuggccucagccucccgaguagcugggauuacaggcgccugacaccaagccuggcuuauuuuuguauuuuuaguagagacgggguuuugccauguuggccagguuggucuugaucuccugacugcaggugaucugcccaccugggccucccaaagugcugggauuacaggcgugagccaccgcacccagccggggcugucucuuuagauaguuacugauguggccaaggaauuggccauuauuauuagcuuauauuauugagaacauggggauggucagguaucuauucuugaauuagaucugaagcuggucuuguuuccucauguuaucagucacugaccugugaacugauccauguguccacaaugugggcagcagguaagugcugacauuuugauggccacaucauauuucagggaucuaugagaaggucuguaaugaccauggaaagccagccaagaaucuccuugccauggacaaaugggagaaguuacuaaauuuagcggacauuaagcuguaaauuauuugaaagguggaaaaggauucuauucagagacuauccagaauuuccauuuacuaaucaggccuugugcuguagaggcuuucaucccaggaaaaguauugcuuucucucuuccucuuuccccacacuuuuguuccuguuauagugggaggaugauuuucagcucuuacuauaacauggacuucagugcauguugcuauuagaugccaagagccucaggaugauaaaaucugaggauucugauucugauucugcuauuuaaaaauuagaauaugagcugaguuugaauuuuuuaacuacagaaugauagagacauauaugaaauacaguacauuuuugcuuuuugaaaggaauuguuauagugauguucacaaaucaccaaccuuggcaaaaaaaaaaaaaaaaggucccugugagaaccgguguaaaucaauaagaaaaaagcagauuucccagcugggcacaguggcucacgccuguaaucccagcacuuugggaggccaaggcaggcggaucacaaggucaggagauugagaccauccuggcuaacacagggaaaccccaucucuacuaaaaauacaaaaaaauuagccgggcgugguggcgggugccuauagucccagcugccggggaggcugaggcagcagaauggcgugaacccgggaggcagaguugcaacgagccgagaucgcgccauugcacuccagccugacugagugacagagcaagacgccgucucaaaaaaaacaaaaaaaacaaaaaaucagauuucccaguaggaaaaugggagaaagacuugaacagacauucacaauagaggauaccuaaauaaucaguaaacauaagaaaaggugcucaacuucauuagucauuagggaacuucaaaaccaccauagaauacuacuacacauagagcaaaauagcaaaaaugaaaaagauacacaauaucaagugauagcaaggauguggaguaacucagacuuucauacccuaaggguaaauaggguaaauuggaaagcuggcugcaucuacaagagcugauuugccagcaauuacauuucuaagaauaugcccagcagguaaucauauauauguucaccaaaagauguuuaugagaauguuuauagcaguguuguucacagaagcuaaaaaaaaaaaaaaaaaagaggaaacugcccaaaucuccaucagaaauaaaauggauaaguaaaaugugaaaauucucauaguggaauacuauaaauaaaugagaauuaguaaacuacaauaucuuacaacacagaugacuuucuccagcauaauauugagugaaagaagccaauccauacccaaaagacuauaaaucaugcugcuauaaagacacacgcacacguauguuuauugcggcacuauucccaauagcaaagacuuggaaccaacccaaguguccaacagugauagaccggauuaagaaaauguggcacauauacaccauggaauacuaugcagccauaaaaaaugaugaguucauguccuuuguagggacauggaugaaauuggaaaucaucauucucaguaaacuaucgcaaggacaaaaaaccaaacaccacauguucucacucauaggugggaauugaacaaugagaacacauggacacaggaaggggaacaucacacucuggggacuguugugggguagggggaggggggagggauagcauuaggagauacaccuaaugcuaaaugaugaguuaaugggugcagcacaccagcauggcacauguauacauauguaacuaaccugcacauugugcacauguacccuaaaacuuaaaguauaauaauaauaaaauuaaaaaaaaaaagaagccaaaccaaaggagcuucuacuucaugaugccauuuauguaaaguucaggcagagaaaaucagugguuuaagaaguuagaauaaugauuaucuuuggagggauugcaacuggaagaagucaugauugggauuucuggguccuaauagugcucugugucuugaucugagugccgacuacaugagugguuagguuugcaaaauucauugaguuaugcacuuaaugguguugucuuauuagagcugauggaggagagagggcuucaauuugcacaacugaguaaucagcuaggcccagucacuaggugaacaacuuacugcuaccaaucagccuuagagcaggaaucaaacucaugucucagaaaaguuauuaauuacagcuugucuugggacuuccuucagagucacucuugaauagcugaaauaguaaauguuaaaucuguggaugcaaguguguaaauuauuuuagucaucagcucuaauaagauggccuuuggggaaaugaguauaaggucacgaaaaugaaauggcaagaaggaggucuacuauuucuucuguaauacugauuuuuaccccaucagggucaguccccagagguuguaaaugugaagcuuguucuuuuucuuuaguaagcugaguuuguggcuuuuuaaagcuuugcuucacuguucucauuuguaagugagauauugcuuguucaccucccauagcugaugaggagauucuugugcacuguauuuguugagauaaggcugguuugggguuuuguuuucaucuuuguuuuuuaguuaaaucauaaccuaguuaugauuuuuguguguccuuguuuauggaucuggaauuuaauucauuauuaguuguagaaugaaagguaagauuuuguuuuacucuucuccugaauuuucuccccauucuagaucuguuggcauaaaauuuuaaccagaagcuaauuuagugaugcugaguuaguccuagaaauuaguuucaauucuaguguuaauauagucuggguuucuaaguuguagaaaaaucucauuuuuugguucuugguuuucauuuguauaauuuagggaaaauacaaccaacuguauuuuaaacauauauaguccucaucuuuucuguugggcuugaagaguuguacuggguauuauggaacuggaaagaagccauguggauaguuacgguauuuagguggauuuguuguugguagaaguggugaauuggaaaagugauaggguacauauguuucgccuucaaggcaagucuauucuuacuguuugaugucagaguaaaaagugucaguagcugaaaaagacaaaagaaucuugacagagugggaaaagucgugccucauguucuauugaucaaaaggagguuauauuuucaaacuagcuuccuaagaugaaauugaagcuguacaugugcccuacuuauccuuguuuuuccugauuuugguuuuucagauuauuccuauuaaacaugauaugcugauuagcacugaauauuuuaggucugcuacgccuguauuaguugagauuccucuuaauuuguguuagaucucuguuaggucauuucuacugcuggcauucccuagacuagaggccugcacgcacauuuguauucuaaugaguauaagcacuagguguuuuucuuggcacuaagaaaaccuugcagcaucauuaaccuaggagagauuugggguuuacacauuaacuaugggagguugaucaguuuguggccuauacaccaagacuguucuuuaucacccccaagccacauuugagcagggauugaggaagggguugauuuuucuguuuauuagaggugacaugagcaguggggcagcggcaaagaggccauguugcucuugcuaaauauacaucccugacaguuggauaauagguuccaggaaguucaguggaaaauuaaaacaaagcaacauuuauagcugauugaacuugaaaagccauuuugguguugaauggcaaauauguggacuucagcauuccuggagccugaugcaucccgcuggauggcccuguuccuguguacaugauggccuggggacucagcagugugcaggguacucuccuuuagagggugcuuugaggaaagaaguuugcugccacuuacagaaguccccuucccauacagugauauaacacaaguaccccauguccagggagcaucuuuccucugauggcuugaggacuuauuuauuaaaaggacaggaaugucuggcaagaaacagaggagcucuuaaguacuguaaauacuccuagucacucugcaucagggcugcaaguuuaagcagauugcugugguguauacacaugauuuuagcaugauaacacuucuguuuaauguccuuaguuguucuggggccaccacuggcgugagccuuaagaaaggcuaacgcggcugugaagaaagggcuuuauagucuguguguggagugguuaauuuucuuagaacuaaaagagaagcugcaggggaugggaagggaaaaugaagucaugguacaggaaauauaggugaagagagaauugagccauuugcaaguaucaagaaaaguugcuacacauucccaucuuuuucuccaggaugaucuuacgcuauugcuucuauguguuugucuuuugagaagcaaggccagggugucugaugggaacuuacgaaccuugguuugcuaagggugaugagaaaaccucugucauuugacccugucagucccuuggugacuucauccaaaccagcuuggcugucaggaaaauaugaauuguggcuaugggccuaauuucuucuguucccacucaaaugaacugccuuugcuagcuguagaaucaacuauuccuaugccccaugaauuuccccaaaguugaacuacuccaguggaacugaggguuuauugguucccuaccauuucagggcauuuccccagcaaauaagagucuuucaucccuuguguuuuaacugaaaaacagagacccagccauaacaauucccucagcuccuccuuuacuuaaugaagagcuugaguaggccccacuuuuaaauaucucuucuauaaguauggugcacuguucacaaacuuagaaaauguuaaaucucgccgggcgugguagcucacgccuguaaucccagcacuuugggaggucaaggcaggaggaucaccugaggucaggaguuugagaccagccugaccagcauggagaaacccugucucuacuaaaaauacaaaauuagcugggcgugguggcgcaugccuguaaucccaucuauucaauggaggccgaggcgggagaauggcuugaaccucggggguggagguugcggugagcugagaucuuaccauugcacuccagccugggcaacaagagcguaacucugucucagaaaaaaaaaaaaaaagaaagaaaauguuaaaucucucucugcccuacucugcugugggguugaggaacaauccacuuaaugggucucuucucuuuugcuuagcuguagccacggcagcucuauguguagguugguuggcaagcauuuauaaacuuuggauaaccuggcacccagcccuugguucacuuauuuuaaugcuacuaaaguuuaguuuucaauucaauaaucuuuguugguagggcguaacuauucuaguuagcaauuccauccguuguaagggaaugcugacagcugaccugcugucgucuaugcagguuaaaagaucuuaguuaaaagaucuuaguuggaguaagccuauacuuuugguguucccagacuaugaaacugcugcagguagaaacaacuguuuguuuugguuucuucagcagauagagcuuugcccaugagacacugcuccugguguuugccucggguaccuguaaagucacugaggaagaaacagaucuuccagugaauugagcuuaauuguggucuguugcuuucucugucugugucucauacuggcaucaugaguuuccuuucugagucaguuaaaucugagcugugccuuguccuguggaaaucugaggcuuggcuaggcucaucuugauggucuccaaauggugaaauuggggcuaagguguguggaaaugcacaccuuagcccugugugcagggcuguggugucuuauagauacaguacuuucuagugagugcucacuuaggcagggccaagaaaguaguucugaaugggaacuccagaggccuaauccagauauagcauauuauaggugcuaaugaagaggaauugugcugcugagcaaaggaaagcuuuugugacuugaaagcacguucuguguaucauggaggcuggguuauuuucccagcuuuaggcgaguggcacuaacuacaaguuucauguucuucugaguacacaugagucgguacugcagucaguauacuucuuuuccugaaauaagaaagugauuuacgaggugugggcccuuacgugaaagaaaacaaaaccagccgcucugugggccuguaaaauuccugugccaucucagugguguggguuacaggaggagaagauggagagggcuagcuggcccucccuugcuggggcucagcugccccaaauacuugugauauugcagguuauuuaugagcucgucuggacugggauucacugccccacacccugguaggugaagauuugcaggcagaauguagaagcccucauuaaucuuccuggucuuguugaggauuucuugucggccugagcuccuguuggagaaugaacuggcuuuuccacugaacuacaauggcucagauuaauauuaauccccuuaaugcugcaguucaugauauagucauuaggugacuuggaacuaauccuguccaccuaacuagugugauuuauuaaauacacauggagaucgagucugaauacagcuaggcagaaucagcagcaaauaaauaccucuguguaucuguauuaaugcugguugauugggacacaauugcaggcugggcuagggagaaacaagggccaaaaggaggcugagcucucuuaaucaacaguauuuucccaccucuacccuuuaauuuagauggcagaaacuauuaaacucuugguaacaguuuuaggagcagugaugagagcguaugucaggaacagggauuauaaguaauccaguucugugcauguaaagucaaagaagagaaaaaaagaaaccauauaugcauuugaaaaaauguaaagacauaagcucaaacuaaggaagaagaaauccuuuaaacauaucuuuuuuuuuuuuuuuuuuucuggagucaggauuacgcucuuuugcccaggcuggagugcaguggugugaaaauggcucacugcagccucaaccuccugggcucaagugauccuccugucucagccucccaacuagcgggaccauaggugcacaccaccacaccuggcuaauuuuuaauuuuuuuuguagagacagggaucuuccuauguuguccaggcuggucuugaacuccugggcucaagcaguccucccgccuaggccucccaaaaugcugggauuacagguaugagccaccgcacccagcaaccugucaauuauuugagugacuuuuccuccuauacuuucuuccuuuaaguuuuaagaguaacgguucaaauggagcuuucucuacaauuuaacuuccuuagcuuccuuuaaauucuuuaucaguagacacccuaggccaggcaaugaucucacuguucuauuacuucuccuggcuucaaggcuugaauuuuucuuuuugaaauggguaaggagauggaguagccaugccugccauauaacaguucucuucucugagauccuugcccaaguuagcagaagcauaauuucuuugguaaauaauugauguuuaucguuucccuuucucaaaccuccuuuucuuccccuucuuugcucuuucagcagagauggcauuaauaugaaaaacaucuaccuagcuggcuucauuuaaucaggcaagucugacauuugugaaaccucucauuaacauuuuccccaaagagcacaaaauggccuccccuccaaauacagccaccucaaaguuuaggcuucuuuccaucaccauuggcaggcuguucucagagauguuacuucucuaaacucacacuccuggccaacagccacuggucacauauggggggaccuucuguucaggugcugcccuauuccuuguaaacaucgcuuauuaccaauuuuccuggaaauaacaagaaaucuuugauaggaauacuggaguauagguuucuucaguacuuacauaggaccuuucuccaccaauucagaaacaucaguugaagacuacuauguucaugguccucuacuucaggggguccccaacccccuggccacggacccguuaggaacugggccgcacagcaggagguaaguggugggcgagcaagcauuacugccugagcucugccuccugucaguuaagcugcagcauuagauucucauaggagugugaacccuauugugaacugcacacaugagggaucuagguuacgugcuccuuaugagaauguaacuaacacuguagaacaucgguuccccaaccuuuucagcaccagggacugguuucauggcagaccauuuuuccacagacaguggggcuggagggcaagggagguguuugggaugaaaguguucgaccucagcucaucaggcauuagauucucauaaggagcaccaaccuagaucccucacaucccucacaugugcaguucacaauaggguuugugcuccuaugaaaaucuaaugucgucgcuaaucugacaggaggcagaguuuaggugguaaugcucacucgcccgcugcucaccuccuucuguguggccugguuccuaaugggccacagacugguagugguccauggccuugggguuggggaccccugcuguagguaacagaaaagcaaagaagccuugucccuuucugcuuuccaggagcuugcagacuacaauuuagcaauuccauaaaccagaauaugcuauacuaaagcaacagaacucuauagaaguucuaagaaggaagaaauuaauucugauagcagacuauauaauacuaauacuaguaauaguacuaauauaguacuauuagugcuauauccucuuaccaauucauaucaggaugaggacaguagucucugucauuuaccuuucuguuuuccuucccuccacuuuuuuuuuuuuuuuuuuuugagauggagucucacucugucgcccaagcuggagugcaguggugcaauaucagcucacugcaaccucugccuccuggguucaagcgauucuccugccucagccucccauguagcugggauuacaagcgugugccaccacaccuggcuaauuuuuguauuuuuaguagagaugggauuucaccgucuuggccaggcuggucuugaacuucugaccucaggugauccgcccgccuuagccucccaaagcgcugggauuuacaggcaugagccaccacgcucggccuucccucuacuuuuugaccugucuaguuuuugacugaguacaguuuaaguaaggacauggauugcuuauacuucuugguaauuuuaguaguccucuuccucuuaccuguucuccaucucaucacaauauuagugucuuuuuaacaagcauuaggaacagaaccaccauuuaggucuucagugagucacagauauaaaacugugccacaguuaacgaguagaauacuuggcaugccugacaaucagaaaucauagucauugaauuucugagccauauggccauuuccaguccuauccuuuuagauagauagacagauagaccaacugauaaaauaagacccagaaaauuugaaguuuggcuguggucauaaaagcuaguguagucuauagucuguaagcaagacuuuggauuauucuucuuuguauauccaauggcuagcagugccaggcccacagaagguacaaaauaauauucacugaaggagaggaugagggauuugaaugcaggaaggccaguauuguuucaguaauccuauaaaugccauuuuaaauaauuauuuuaaauucccuaauaaugggagauuaugcuaaacaucauuuuuagcuauucaugaacaacaaagcagugcucauauuaaguuuugggaagugaguuuuacuaaaacuuaguaauaauagucuucagacucugugauuuaggcugcccagugcccccuuuuuuuuucuaacuggcuuuuaaaaaauaacauuuaguaguaauauaagccaggcacaguggcauguguugguagucccagcuacuccagaggcugagaugggagaaucgcuuagcccagaaguccaagucuagccugggcaacauagugagacccuguaucuaaaaaauaauaauagcccaugucuacauagacuauuauauaaauuuaggaagauacaaaaaaguuuaaagaugcugggcaugguggcucaugccuguaaucccagcaguuugggaggccaagguggguggaucaccugaggucaggaguucgagaccaaccuggccaacguggagaaaccccaucuuuacuaaaaauacaaaauuagccaggcaugguggcacaugccuguaauccuagcuacuugagaaggcugaggcaggagaaucgcuugaacccaggaggcggagguugcuguggccaaaaucacgucauugcacuccagccugggcgacaagagcaagacuacaucuuuaaaaaaauaaaaaaguuuaaagagauggaaacaagaaccuccauaguccaaucaccuaaagauaacuauuauuuuaucuuuuuuuagcgcacgcaaacacaauaucacccuuagcaaaaugggaaucauauucuauacauuuuugccucuucuuuuaucauguuaugggcauugucccacaucauuacacauuagaaaauaagaucuaaugauauuauucauuguaugaauguuacagaauuuauuuaagagcuuccuguuguugguuauuuauuuauuuauuuuuauuuauuuauuuauuuauuuugagacggagucucgcccugucacccaggcuggagugcaguggugugaucucagcucacuacaagcucugccucccggguucacgccauucuccugccucagccucccaaauagcugggacuacaggcgccugccaccacgccuggcuaauuuuuuguauuuuuaguagagacaagguuucaccguggucucgaucuccugaccuugugauccgcccggccucggccucccaaagugcugggauuacaggugugagccaccaugcccagucuauuuauuuauuuuaagauagugucucacuuuguugccuaggcuagaaggcagugguguggcucacugcacccucaaccuccugggcucaagugauucuccugccuuagccccccaaguagcugggacuacaggugcgcaucaucacacccggcuaauuuuuguaauuuuuuuuuguagagaugggguuucgccauguugccaaggcuggucuugaacuccugggcucaagcgauccaccuaccuuggccucccaaagugcugggauuacaggcaugagcaccgugcccagugguuauuuagauuauucccaguuuuucaauauuauaagcaaugugguauaaauaucuugguacacgauuuuuugcuuaucacucuuaaggauccuuauaauaaauuccuucuauuauuuuuauuucucuuuagguaauacauguacauaguuuuaaaaagucaaauugugcugcaaaguccaacuucccccccuucaagguccccucccuaaacucuuuuagcuguuuauucaguuguuuucuuuucuauuucuaaauaauauguugauacuacauuuuuaaauaggauuuuuacauuuuaagcauuaucuauugacuuccuacuccuacauguagauauagcacauuugcaauacucaccaccccauucuccuuuccuccauccucccaauauaauuaucaccccauuugguuaaaccaguacucauucuuuaccuuauuaagaccuuauagcugggcacaguggcucaugccuguaaucccagcauuuugggaagccaagacaggaggaucuguugaggccagaaguucaagacuagccuggguaggcugggcgcaguggcucaugccuguaaucccagcacuuugggaggcuaaggcagauggaucacgaggucaggagaucgugacuauccuggcuaacauggugaaaccccgucucuacuaaaaauacaaaacaaaauuagccgggcgugguggcaggugccuguagucccagcuacucgagaggcuaaggcaggagaauggcaugaacccgggaggcggagcuugcagugagccgagaucgcgccacugcacuccagccugggugacagagugagacuccgucucaacaacaacaacaacaaaaggcuagccuggguaacauagcaggacuccugucucuaaaaaaaaagaucuuuaguauuauucauuugaauucauuauucaaguuuucccuuccuuuugaaaauaugcuguuuucuguuacuauuacuguuucuucucaaauucuacaaguuuuaaaaacugaauauuauuuuuccacguggucaaacacacagcucuucucuuccauuuuuaucucuuccuagaaacuccuucucagagccucccauccucuucuucuauucuguauugguuacugucuagaccucaggcacagcuguccuucuggaacuucccuucaguuuucucuagaucuccuuuuucuuguuuaugcuauguccauuucuuucuuuuuucuuuuucuuuuucuuucuuuuuuuuuuuuuuuuugagacagaguuucacucaugucgcccaggcuggagugcagugaugugaucucggcucacugcaaccuccgccucccaaguucaagcaauuuuccugccucugccuccugaguagcugggauuacaggugccugccaccacgcccaacuaauuuuuauauuuuuaguagagaugggguuucaccauauuggccagguugaucucaaacuccugaccuaaggugaugugccucugccuuccaaagugcugggauuacaggcgugaaccacugcaccuggcccauuucuuucuugauuuacugucucacauugguuuuuuauuuuuuauuuuuuacgucauccaguagcuucuaggaaaggacaccuggggauguaugguuuuuuuagacauugcuuaucugaagcuaucuuuuuauucuauacugacacuaauugaagguuuuaccggauauagaauucuaguuuggaaauaguuuuccuucgaaacuugauggcucugcuucuuuuucuucucauuuccaguguugaucuugaguagucugaugccauauugaaucucaguccuuuauauuuaaacuggaguucuuacaauuucuuuauccucauuauucugaaacacuuggugugggucucuuuuaguuauucugcuagguucuuaguaagggucuuuuugaucugcaaaauuauaucauuugauuuugggaaaugaucuuauauuaguuccucaauaauuuccccuuuucccccuucuccauuuuuucuguuuucucaauuagucccccuguuuucuguuccaugucucaccuucuaccuggugccuccuuccagagcuuguuucuuauugguacuuccuucuaaagcaacuugcucuucagccuuuucugcucugcuuauauuuccuuuucuucugcuaagaaucuguuaaugaaucuaugcuugauuuuagcugaaaggcugagaagcaaucuguuaaugaaucucagacaguuuucuuuucaccucaagaucauuuuauucuacuuauuauauauuuuaguuuuuauuuuuaauucuuuuuuuuuuuaaauggagucugacucugucgcccagacuggagugcaguggugcagucucggagucucggcucacuacaaccuccaccuccuagauucaagugauucucaagcgucagccucccgaguagcugggauuacaggugugcaccaccacgcccggcuaguuuuuguauuuuuaguagagaugggguuucaccauguuggccaagcuggucucaaacuccugaccucaagugauccacccaccuuggccucccgaagugcugggauuacaggcauaagccacggugcccagccuauauuuaauucuuaaccacucugaacaccuuguauuucuucauaacacuuacaauuaguguuaaaaucauaacuuauaauuagucacaauuauaauuaguuaauugugugaucccuugccuaaugucuuucccacuacacaggaaacuccaugaggacaaggauuguguugcauuguucaccaucauauaucuauuaucuagccuggugacuggcacaaaguuggcacucauaaauauuuaauaaguguauuaauuugcaucuuucuuuaaucaauauaauuuauucugucaaguggacugaaauaggaauuuaacuuuucccaccuaacaucccauuuauugaaugcucuuuaucauauaucauauacuacauauuguccuaccuauucuuuugccaauaguauacugauuuauuuguuguaguauuauaagacauuuuaaaaugauacugcagacuuccugaaauuaguuuuuuguuuguuuuuguuuugagacggagucucgcucuacuacccaggcuggaguauaauggcacgaucucagcucacugcaaccuccaccuccugggcucaagcaauauuccugucucagccucccgaguagcugggaccacaggugugugccaccacaccuggcuaauuuuuuguagagacgggguuucgccauguugcccaagcuggccuuaaacuccugaacucaagugaucugcccaccuuggccucccaaagugccaggauuacaggugugagugagccacugcacccagccuguuuguuuuugagacagggucuugcucugucacccaggcuggaguacaguggugcagucacagcucacucuagccucaaccuccugggcugaagcaauccucccagcucagccuccagaguaguugggacuacaggccugcaacaccacgcccagguaauuuuuuguauuuuuuguagagacaggguuucaccauguuggccaagcuggucuugaacuccugggcuuaagcaauccacccaccucggcuucccacagugcugggauuacaggcgcaagccaagccaccaugccuggccucauuaguuguuugaaaaaauauucuggcuaucuucaucugguucuucuuucacaugaaguacagagucacuuauucaaguucuuuuucaaagaccuuuaagauuuugauucaaaaacauaaauuaguauggagagaauugacaucuuuauaauauauuuggccucccuaaccaggaacauguuauggcuucuccauuuagucaagacuucucuggugaccuugguaaaguuuguagauucuucuuuccccaguuuauguccauuucuuguuagauuuauuccuaaauauguguauguucaauugcuaaaggaaauaggauuucuccccacuauaaauuccuuuuaucucaccuaaaacuggguaaguuucccuuuauuccuacaauacaguuuacauuauaugcccaugacaaaauacuaguguuaguaguucuccuuacauguggugucucaugccuguaauucuagcacuuugggaggccgaggcaggaggaucucuugaauccaggaguuugagaccagccugggcaacauagugagaucucaucucuacaaaaaaaaaaaaaaaaaaaaaaaaaauugcuggguaugguggugcaugucuguagucccaguuuccuaaguuagcuucauuuuuaauaagagccaguuguuucagcaagaaucgcuugaacccaggaagcagagguugcagugagcugagaucacaccacuguaguccagccugggugacagagcaagacugucucaaaguaauaauaauaauaagaagaagacaaagaagagccagccauuucaaugaucuauuacuguguaaccauuuccaaacuuuguggcuuaaaccgacaaccauuuuauuguaucacaauuuuguggguuguccagggcccagcugaacaccucuucucacagucucuccugugguugcagucagcugcggcugugguuuggaugucugguaccauguggcuuccuuugacaugauaccucaaucuccagggcuuuuccucaugaccuagcucuccugcaggguagcuuagacuguguacauggcaguuuagaucuccaaaauugaaaaaaaaaaaaaaaaaaaaaagaagaagaagaagcuucaaagccuuuuuagugccugggcauggaagucccagauugucauuuucucugcauuccguaugucaaagcagucacagacgagauucaaggggagcagacacaagcuguaccucuugauuggaggaggaacaugugagggguggcacuguaagggacuaccuuuggagauuaacugccauaauggcauuuguucauuggcccuugucuucuuccuuuucuucuuuuauuccagguagcuacccuagacuucaguguagacuaaguucuuuuaagcauguuugcacuuuuuuuucugucuuuuuuuuuuuuuuuccuuuauguggagaacgggaccucgcuauauugcccaacuccugggcucaaguuauccucccaucucugccucccuaagagcugggauuacaggcgugagccaccaugccuggccauaagcuuguuuaauccagucaaauuucaguaccaaauaacuauauucauugucauaaauaggaaucugaaggggguagcaagggaagccuuucuuuuaauguuuccaucuucacauuuguuuuccuggaugaaguuuaacucuuauggacagaaauacagaguucacuugagcaugaaauaccagacaaagagacagguguaaauuggcccuguucuucugaacccugccugccuacuuucuaggaaggcuagccuuccccucuuuuccccagcauaaguccaaccccuucccucauuaugguuugucauaagaacucucucuuauacuggugcaaguggaaaaaagagaguauuauuccuuuucuuuuuuucacaaaauacuucuuccuacccuggauuugcuaaccucuggcuuaaauacgcaccaagcaaagauguauauauagucuuccucccuuccucucucuccccuuagucugaaggaaagcagcaggugauggaaugcauaaaggaucggggcagggcuagagucuuuucucacacacuauggacguugcucaacagaaugggugugaaauuuagucagagccacagcauguguuucaguuuuccagggaauuuccucuuccuaacuguagguuuaacccuuucuucuguguagggaaugccaggggcuacccaagaaauaugaaaugaguuauuuguaagaaggaaaaaaugccaggcuuuuaccaggcuccuuugggaucuaggaucuccaacuuacuucuugcuaaaugauuguggaaaaagacauagacuuuggaguuggauagaccuggcuucauaucccaucucuaccauuggguggucuugggcagucauugguggcaguuacuugaucuuuuuuuuuuauuugagacggaguuucgcucugucacccaggcuggagugcaguggcgcaaucuuggcucacugcagccuccaccuuccagguucaagcgauucuccugccucagccuucugaguagcugggauuacaggcgcccgccaccacggcuggcuaauuuuuguauuuuuuaguaaagacaggguuucaccauguuggccaggcugaucucaaacucuugaccucaagugaucugccuaccucugccucccaaagugcugggauuacaggcgugagccacuguaccuggcugaucuuuuugaaucuccauuuucucaucugcaaaauaauauaaaaacuugccuuauaguauucuugugagaauuacaugaguugauguguauaaggugccuaguacaaugcauacccucuccacaguaugcacucuacauaugauuauuuucuucuccagucuuuaccucuggauucugaggcuaucuacucuucuuuugugccaugccauguuggguguuugccaugguagcagcuuuucacuaaaguuuguugcuuuucuccccgaaucuaauucccuaagugcguuacagggaggaguuauuucacaugauaugcagaaucccucuugggguccucauuaagcuaaaggacaagucucuauacgaaugcugagaagggcugggcccaguggcucacgccuguaaucccagcacuuugggaggccaaggcaggcggaucaccugaggucaggaguucaagaccagccuggccaacaauggugaaaccccgucucuacuaaaaaugcaaaaauuagcuaggcgugauggugggcaccuguaaugccagcuccuugggaggcugaggcaggagaauugcuugaacucaggagacggagguugcagugagcugagauugcuccacugcacuccaagccugagcgacagagcaagacuccgucucaaaaaaaaaaaaaaaagaaagaaaaaaugcugagaaggacuauagggcuuuccuugcccgucucauacuggaacccauaugaacuuacaaaaguuuuuuuuguuuuuguuuuuuuuuaagacacagucucacucugucacccaggcuggagugcgguggcacaaucuuggcucacugcacccuccgccuccugaguucaagcgauucucgugccucagccucccgaguaggugggauuacaggcacaugccaccacaccuaacuaauuuuuguauuuuuaguagagaugggguuuugccauguuggcgaggcuggucuugaacuccugaccucaagugauccaccugccucggccucccaaagugcugggauuauaggugugagccacugcgcccagccuacacuuauaagaguucuaaaaucauacaguguuagaacugaaaugaaguauagaggucaccuggccuauuuuauacggaaagaacuguggcucggaaaaggucaugucaugcaaggccucauaacggaguaguggcagcucuggaacuaaagaucugucuuacuugucuauuacuaugguuauaauuuaauuuuuuugaacgcuaucugaguucuaagugcucagggccuaguaugcaaguuuacgccaaguauguaaacuugcuucuaaauuggaaugcugaucauacuuuuagcaauggggaaguaaacacuguugaagacauuucaauaucauucccuuggggaguaacagggcuucaaugagaauauuauaagcuaccaccugaaaaccucauuuuucuacaaagguugcccaaggggcacugagguggcaguucagcuggcuguugagucucugcucccagacuggugaguugggaagcaaacuuguuucuucuguucuuucuucauucucccaaauaauaccaaguaggggaagcucaccccaagcccccaucuggcuuuccuuuuuuuucaacuugagguauaauuaacauacaauaaaauaugcagauguuagguguucaguugguaaguuuugauaauuguauaaaccauguaaccagcaugaauaaagaauacacagaacauuucaucuccccagaaauaucccccaugccucuuugagucccccaaccccacacauauauacaaaaccauuuucuaucacuauggauaaguuuuguuuuuggauuucauauaaauggaaucacacaggauauacucuuucauagcuagcuucuuuuagcuuagcauguuuuuggaauuuauccauguugcauauaucaguaguuuuuuucuguuuugcuuuucugagugguagucaauuguguggauauauaaggagaaaagguagagguuggugaagggcuuucaucuggcacguagccugacuacccuuugcucaagagcauuuggaccaccagaggccccccuccuuaagauuaagauguucacuuaccugcuuuaaauguaccacgucacagcauauacacuauuauguagcuaugucuuguaaaagucucuaaucggcauccauuagaugagccgaauucuccuggccaagccuuagccucucagggggcuggcaccaaacagggaggcuggaguaggguuucaaacaccuguuucagcuuuuuaaguguccgauucaggccacugugcucuggcagcagggauccucaugauguggcuucuucucuccugccaaauccucaacuuaaagaaccuaggcccuuaggggaggaaaauauagagcugguggagaggggaggggugugcagcaacauugaagaacuguuucuuuuaaaguuaaaugcacaucuacccuguggcugagcacuuucgcucuuagguauuuagucaagagaaacaaacacauuuacaaagagacuuuuauaggaauguauacagcaguaauaguaaauaacuggaaacaacucaaauauccuucaauaagagaauggauaaauucuuugggagugaaggacuuacagaggauucucuggcggcccuccucucuuucuaggaaucauucuuguuucuauucuuauuucuuucuggauuuuucugaauuugguuguguuuuaaaugccauguaauggaauacccauuauuuguaaguugauugagcauaaaguauuuuauuauaaaguggucauccgucacaagaaggcauguggcuguaaaaaacauuaacucugcacucugggcuggaaugcaacuuuaccagaauaauggagcuuuuguauuaagugugcaguugggauaaaacaagagacagacagacagacaguguuggggaaacagguguuggcugggcccagcuucugucccauguuuugugaaauuguuuuccaacccuuugaggauugcuccuccagauucagcugucuuaaagguucugucagcaccuuucgagcaaauaaggugugacuuuucaggguacugcugcuuccauaagcuuuauuuguuuacuguccagcucacagacaugucuagagacagcaguggcaagugauuaccauacuuauccuagcuccaucuauuuuugacgcuuuuguuuuccccaucaguaaaaugggaaauaucccuuaucauaaaguucuugagccuuuuagcaugaggguggcugaaacagcauaaagacuucuuaaucuggcugggcacaguggcucaugccuauaauccuagcacuuugggaggccaaggaaggaggaucacuugaacccaggaguucaaaaccagccugggaaauaauagcaggaccucgucucuacaaagaaaaaauuuuuuuuaauuagccaagugugguggcacacgcuuuagucccagcuacuugggaggcugagguggaaggauuacuugagagguugcagugagccgagacugugccacugcacuccagccagggugacagagugaaacccucucucaaaaaaaauaaaaauaaaaagaccccuuagucuuguugucacuaagaauuuaugauaugcugcuguaguaacuauuuccagcucuugggaaaacauuaacucuguacucugauaguacaguaagugagagugaauaaguaagguccuauacacugaagggauagggaaagguuacuuaucaguccuguuauugagacuggggacugucugauucuucuccaggagcuuugacuauuaucucuucaggcuuuuucaucaucuguaaacuuugcuaaugucaguucagaauuuaguucuuuuuaauuuccucuuugucuuuuucagggcugguagagaagaccugacauaguuauaauugauaauaaaccuauaaugcugcuguugaacaaugaaauuuuuuacuagacucugaaaggaauuuguauugaaaaagcugcuccaaguguaaugacugcauaaagcugggguaaauuguucuguugucaaguauaccaacagaaguuuuuaauuucuccugggcuuucagauugccugcuuaaguuggggcuuggucuucuacagugcaugcagaaaacaacaaggcagagugaagggccacaguagcucugguuugucuguaugcuauagcugaauugcuugccuuucaauaugugccaauuuccucuagaaagaagagaacuaguauuuaagguugauacgcaucaaacuugugcuuucaguaagacagauggaucagucuguccuugggucucugagauaugauugaggccagucccugugggccucauuuaucccugccagccuuguuaaaggggccucacucucccucuuuggauuaggagggaaccuagguaaaccugacacuuaauuuguauggcaguacuacaagcaauaacuaacaauguuuagucacugguuaggagaaggagaggugcagaagaaacuucaguucuaggaugguugaguuuuaaaauuuuuuguuuuguuuuguuuuugagacggagucuugcucugucucccaggcuggagugcaguggcacaaucucggcucacugcaagcuccgccucccagguucacuccauucuccugccucagccuccugaguagcugggacuacaggugcccgccaccacacccggcuaauuuuuuguauuuuuaguagagauaggguuucaccguguuaaccaggauggucucaaucuccugaucucaugauccaccugccucggccucccaaagugcugggauuacaggugugagccaccaagcccggccaaguuuuaaauuuuugucauccaagucaugcaguuaauauaucuaguaguaaacuuauacaauaggccaggcacaguggcuuaugccuauaaucccagcacuuugggaggcugaggcaggaggaucauuuaaggccaggaguucaagaccagccugggcaacauagcaagacccccuaucuacaaaaaauuuaaaaaauuagcugggcaugguggcacaugccaguagucuuagccacucaggaguugguagucuuagccacucaggagucugaggcagaaggauugcuuuugagccuaggacuuugaguuugcagugagcuauaauugcaccaugguacuccagccugagcaacagagcaagacucugucucaaaacaaacaaacaaacaaaaagcccccuguaccauagcaugguauaauauugaagaguauaauacaguggcuuuggagucacaauagaccuggauucaaauuuuaucucuuccacuugcugugugaccuuggguaagucacuuaaccucuuagagccucgguguccuuaucuguaaagugaggacaguaacacuauuucccagaguuauugggaggauaaaauaaaauuauauaugguaauuauguuuaauaauauaauguagcuggccgggugcaguggcucacaccuauaaucccagcacuuugggaggcugaggcaggcagaucaccucagguuaggaguucaagaccagccuggccaacauggcgaaaccccgucucuacuaaaaauacaaaaauuagcugggugugguaguacacgccuguaaucccagcuacacucaggaggcugaggcaggagaaucgcuugaacucuggagguggagguugcagugagcugaaaucacgccauugcacuccagccugggcaacaagagcaaaauuccaucucaaaaaaaaaauaaauaaaaauaauauaauguagcuguugcugaugucugaggcaaauuaagguuguuguucuggcaaugaaaugggauucuugugagggugguagauagcagcuccuagcaacaaguuaaucuggcuauuuagcaggaaugcccaagguaggaaacucauuccucuucuaaucaggauucauacaucauauuggacaaaaucauacaauaaacuauuuucccauguguaugcugccuuuaagugccugucuuaucuuuugaaaguggaggcuaaaucugaccugaggcagaccagggcagccucacucagcaaggagacgauggcaaaaaugacgauuucaggagcagagauuuacggaaagcagccugcucugagauacacaugcuguuagggauuuugacccugaaaaaauauauccucuuccuauccucucucuaaggagagguugagcugcuauagggauggagaugggggcaagguccugacaaagguguucaagccagagagcauauauagauggcaaaaauaauuuucugucauggucaucuugaaccuuuuugcaccagguaucuagggaggaggaguucuuacauaaucucuggguuagguuggggccucaugaacaugaugcuccauaaaguacuuaucaguggcaguuuuggagaaaauauaaaauuaugauuucuaaucccugggguuuucagacuuuaaauguaaccucaagguguauacauucaggaacuccucauguuuaaucagagaguuaagguuugggguuuugauucauuaaaaaaaacagauuggggcugggcacggugucucaagccuguagucccaucacuuugagggccaagguggguggacugcuugagcccaggaguucaagaccagccugggcaagagagagagaagaaaaacaggguggguugaccuuugagggauugaucagccagaaaagugaacacuuuccaaaggguuuguuuuuguuguuguugucuuuugagacagggccucacucugucgcccagacuggaaugcaguggugccaucauggcucacuccagccaugacaucccugggcucaagugauccaccccacacgucagccucccuaguaguugggacuacaggcgcacgccaccauaccuggcuaauuuuuuuuuuuuuuuuuuuuuuuuuugagacagcgucuggcucugucgcccaggcuggagugcaguggcgcagucuuggcucacugcaaccuuugccuccuggguucaagcgauucuucugccucagccuccugaauagcugggauuacaggcgucugccaucacgcccagcuaaucuuuguauuuuuaguagggacaggguuucgccauguuggccaggcugguuucgaacuccugaccucaagugaucuacccgccuccgccucccaaagugcugggauuacaggugugagccaccgcacccagccuuccccuauacuuuaaaucaucucuagauuacuuguaaugccuaacucaauauaaauacuauguaaauaguuauaccauauuuagggaauaaugacaagggaaaaaguuuguagauguucaguacagaugcaaccauccacuuaauuuuucugaauauuuuugaucugugguugaucguguacacugauguuggauccacagacacagagggucaacuguaauuugccuuuuuuuuuuuuugaaacagagucuugcugugucacccaggcuggaguaaaaauguuaugaucucggcuaacugcaacuucugccuccccggcucaagcgauucucgugccucagcuaccagaguagcugggauuacaggugcgcaccaccaugcccaacuaauuuuuauauuuuuuguagagacaguguuucaccauguuggucaggcugguaucuaacuucugaccucaagugauucgcccaccuuugccuaccaaagugcugggauaacaagcgugagccaccaagcccagccuaauuugccuuuuucaauguaagugguugguaccauuaucuucuacugcuggcccuaaguggaucuauggauccugauuuuuaccuugaugcagcaaugauuaagccauaaucauacuuugucucuuaaaaaucauaaugucaaaguuaauagcccccuaagucuagaagcauccugagaagcuaagaauguguuugauaaaaagaagcagaucugagaaacuguugugugauagcugagaaaagagccacugugaagagcuuagacaaacaaacaggacuugccuucccuccaggcuagacugucugcauucaugugcauuuacuuccaaaugguacuuugcauuuagaaucauaaguuuuagggaccuuaaagaaucuaguuaaauuacuaucaccaccaccaccuuccccaggaaaucccaauggaugaggaaacuauggcccagagaaaugagguguuuuugcccaaggucacacaguuaaugacagaaucagaauugggccuagugcauuucuuuauuucauaucuccuguuguauagggcagggucuaucuggguuugacccuuaagcccaggcuaggaaauacagguaugggaccuguccguugacaguguuuucuggaauccguuccugaaccaagccuaaauucccaccuguccauucauaggucuggaaaacuuugaagcugauaaacgaagguaugggagguuuggcaguuauuccagaggcuucuggcuuugccaaaguuuagcuuugauuauucuuuggaccacuaccccucuuuuuuuuuuuuuucuuuuugaaacaggguuccacucuguugcucaggguagaaugcaaugguaugaucagggcucaccucagcuuccugaguagccaggaccacaggugcgcaugccuggcuaauuuuuucauauuuugugcagcugaagucucacuaugucgcccaggcuggucucgaacugcugggcucaagugauucucccaccucagccucccaaagugcugggauuacagguguaagccaccacaccuggccuggaccacuacucuugauguccucuagugaccaaaaagaacacagcuucuuccuacggagcuuaccauacaucagacauuuuuguagaucacuaucaaucuugacuuuugcaagaaauauauuccugggguguacagcauagucagaaaaguagcauaugagaccuaacacuuucuccuaaaauggaauguacagauacagacagaaaagccuaaaaccaaaaagcuuuugucgucugucucuggauacagaaauguuagagggguaaaugaacuaauuucuuuuuuuaucaugcuaugauuuauuagucuguuauacaugauccaucuugugaaugauggcauucugucuccaggaacaugggccaauauuugcaggguaaagaacaugcaugggagcaggcuggugacccucuagaaagcaagaagagagaaguagacucugagggcaaaaaggucgagacaggcauuucugaagccaaaugguguugaaauaacauaccgcaggccuuuuuccuugucagcguaauccaauugagaaugcccaacugccccugauaagagucacucaggagugaagagcuuugcuaccagggaaagcagcuuaugugugcauuuuggcucaggaaugugccagcccaaugcuggccaaaugagaaaaggcugcugcggccuggagaacacagccuccugggaggaugguggcuguucccuuguagcuuaggagaguauucuguuuuguccaagggcagugcuugaggccacauguugaggccuuugacauagauuaucagagaugguagcagcucugacaugagaagagaaaauaaugucaagauucagcugggcgcagugguucaucccuguaaucccagcacuuugggaggccgaggcgggcacaucacgaggucaggagaucgagaccauccuagcuaauaacggugaaaccccgucucuacugaaaauacaaaaaauuagccaggcgugguggcuugcgccuguagucccagcuacucgggaggcuguggcaggagaauugcuugaaccggagaggcggagguuacagugagccaaaauugcaccauugcacuccaggcugggugacagagcgagacuucgucucaaaaaaaaaaaaaaaagucaagauucauccccauuuuggagaggucaccucaucauuugggaagacaagaggugugggacaucugcagauucucagacagacauugggccaaauugacacuucuguuuuaaugucauaauauggggagugaagcacccugcccagucguauugaguacaguaugagcagaccaccaccaagacaucuccaaagggcuucacuuugcuuuggguugaagugacucaugagccucuccagaaauaauuuaauaauucuuguuguaauuugucacugacuguccagaaauuggauccggauuugauucuggaaggauccgaaguguuuucuccaaugggggguuagauuuccccuccuugugcccuuuuucccccagaugacuggcucaucuuagaacauggaccagucaccuucagagcaccucucuaccuaaucugcacucuguguuuacuggacuguuugugccuugagguugacagucuuccagggcgggaauuuuggcugcuuggcuggggugucagaugucuccuugguugugaaauuauucagccugcuuacuaugagcagaaucauggcacuuuucuccugaaggacucaggcaguuuucacucuucuggagaagauccagacaauugaaucucaguucccagccaggcugaaccgugagauaggacaccagaaaccuuucuguucuagccuuguaggaagcaguaaagucggauggcuacgagcagagcuuuuggaguuggauggaccuggauuugauuccuguuuccacuacuagcuagugcuaugaucuuagcugguggggacaucucguuauccuuuccaagccucauuuuuaucuucaaaaugggguuaauuaugaagagugaagguauguaaagugcauagcacuuggcauggcgcagguaauaaauguuaaugaguacuuuaauaauucauuuuauuaaaaggaagccuguucuuucucugauaccuuggagaaagcugaagcccucagaaauuaaaagugcuaucccaaauuguaccguaaauaucaaccacccguuaucucaguauuuauccuuaacuuguguuuguuuuaugguuuaggagucaaagguagaauuuuuauauauauauuuacuuaaaucuuaagaaaugaacugguggccaggugcaguggcucaugccuguaaucccagcacuuugggaggccgaggcaggcagaucacaaggucaggagaucaaaaccaucuuggccaacauggugaaaucccaucucuacuagaaaauacaaaaauuagcugggugugguggcaugugccuguagucccagcuacucgggaggcugagccaggagaauuacuugaaccggggagguggagguugcagugagccaagaucacuccacugcacucuagccuggugacagagcgagacuuugucucaaaaaaaaaaaaaaagaaaaaaaaaaaagaaagaaaugaacugguauacaauauagagaacacuggacugcugugacucuagagcuaaaaacuagaacaauaucuuaguuaucuuuauuauacacuuuauuccaugcauuguaccaaguguuuuacaugcaucaaaugagauaguguguaaauugcuuaauaccaugccuggcacauaguauacgcucagugaauguuaguugcuauuauuauuuauuuuaaauguaauuuauuuaaauuaucuaauacccauuuacaaguaauaaaauuagagacccagaacacuuaaguaauuaaagucacauagcuauuaaguugcagaacugggauuugaaucguccacgaaagcccaugauucuaccuagagcccuuagcuucuaguccugguuccaauacuaacuggccuuguacaaauuacuuaacuucccuaaaucucaguuaccucauuauaaauuauuuucaggcccuauuuuagcuguaauauccuaggauuuggaggauuuuccugaacagucaaaaauuaugacuuauuuuuguaggguaugguuuaaucucugaguaacaguucccuagaaaacugaugcagccuacaaacugcugcuuauacacaaagagauauauacagaaguugaaaguauuuuaaaaauuuuauaacaaugugacaguaguuacauguauguugauucuaguaauaaaaaaauuggacuuuauguuuuuaaaauuuuucuaguaauuaacuguauuuuauaaaacuaugggucugcacgggcugggcgagguggcucacgucuguaaucccagcacuuugggaggccgaggugggcggaucacgaggucaggaggucgagaccauccuggcuaacgcggcgaaaccccaucucuacuaaaaauacaaaaaguuagccgggcaugguggugggcgccuguagucccagguacucggggggcugagguggaagaauggugcgugggggagcuugcagugagccaagaucucgccacugcacuccagccugggcgacagagcgagacuccgccucaaaaaaaaaaaaaaaaacuaugggucugcaguggauugacauaaagaagaaaaaacugcucuucaucacagauaauuugacaagcacuauucuagauaaccaucugaacaucucaccaggauuauaaauucaaauuuguuuguuuuuaaauuacauguuuacaaaaaguuaccccuuaaauuagaaauauccuuacuaaaggcuggacguggagacucacgccuguaaucacagcacuuugggaggcugagacagguggaccaccugaggucaggagugcaguuugagaccagccuggccaacaugaagaaaccccaucucuacuaaaaauauaaaaauuagcugggccuggugguacaugccuguaaucccagcuaccugggaggcugaggcaggagaaucgcuugaacccaggaggcagagguugcagugaaccgagaucacaccacugcacuccagccugggugacagagcaagacucugucucaaaaagaaagaaagaaagaaagaaauauccuuacuagugaugccccacuaggaguucaacuugcccccaaccccacuuguugcagaguugcuccuguuagagcuucucuuaugcuccuggcaaucaacaguugaaccuagagagcaaaacucuuguucucccuagacaaaacucuuuaaggaaaguuaacuuuauauaucaugauucucuuuuuuggaagagguagggaagugacaugauaaugaagguuccuggugggcucauuaaaaaguuuaacccuucuaguuuuucaucaguagguuucuauaaagcacugacuuaccaaaugaaaguacuggaaugaacauaucuuagcagucauagauuccaacaaccuucuucuuuuuuuuuuuuuuuuuuuuugagacagagucuccuucugucacccaggcuggagugcaguggugcagucucggcucacuguagccucugccucccagguugaagcaauucucaugccucagccuccaaaguagcugagauuacaggcacgugccaccacaccaggcuaauuuuuuuuguauuuuuauuagagacaugguuucacuauguuggccaggcugaucugaaacucgugaccucaagugauccacucaccucggccucccaaagugcugggauuagaggugugagccacugcgcccagccgauuucaacuaucuaauuugacagaugaaggucuuggguaucauauaucuggcuauugauaggagugagacuaguccauugacugaauuguaugcugugugaggguuacacacagagccucggcugggugcgguggcuuacaccuguaaucccagcacuuugguaggccaaggcaggcggauuaccugagguugggaguuugagaccagccugacaaacauggagauaccccgucucuacuaaaaauacaaaauuagcugggcgugguggcgcucaucaguacagugaugagagaaaccaagaagaucugaauaauggagagacauaccaaguucaugaauugguaggcacaacauagcaaagauaucaugucuccccaaauugaucuauagacucaaugcaauuccuuucaaacuuccaacaaggcaaguuugucuuaaauugaaauggaaaggcaaaggaauuggaacacugaaugauauuggaaaaaaaaaugaaguuggaggaaucacaccacuguuauuaagacuuaguauaagccgggcaugguggcucacgccuauaaucccagcacuuuggaaggccgagacggguggaucaccugaggucaggaguucaagaccagccuggccaacauggcaaaaucucgucuauacuaaaaauacaaaaauuagccagacgagguggugugugccuguaaucccaacuacucaggaggcugaggcaugagaaucacuugaacccgggagguagagguugcagugagccgagaucaugccacugcacuccagccugggugacagagcgagacucugucucaaaaaaagacuuaguauauaucggcagggcacaguggcuuaugccuguaaugccagcacuuugggaggcugaggcggacagaucacagggucaagagaucgagaccauccuggccaacauggugaaaccccgucucuacuaaaaguacaaaaaaauuaacugggcgugguggcacguuccuguagucccagcuacucaggaggcugaggcaggagaaucgcuugaacccaggaggcaagguugcagugagccaagaucgagccacugcacucuagccuggguaacagagcaagacuccgucucaaaaaaaaaaagacuuaguauauauuuauaauaauuaacacagugucguguugucagacuuagacacauagaucaaugaaacagaacagaacccagaagagacucacaaaaauauggccaauuuaauuuuuauuuuuuggaacagggucuuacucugucaccccaggcuggagugcagugguaugaucacaguucacugcagccucagccucccaggcucaagcaauccucucaccucagccuccugagucgcugggacuacaggcacaugccaucauaccugguuaauuuuuuuuuuuuuuuuuugagacaggaucucacuuugucacccaggcuggagugcaguggcacgaucucagcucacugcagccucuaccuccuggguucaagauauucuuucaccucagccuccccaguagcugggacuacaggugcgcgccaccaugccccacuaauuuuuguauuuuuugguagagaugggguuucaccauguuugccaggcuggucuugaacuccugaccucaggugauccacccaccucagccucccaaagugcugggauuauaggcaugaggcaugagccacugcuccugguccaugccuuuuuuuuuuuuuuuuuuuuuuugagacagagucucgcuguguugcccaggcuggagugcaguggcacgaucuccgcucacugcaagcucugccucccagguucacgccauucuccugccucagccuuccugaguagcugggacuacaggcucccgccaccacgccuggcuaauuuuuuguauuuuuaguagagacgggguuucaccguguuagccaggauggucucgaucuccugaccuugugauccgccugccucggccucccaaagugcugggauuacaggcgugagccaccacgccuggccguuuuuuuaauuauuuucuguagagaugaucucacuauguugcccaggcuggucucgaacuccuagacucaagggauccacccaccucagucuuccaaagugcugggaccagugcccaaccuggucaauuuauuuuugacaaaggugcaaagacaacuuaaugagauauguuggaaacaguaggaaauucuuaggcaaaggaaaaaugagccucaaucuaaaccucacaccuuaugcaaaaauuaacugaaaauagaucauaggugaaaaacauaaaucuguaaacauuuuaggagaaaaugggaggguggaaaucuuugugacuuggaauuaggcagagucaauuuagacauuaaaccaaaacacaauccauaaaauauuaauaaguuggacuucaucaagaguaaaagugucuguucuaugaaagauguuaagggaaugaaaaaauaagcuuaagacugggagaaaauacuuagaaauaacuguaucacuacugaaggacuugaauucagaauaaagaagucuccaaacucaauaguaagaaaacaauuuaguuuaauaauggauaaaagacuugagcagacaugucacccaaaaggauauacagacggcaaauaagcacaugaaaagauguucaacauaauuagucauuagagaaaugcaaauuuaaaccacauggagcuacuauuacauacauacuugaaucgcuuaaguaaaaacacugaaauacaaaguacugaagaggauguggagaaacuagaauucuuauugcuagugggaauacaaagugauaaaaugacauuggaaaagaguuugacaguaaagcuaaccacaccuuuaccuuuugacccaggaauccuaccccuggguacuuacccuaaagaaguggaaaccuguguucacacaaacacugauacacaaauguuuauagcagcuccauucauaauugccccaaacuggagaucccacauguccuucaaccagugaauggauaaagaaacugauacauacaggcaaugaauacuacucagcaguaaaaagaaacaagcuauugauauaugcaauagcuuggaaaaauuucagucaucauguugaaugaaggaagccagucugaaaauuggcuguaaaauuacaugcuguauaaaucauucauuuaaagaaaagaauuaauuuuaccaaauuagcaaaaagaggcugaaugcacaucacccuagaaguguggaccccauauauaaaacugcccuacucuuuuaccgugaaggaagacaugaagcaaguauauaguuguagcaacuaaaugaaaucacagaaaaucuguaccugucccgauucucaaagauuuuuuuccucuagacuuuuauaugucaaauauaccucaugaccacuuuuaagauaacaaaccaaauuguacauaauucaugcuccuaaagcagcaagacuagaugacuuuacauuuuuuuauguacuuuuuuuuuuuuuuuugagucggagucuuguucugucacccaggcuggagugcaguggcgugaccucagcucacugaaagcucugccuccuggguucacaccauucuccugccucagccucccgaguagcugggacuacaggugcccaccaccacacccagcuaauuuuuuuguauuuuuaguagagaccagguuucaccauguuagccaggauggucucgaucuccugaccucgugaugcgcccgccucggccucccaaagugcuaggauuacaggcaugagccaccgugcccggcccuuuuaugugcuuuuuaaaaguacguuauguauuucaguuuuucacacacacgcacacacacacacacacacucacacacagacacacacacacguucuucucuagguuuuuucuguaaauuuuacaucucuagguggggguaguaggggaagagaagcagguuuuuuuuacagcugaugugaucacuguacagacaagcuuggaaaaugcuacccaaucugccaauuaauuaaagcguuaaucugaggagcagccgggcccagggaauguuuacccagggaggagugggggugguaggaacugaguaggcagcucccuauauuugcaugaaaaugaaggugcuuaggaaacccugcuuccuuuugucucuaaagguggggcagccuagaucacaucccuaaacacuuuuggucucuuuaggaagccuuuuagggagcuggucucugaaagaugaaagcacagcacaaucuagaaaaacaaauuuaaauucuggucagaguaagguagggaguaaguacaguguaguauucuuugaccuagaauggaaucuucuaaauucaggaguaaaauuucaucuauuuagguagaauagaugaagggguuuuacaaguuuuaaaaccacauaggcuggguucaaaucccagcucugcauauuaguugugugauuugggacuaaucauguaucuuaucugagccuuuucucaucuguaaaauaaagauuaucaauugccccuucaucucagagcaguuaguucucugcuaacucuaggcaggaaacaggccggacagugguuacgaacuuccaagauuacagacugccuccaugacuaagagacugcucagccuuuuguucuuguuaaacuuuuuucucagcaagggauuauaaaccucagaguuuccucucacccuccuggaauaugcugcacucuuucucuaagagaagugacccugaccauaacagcaaaggacauaaagacaggagcccaccuugggaccuaagggucgcauuggcucuacccaagaugacguuaccuauuuauaucacaggggaggguggugaaaugggcauggaaaauugacucacaauauuugaugauauugaaaaauuauuguuaauuuuuaaaaauugugauaaaauacauauaaugcaaaauuuaccauuuuaacuguuuguuaacucuuuaagcauaauauugugggccaggcacgguggcucgcgccuguaauccuagcucuuugggagggcaaggcagggacaauugcuugagcucaggaguucgagaccaaccugggcaacaugguguaaccccaucucuacuaaaaauacaaaauuagccgggcauggugacagacgccuauagucccagcuacugaggaggcugaggggcuugagcccuggagguggagguuugcagugagcugagaucaugccacugcacuccaaagcaggacucugucugacaaaaaaaaaaaaaaaaagauaauauuguguuuuuguucuuuuuuuaagauuccuaaucuuuuagaucuacaugcugaaaauuuuacagauaaaaugauacagugucugggauuugauucaagguaauccagagggaagaagauugacccaacaacaaagaccucuagccucauggcacaaacaagaaacuuuuuccaggguuuaguuuucucuuagaugauaccucuucauuucuguguauuuucuugcagaacucucagaaauugagcccaauguauuccuucgaccuuuucuggaagugauucgcucugaagauaccacuggcccuaucacuggacuggcacucaccucugucaacaaguuccuguccuaugcacucauagguaagagcucaggcuuuguugcaugaccacagcacuucauuucccaccuuuccuggggugcccaggccuuaggcaaugagcuggugauagugggaaauuuuuuccagucaccucuuuucuuguagaagagaaauaggauuguuguugguuauucaucaugcuagcugacucacguuguacagggugggaagggcaagagaagaaguuuuccuuggcacucuggcuucucuaugcuuuggaaagaguuaaggguaugguaccuuacucuuggaaguuugguuagguuuguuuguuuguuuguuuguuuguuuaguuagagauggagucucacucugucgcccaggcuggagugcaguggugugaucucggcucacugcaagcuccaccucccggguucaugccagucuccugccucagccucccgaggagcugggacuacaggcgcccaccaccacgcccagcuaauuuuuuguauuuuuaguaaagacgggguuucaccauguuagccaggaugguuucgaucuccugaccucaugaucugcccgccuuggccucccaaagugcugggauuacaggugugagccacugugccuggccugguuagguuuauuuuuaaaguuauuuuuucaaacauaaugcaugcacauuauaagaagacagacaauagagauguucaaaagaaaaguuaauuguccuuccuguacuuucucaauguuccuccuccuucuuuaggcaaauagugugaacagccuaguuugaaucuuuauguuuuucuaugucuuuauaaaugaaguaccauuccuuuuuaaaaugaaauaaggccgggugcgguggcucacgccuguaagccuagcacuuuggguggccaaggcggguggaucacgaggucaggaguuugagaccagccuggccaacauggugaaaccccguaucuacuaaaaauacaaauauuagccaggcgugguggcgggcuucuguaaccccagcuacuggggaggcugaggcaggugaaucgcuugaacccgggaggcggaguuugcagagagcagagaucgcgccacuguacucuaaccugagcaacagagcgagacucugucucaaaaaaaaaaaaaaaagaauagaauaaaaugaaauaaaaauaggauuaugugcuacauauuuucuuuuuucauuuaaugguauuaacuugaccaggcacaguggcucaugccuguaaucccagcacuuuuugaggccgaggcggacggaucaugaggucaggaguuugagaccagccuaacauggugaaaccccaucucuacuaaaaauacaaaaauuagccaggcagggugguacgugccuguaaucccagcuacucaggaggcugaggcaggagaaucacuugaacccgggaggcggaaguuacagugagccaagaucacaccauugcacuccagccugggugacagagcaagacuccgucucaaaaaaaaaaaaaaaaaaaaaaaaaagcagauaguauuaacuuaaauguacaugauauaacuauucaucugauuuauucuuuuauauuguagaaaauauauauaaaacuugcuauuuccaucaguuucaguuuacaauucauuggcauuaauuacacucacaauguugugcagccgucaccaccaucuauuucccaaacauuuuuauuaccccaaauagaaacuuaacauaauggggaguuaacauuaaccaauaacuccccauuucucucuccccucagccccuuguaugauuuuuuuuacuagcucuauaauuuccauaguguaauauagauauaacacaauucaugugcucauucuuaauauuuaagauuguuuccuauugaagucauaaauaaugcuaauauaagcauccuugaucacauguccuuauuaauaauuuuuuuaauuuuuauuuuuaguagagacgggguuucaccauuuugugccaccacgcccggcuaauuuuuguauuuuuaguagagacaggguuucaccauauuggccaggcuggucucaaacuccugaccuugugauccacccgccucggcuucccaaagugcugggauuauaggcaugagccaccaugcccggccccuuauugcuaauuuuacucuuguaugaaagauuucugaacuuggaauuucuggauuaaagaccacgugcauauugcauuuuuauagcuauuaccagguugcuuccccaaaagguuacaucauuuauacuuccaccagcagugauugagaauuucuacuuccuuacccugucaucagcacugaauauuaucaguuuuauuugugccaacuugguaaguaaaaaaugauauuuuguuuuuauuuuuugagacagggucuugcucugucacccagacuggagugcaguggcacaaucacggcucacugcagccuugaccuucgggcucaggugauccucccaccuccgccucccaaguagcugggacuauaggcacacgccaccacacccagcuaguuuuuguacuuuuaguagaaguggaguuucuccauguugcccaggcuggucuugaacuccugagcucaagaaauccaccaccuuggccucccaaagugcuaggauuacggaugugagccauugcacucagccuuuuguugcuuuuauuuccuggaggcugaacauuugaauuuccuguccuucacuucuuuuuuuaauugaguuggguuuguuuuucaugucaauuuguaggaguucuuuguaugguaggaauauuaacccauugccuuucauagcauuacaauuauuugcuccuaaucuaggccaaauauuucccuuaaucuguaguuuaucucuaaauuucuucauggugucuuucuuuggauuucuuuuuuaguuggucuugacacucaauuugggaauucauuuucccugauuggcagcccauguacaaggaugaagaauauagaaaacaggcagcugucuuuguuucuuaagcagggagacaagaaaagauaaggcucaggcuuuagcuagccagaaaagaaaauagucuucaguucagagcaagaaaacccuuuauucuagaaauguuggauuugcuuagcugaugcauucaggauccugagcaggaauccuggguaccaacuagcuucugaacaggugcaucagccucuccgacacccuagucccagcuucauacuuuuccuaaacaaaaucaggcccagccacuuccagccuugcccugagcaccaccugcaggucaucuuucuucacagccuccaguggcugccgcugcugugccuuuucccucugcugucuuguugguguuacucuuuccucuuccuggacuuggcagacaggcuggucauuggagaccucaggccaccuggucauuggaguuuccuguggugggaaaggagaaugcuggaggugguuauugcagugggcaugagaaaaggagcaggaaggaguguaugaaagccaagaaagcaaaggagaugggauuggcagauuucccugaaguugguuccagaguagccagaagaggaggacauuuuaaagaaggguuuaggcugcucuucuagaagaaaacuccugucucuugcuccuaugauccaagguuucagggauuauuuuagauccuccaaggacuagccuuuuguuuggccccauacagcugccagaccagaauuuuugugccauggauuucauggguugcuagcaagccuugccuaugguucuugucaaagaccugucacucuagucugccuuuuuauuuuuauuuuuuauugguuuuuauugagacaguucgcucuguugcccagguuggagugcacuggugugaucuuggcucacugcaaccuccauuuccugaguucaagcaauucucaugccucagccucccaaguagcugggaccacaggcaugcaccaccacgcccggcuaauuuuuguauuuuuaguagagauggggucucgcuguauuggccaggcuggucucgaacuccugagcuccggcaaucugcccaccucagccucccaaaaugcugggauuacaggcaugagccaccgugcccagcccauaacugccuguuuagaaaauuaacuuugcuacuucauucaaccucaggggacaagaacuacaaagagaucaguagagcuuaaaccccauuaauggagucucucugaaucuauucugguugggggauggaaggagugucugauucaaaguaauaauuuaaaagacaccuuaacaagagagauuacugaaagagaggaagaaauggauccccaggagccuugugagaugggaacaaggcuacuauucacuuaucucugaaaugcuacacaacacugagaaggaccuggguuuccuaugugggcccugguggccuggguagggacugucaggcagggcuaugagauagaggcccugagaguaugggauuuuuuugugcugaucgggagaaacguggagagguggugugauaggaggagcugggucaccccauuuuauuauaugucaugaaacuggcuuccuucugcaugaccucuaaaguaacuacucccagugcugaguagaaggacacuguaaauaggacaaagaaagucuugauguggugucggaggcuaaugaggacagaagaaaaagaggaaacauucacaauuaguaaaagacuucuggcuuaucauugcaagagaaauguuugggggccaggcacaguggcucacaccuguaaucccagcacuuuggggguccaggcaggcagaucacuugagcccaggaguucaagaccagccuggacaauauggggaaaccccaugucuauaaaaaauacaaaaauucuccuggcauguuagcacacaucuguaguccuagcuacuaaggaggcuuagguaggaggaucacuugagccccagaggucgaggcagcagugagccaugauugcaccacugcaccccagccugggcgauagagcaagacccugucuauuuaaaaacaaaaaaagaaaaaaaaaaguuuagguucucagccauccccugagcuuuaggcucaggaacucucugauuucagguaccaagaaagagaaaaugggcugggcacaguggcccaagccuguaaucccaguacuuugggaggccaaggugggugaaucaccugaggucaggaguuugugaccagccuggccaacauggugaaaccccaucucuacuaaaaauacaaaaauugcugggugugguggcaggcaccuguaaucccagcuacucaggaggcugaggcaggagaauugcuugaacccaggaggcagagguugcagugauccgagaucaugccacuggacuccaucuggccuggaugacagagugagacucugucucaauucaaaagaaagagagagaaaaaauaacaacaaucuuauaauuccugugacuaaaauuaggggguguuccugcauuacaccaugccaccucuggagcaacuuucucugucacucacaaagcuuuuucauaugccugcccuuucccccuacuuaggcucccccuuuagaacuaaacagcucuggaaaggauccuucagagcagaccuagggcaggagcuaggcaagacccuugauggugacaacuuauuuggcuauuucucguggcuauuuaauacaugaaugggagcugaguucccugcuuaauagcauuuguguucauuuccagcguggugccgguugucugaccucuagcuucuccccucuuauucuguacagcugaaauucucccuccugccuaccccccagcuagucagccuccaguccuguuuaguuuaucuuuuuucucuccuaaugccuguuaagcuggaaacaggauucuugcucgucgucauauuauuuuaaauaagaaugaaacuaaagaagaggucuuugggccaggcaugguagcucacaccuguaaucccagcacuuugggaggccgaggcuggcagauaccugaggucgggaguucgagaccagccugaccaacauggagaaacccugucucuacuaaaaauacaaaauuagccaggcguggcggcgcaugccuguaaucccagcuacucgggaagccucaggcaggagaaucgcuugaaccuaggagacggagguugcagugagccaggaucucaccauagcacuccagccugccaacaagagcgaaacuccaucuccaaaaaaaaaaaaaaagucuucaaucugcuguaauguggcacucagauaugaguauuggcggcagugaguguucauuuccuccuccugcuccccuaauucaguugcgccugaacacaaaacuccaaaagcaaccagagagagaagcuguguugaaagaugaaaggagaaaaggccacaagcuuuggcccuaccugguucuuguucugagucaaaaacucuuguuuccaggccccucgucuaugaaauuaguagauuuauacuagugauucccagaguaugguccccugcucggugguguuuaacuucaacuggggucuuguuagaaacacaaauucucaggccccacucugggcauacaaaaucaaaacuuugugguauggguccagcaauugagaaccacaguuuuacccaguggauuuuguguugaggagcucauuaaaaccaguuauggggccgggugcaguggcucacaucuguaaucccagcacuuugggaggccgaggcagguggaucaccugaggucaggaguucaagaccagccuagccaacauggcaaaaccccaucucuacuaaaaguacaaaaaaaauuagcugggcaugguggugggcgccuguaaugccagcuacucgggaggcuaaggcaggaaaaucgcuugaacccaagaggcggagguugcaguaagcugagaucacgucauugcacuccagccugggccacaaagugagacucugucucaaaaaaaaaaaaaaaaaaucaguugugggcaaaaauucucagguagcucaaggagccacggguuagggaacugaagaggaaaaacugucucucaaagcuagacaggcugccuuaccuuuuaucucucuccucuccacaucacuuaaucuuuccuuuuucgcuggagcagaucccacccaugagggcacagcagagggcauggagaacauggcagaugcugucacccaugcucguuuugugggcacggauccugccagugaugaaguuguccugaugaaaauccuucagguaagcgagagggaaauagcaauuaggcuaauggccaggggcuggugccgcagacucuacuuacucugcccacagcaugaaacuguguuuugacuccacuggggcuuaggggagcuacuuuguuuccagacaagcagcugggguacccaaaguaaaagcuuuuucuaaggaaaaucaguaaaagcuuuauaugaagugaugucaaauaccagaagccuuaaauacacuuguaccucuggccgacuguauuugugccguccaucucuugggcucaugggcuagggcuagaaucaguucugaaauaugucagggucauaaaaagugaagaaacaauuccaaggacaagcuucuuggagaccucucuaccaagcugaggugaggucagcauucuugcuaaccccucucucuuacccuugaguaccucucaguaccuuguuuaucacaguaauuccuuuuucuuccugauagguucuacggacucugcugcuaaccccagugggugcccaccuaaccaaugaaucugugugugagauuaugcagucuugcuuccggaucugcuuugaaaugaggcucagugguaggugcuuggauauuagccccuucaccauuccuggggccagugucugaguaugaauacaggaggcugucuucccagagagauggaaaauucaggacuucuccaucaucuaucucaugcgaucauaggggucuagaagaaaugucuguacuuggcuauugugaagcuagaauagagaccucagcccauuaugccagggcaggaguugggauggaucccagauugacuuagcccaggcaccaaaucacccucucuugggguuucugggauugacaccaaccugcaacccccuagaacacaucuauaccuccccuuuuuucccugacucaguagugccaccuagugggccagugaaguucuggcugccaggcugagcuggagcugguuuuaauaaguuuggcauaauccuugguaaacaagguuuggaggggagucugcucugagaacccucuugauaauagcacagcaaguaaugacaccuguguuauuuguuuuugccugugcagaguuauugagaaaauccgcagagcacacucucguagacauggugcagcugcucuucacaagguaaaccugcugcuguuugcuucagcccggcugcccaggccucuugagucugccugcuuccacacagccacgucagggaccuggccaaccccacagccgcaucagaggccacugggauuauggaugggggguaguucucugggcccaggguuacugagcaagggagaaggaggagggagcugauuuggccucacggggaggcagaggguuauuuaauauaggccagcagaccucauucugcuucccaaauuugugucuguuucugugcagguagcagcugggaaagggaacccagagaggaagccaaacucaagggaucaugauuucugugggagagggccaaaauuagggugacuagcaauugugaauugccugggacuguccugauuucagcacuaaaaguucugcauccuggcaaaccccccucagucccaggcaaaccaagaugguugguuacccuuugguaaggcccuuagccuagggccuaggaggccuuuucauacuaggccuguuuccugcaccuccuuucaacagacucacagaagagcugaggcaauggcuuuaaaccuuccucugggauuucuuuuugcucucaaaucuauagauaauaauccuuauuaucuacagacuagacugcccuuggauccugcugcaaagaauuuuuugcuccucaggcucaaauuuacugguuucaaaacuucaaccugccuguuaauucuucucuuuugcccacucuccuaggguuuugauagacugcccuccccccaucucuuggcagcaguauuugccaaguaaauauaagcaggaaggaaucagucucaggauaaaaagagccuccacacuccaagggcacuuaccuugcucucacaacuaccuccuuuuguccaugucacacaucccccgauuccuguggcucuuugaugaagcucugaaaaggaugaaauuagucugcuucucuuuuguagccuuuucuaagacacagggcaugcucuggcucagagcaccuuugguuuguggcuggcauggagggagacauuugucauuaucccuaaugacaguugauggauuuucuaucuuauagguuaccucaguuuaaagaagaacccaagaacuauguggggaccaacaugaagaagguaugaucugagagcugaucugcugucccucauccaaaccuuaaucucccaacuucagugccuugggguaaccuugcuuagcaaagauaugcuuuugccuaaacaggucugcuuggaaucuagaaguagcucucacuccuuucgugagaaauguauucucuuccagauauaucccuuccucagcuuuucugcucuggccuaucuuugaaccaccauguaagcuggugagccaguucuucauggaaacugcaugguacccaucagucuuggcuaaaaaugucuguugacaaagaugaaaguccugccauccccucaagacuuagccuuauccgcagguagaaggccuagagaggcuaugucccaaauccuaccucaaugcugaauuagacugggcucuugcuugugcuagucuguauugaagagauuagucaaguuaagaaccaaaggguucuuaaacugcuaggagaagaauaguggucaaaagaauggcuucuuucuaucuugaacugaagcccuggacuucacgggccucugaugaggauuccgcuugcagcccuaagagggucuaccuauggagaugacccuuagcugugugaugcaugcaccugaccuucuccucuccccugucauccauccccauuccugcccuguucccuguugguaugugucugaguuuauuucacuguuaaaucgugcguuugccugucuuucgcagauaucuccaugucuccucaacaaacuggagcuaaguaguggggagcagaccaaagcccugaaccaguuagagaggguacuacucuuuaagaaccucaaggucucucucccucucuuucccuuccccuuuuuauuucuuucaauguuuauuuuuuauauauaacaccugggucccauuuccauuguguagagcacaacuuacuccucccuaguaacacagcacggcuuuggaagaguugcacgugauuguagcuuugcaguguugggaauucuccuggggcaucugguugccuggauacaggagaaggaagacuugaacaucacauaguuagccuagaaagccuggggucugcuguuaccuuguggggaggcuuaagaucuaccauuucuagggaaaccgugagggaccuucaagcaagacccuucccccuucuaccuuauccuugucucagagcuggcauagagagcuuaagcacaguccucagcucuaucuggauuaccuggacuggguuuggagggaaaggguaguccaucuaguugggaucuuuuuuuuuuuuuuuuuucuugguuaccauuaaagaggucauuccaaggauuagaacucuagauugauggaaagaagccaggugccaggauagcccaggacacugggaauacuuugggaucugugaagaugcccucuguccucuaaaagucaagguauaggggagcuuaggggagggauccaagcuaaagauuacccuaaucugcauauaccugccuuaggaagaaaggggagagaaggaggugugggcugucugggcuguccaucacaagagugugcaugcugaaggugugguuguggacauacaggucacugaaaguaaaaaacucuguguauguacaccuagcuagauaguccauuggcccguguucucuuugaaugcauugugucauuucauuugugugcuugcacagucucaagcugcagcucucauuaguggcuauccagcauguugccaugauuauuaaccugggaccugcuccuuuuuuguaaagcuuacacuguccuuuggaguacagagucauacagauaagguggcguagaauuccaugaauaccuacugcccaccccacaccuucagaccuuaggagagggagaauagcuauaccuuuuaagggcugaggcauucgugagaacuggcagccucuuggccccuacuccagccagcaggcugagaacacuaauugaaaugaucagguuggagcaagcuuugcagaagauagagaaggaaacgugaaaaacugauccucguaugggaaggaaucucaaugacugacuggcuucucaguggaaguaggacugccuggagucccugaaaugggggagccuccuggagagaaaggcuaccucauaaaaguagauccaguucuuaguacuuuugggagcucaaugauaacugccaguagagccaggaggucucucauugaucucuuggccucuugcccuuuugcauguuuggcggacucuucucccauaacauuuuuuacuaugaacuugauccaguugagcuccagugguuccuggggagagaauccuuuugcuuccuccuuagcuauagcggucaguacgccugaagcucaguucuaagcauaugacugcaggcauuuuggagauggaucaucuagaaguauaaauccaguaugaggcuguugcuauguuacuaagagcugggggaaggaagggcucagcuguucagccucaucuuuauuggaaggagcuauggguaggaauggaagaauugugugguuucuaagcaaggaaucaaagauuacccagguucugagagcuugggggagcuugaggaagggagucaaucccucacuaucaaaaggaauugaacaggccauggacaauaggauauauucagccuuuaggaagaggcagagagaaaaagugcuucugcucucuuuagagucauucuaaugguuucuggaagaguguugccauugcccaauccaggaaugguccaauccaagaauggucuaucagucuaggaauaguuuagaaugacuuuguagagggacugaguucaaacccaacugagaaaacaucagggcuuaaaaaacaaauugggccgggcacaguggcucacaccuguaaucccaguacuuugggaggccaaggcgggcggaucacgaggucaggagaucgagaccauccuggcuagcacggugaaaccccgucucuacuaaaaauacaaaaagaauuagccaggcuugguggcgggcgccuguagucccagcuacucaggagacugaggcaggagaauggcgugaacccaggaggcggagcuugcagugagccaagaucacgccacugcacuccagccuggguggcacagugagacucugucucaaaaaaaaaaaaaaaaaaaauggggccuaaacaaaguaacuuugaacuuagaauggaggaaauacauaaaaacacagauccuagggaauaguuaacaaacaggugauagagauugucccuugccacuaaaaguaagcuauaggaagaacagaaauacagcaagaggggagugcaacagagcaaggagucaaggaaucaguggccuuaccaucugacaacauaaaacugcaucuggaaagaccaauagugagagggccagagggacagguagucucauugauauaacaaauugggagcagcagagagcacagcagcagcgugacaugaccuucuauccugaacuccacaaagaaacugggaggccacuccuuccuuaacuccaaggaaugagcuuuugaccaaucugauacagaaauuccagagaguaagagauauguuagcugggugcaguggcucacaccuguaaucccagcacuuugggaggcuggggcaggcagaucaccuaaggucaggaguuagagacuagccuggccaacauagugaaacccugucucuacuaaaaauacaaaaauuauccaggcguggugguccacaccuguaaucccauuuacucaggaggcugaggcaggagaaucacuugaacccaggaggcagagguugcagugagcugagaucgugccacugcacuccagccuggguggcaaagcuagacuccaucucaaaaaaaaaaaaaaaaauauguuuauggcuuaggcccagcucacauaccaguaagaaaaccaggacaggaaggaauaggcucuuauaguuggauaaaacuacaaguaggaggcugcucuacaagcuaguugaggaggaaagccgagagaccaugcaccuguagaacugagugucagggcaaaggaaacccugcccuuacacuuucugcaagagggucaugcaucauccauagggcucgggauuuccugcuuaauguaacacucaggacccagagaagcagagugauaagugugaggacuggcccuaccaaugaccagcccagaaacagaaugucaccuucuacauggaggcugccaugccaaccugugaagugguaaauguagaagccaaguuagaagaguaggaaugugaacugauggucuagagucuuacuuuagcaaagauaugggguauagcuuguuuucuagagaucaguaggacuaaaugaagggagauuaauagggauagagucuuaguuugaauaccauugcuaaugggguaugauauuuccagcugaaaaugagagccggaggcaugagugauucauccaaauggaagaaacagaagagauccccucggcccccacgccauaugaccaaagucacaccagguucagagcugcccacucccaauggaaccaccuuaucaucuaaccucacuggugagugcccuggacuacuuccucugauuagacaaaagaagagcuccuuucucucuuagggauuuugaaauugaagaccaaccaacugaggggcuuuggucuuggcgcugagaacaaaaagggaaacuccaggucaaaucagagugugaccauucagcaacuaugcagugacuuaagguuguucucugacaacuuuagagaccaauauaugcaaagauaagcauguaaucugggaaacagagacccuaguaccauagaggguuuguuuugcccacagccucuuucuucuccuucaagcgucacauacuuuucuuggcagguggcaugcccuucauugaugugcccacucccaucuccucugcaaguucagaagcugccucagcaguggucagucccucuacagacaguggccuggaauucuccucccaaaccacuuccaaggaagaccuuacugaucuagagcaaccuggcucuccaggguacagcacagcuacagagccuggaagcagugagcuagguguucccgagcagccugaccuccagguauggcuuugauuuuuaaugucccucuucaguauuccacugugggaaauggcuugauccuuuggauccuuuaugcaggacuuggcucgaaagaagcuugggguaacuucaaaagaagcucugaucuuuccugcuucucagaauugguuguacugccuugaaaacccacagcaugacucacugugagagauagcucaugagauuuaucaaguuaugcauauagguaguacuugacaaaagggaaggagcuggccauugcuuuuucuggaagguaaugauccaaauccuaagccugugagaggcucugugucucuaagguucuagucauuguaggucagugaagccucaggagauguuuuucugaguccuucaucauacuccuaccugagccaucuugcggugauucauaaaccacugaguuggcccuacaucuguagcccauuagagacagcuuggaagacagcuacuucaggggaguaaguuccaaguugcucuugccucaucccucuucccauaucucccugcuacuggucauagcaggaagggacccauguggaaaagucccagucagcaucuguggaguccaucccugaaguguuagaggagugcacguccccugccgaccacucugacucugccucuguccaugacauggauuacgucaauccccggggcgugcgcuuuacacaguccucccagaaagaagguggguauucugguaggcucugccaauucaccucccccauccuaccuacuaagcugccugagccuagaccgucuuaaaccaagauauuggacuacugccuguugcuccaaguucuaggcuauuuucuagucaggaaauggagucaagccauagacuguuggcauggagggagcccuucccuaacuuauacuacagggaggaaguuugaugggcaauaggaagcaagaaggaagggaaaaaagcuuaggacuuuuaacagaaagguaggaucaucaauucugauuuccuccagaaguagacuaguccccucauguccccaggaaaaaaaaaaaaauccuuuuccuuuuuuuuuuuuuuuccugucgcccaggcuggauugcugcaguggcacaaucacagcucacuauauccucgacuuccuggguucaagcaauccucccaccucagccucccaaguauuugagacuauaggcaugcaccacugcacuuggcuacuuuuaaaaaaucuucuguagagauggggucucucuguguugccugggcuggucucaaacuccuggccucaaacaguccucccaccuuagccucccaaagcacuaggauuacaggcaugagccaucacgcccagcccuuuucuucaaagagaaucacuuaccuaaaauugccuuguguaaugcagagcaggcuaggcaaagccagcagacuaguuguuuuauagcagucucacucuccuccuggccuuccccaggcacagcuuugguccccuauggucuucccugcauccgcgagcucuuccgcuuccucaucucccucaccaauccacacgaccgccauaacucagagguuaugauucacaugggacugcauuugcugacaguggcccuugagucagccccuguagcccagugccagacccucuugggccucaucaaggaugagaugugccgucacuuauuccagguaagacaagauugcuagagggucucagagccucuuucaagggccaggggaacacagggaggucuggcugauuacgcaaagaguauaggaccuaggaaagcaucucccucccaguuggcuaguaguuuuaguaagaggguuccaguaguuccccagggacucuggcagccagagagaaauauaggaauggcuagauguagaguucccuggaagcaauggaccucagugacaccuucacucaguuugccucuucugccucucuugguugagccauagucagcuucagaaaccucacagccgggcugggugcaguggcucacgccuguaaucccagcacuuugggaggccaaggcgggcggaucacgaggucaggagauugagaccagccugaccaauguggugaaacccagucucuacuaaaaauaucaaauuagcugggcauggugacgugcgccuguaaucccagcuucuugggaggcugaggaaggagaauaucuuaaacccaggaggcagagguugcagugagcugagauugcgccacugcacuccagcgugggcaacagagugaaacuccgccucaaaaaaaaaaaaaaaaaacucauggccuacccugcucucaucuccagcuacucagcauagagcgacuaaaccuuuaugcugcuucccugcgaguaugcuuccuacuguuugagagcaugcgagagcaccucaaguuccaaauggaggugaguuucuugauguggaaagaaaagggggaaaaaaaauagggagauauauggcaucuucaguggggccagcucuaucaugcuacagggguaggauuuagggacuuccuauaggagaguccuuuuagccuccagaguucgguucaaucaacuggccucuuuuguggaaaaguuaaaaggagaccaaaggaaacuggcugaccccaaauaugagaacugccagguaaccuuaccaugaauagggacagcucuucugcccagcaguuacucugcaacacagguagguaagucaagccagcauugucacuaaauugcuaaaaggaacucuaaauaggaccaggucauguucacauagcacaaaagggcaagaggcaacuugucugggaccagguaugugguagagagccaggccuuaucccccaacauggaggccaaagaagagauauauuuaggggauggaauaccuuugggugucucuuaauacaugccucuaggcugggcuucugcauccuguuuaauguuuuuccugucuaauuuuuucucuuccuaucuugaauccuuuccccacccaaauggcaauuacuggguuauugccagauguacaucaaaaagcuuauggagaucaucacuguggagaaccccaagaugccuuaugagaugaaggagauggcacuggaggccauugugcagcucuggcgcauccccagcuuugucacagagcucuacaucaacuaugauugugacuacuacuguuccaaccucuuugaggaacucacaaagcugcuguccaaggugcugagcacuauaacuggcuucuaggaaaaaacgcauuauaaaggaaaucucccuggugguagugaggauguuacauacagagaggggaacacuugagagcugggaaauagaagaaaggcauuuucuuuucuuuucuuuuuuuuuuuuuuuuuuuuuuuugagauggagucucacucuguugcccaggcuggagugcaguggcgcgaucucggcucacugcaagcuccaccucccggguucacaccauucuccugccucagccucccgaguagcugggacuacaggugcccaccaccacgcccggcuaauuuuuuguauuuuuagcagagacgggguuucaccauguuagccaggauggucucgaucuccugaccuugugauccacccgccucggccucccaaagugcugggauuacaggcaugagccaccacgcccggccagaaagacguuuucuaagggcaauguacaaguuagaagaaguuuuggaaauuuuagaaaaugaucaaaguguaaaguguucuccuaacuacaaguccaauugaucuguuuacuuuccagaaugccuucccugugucuggucaacucuauacaacacaccuacuaucucuugaugcccuauugacagugauugacagcaccgaggcccacugccaggcuaaaguccucaacagccucacccagcaagagaagaaggagacagccagaccaagcugugagauaguagauggcacccgagaagcuagcaauagugagaggcauuucuuucuuugaugaacccaguguucuaugcuuaucccuucucuacucucugagucguuuuuccuguccccauaucacuuccccugggaugcucccaauucuguuucugggcuuuggcaguuuaaaucacaggccagucaggcagauuaguagaacucauagccuucucccuuuuuccuccuccccacuuugguuuuuuacagaauuauuauuucuuuauggcaagagaagagaacagagauuaaagaauauaggauuucugucucugaaagcuccaggucccaccaucccucauccccaauaucugccuccacucuaauuaguccucucuagcucccccuugaaauuugagguugcagaagaucagggaaagugacuggguaaucucuucauuaaauuagagaaucuaaugcuuggcugggacagggacuacuuauuuuggcuuggguuuguccugcucagggcuggcgcccugugcaggaaccaugcaggucuucugggcuugggauuugaucuauccugcagcucugcuuggcuucauacccuauaagucuucacguaucuucuucucucuuaccagcugagagaacugccagcgaugggaaagcuguaggcauggccucagacaucccaggccugcaucugccagguggagggcggcugccaccagaacaugggaaaucaggaugcagugaucuggaggaagcuguugacucuggggguggguacuggguguccaugacccuaagcuccucaccuggagggccuggugaagagcagagggagggagcagacaccuaggauaguaacuaagcaagccuugguagcccgccucgccuucagacucagagagagggaagcaaacauauggacccucaguugauaggacuuccagggaaguggaagacuggugaggacaagauuucugaggcuccuucuugaaacuggggaguauauuggugaccuuccaaaaguccuuaucuggguaaaaaaagguguuacagauauuuccccccucuucuuccuacuccuagcugacaaaaaguuugcccggaagccaccccgauuuuccugucuccugccagauccacgggaacuaauugaaauuaaaaacaaaaagaagguacauacauguauuccccagccucuguccaccucugucuggguguccaguguuguaggguuuccaucucagaagaugaaggagagucuagcaccucauuguacagcuuccugaggccagucuuugggcuuguugggacuucagcaacucccauuugaagcccuucccuuacuccuaagcuauguaguugagcauacccuauguaugccccugcgcaaaugcuguaccaguugagagccaagugucacuaguggcagugacaggagccuugggaguuggugucuugugggucauugaagguuacugucaucuccagcucuugcaagaugauuggcaauaaagggaaauugauauucauucuggugcuuuaguaagguucaaauaguaagguucaaauaacuguuuguacuuuggauuucuuuuuuuuuuuuuuuuuuuuuuuuucagacggagucucucucuguugccuaggcuggagugcaguggcaugaucucagcucacugcaaccuccaccuaccggguucaagcaauucuucugccucaggcucccaaguagcugggacuacaggcgugugccaccaugccuggcuaauuuuuuguauuuuuaguagagacgggguuucaccguguuagccaggguggucuugaucuccugaccucgugaucugcccaccuuggccucccaaagugcugggauuacagucgugagccaccaugucuggccuguacuuuggguuucuuaacacaaagaaaaccuaacccuuucuggccgggcgcaguggcucacgccuguaaucccagcacuuugggagaucgaggugggcagaucaccugaggucaggaguuugagaccagccuggcuaacacgaugaaaccccgucucuacuaaaaauacaaaaauuagcugggcaugguggugcaugccuguaaucccagcuacucgggagacugaggcaggagaaucaguugaaccugggaggcagagguugcagugagcugagaucacgccacugcacuccagccugggcaacagagugaaacuccaucucggaaaaagaaaaaaaaaaccuaacccuuucuuucucuuauugccagcuuaaaugacuuugguucaugugugcccuugaguaccuggccgugacuggacauacagaaauaugaguugccuccacaguuaguccacuuugucuuucaaacccagggcauuaagcuaggcaaccaaagaagcuaagcuaggcuaaaaacaagaggcuggcuaucaacaaaugucagggauggauauaaaacuggagagaagaauuaccuaguuucuuucuucuacuuuucccccaauccuaaguuagagaagaggaacuguuuuauguaucuugagcacucaggaaaggaguaaaaaagagcucguaagccaauucaauuagacaugaagaugggggaagcuaaggccauuaugaucuagccuuaguucuguaaucacuaagaaccacauccuaggagcuuuuuagcugaccaacugugggugggcuaugguggacuccaggcuggccuugucuaauuuagaggcaaaguagcuucuauaccucuaguuuuucucaugcagcugcuaaucacuggcacagagcaguucaaucagaaaccaaagaaggggauucaguuucugcaagagaaaggccuccucaccaucccaauggacaacacagagguugcucaguggcuccgagagaacccucggcuggacaagaagaugauuggagaguuugugagugaccgcaaaaacauugaccuguuggagagcuuugugaggugaggaagcuguaagaaaugugggauauagccagguaugguggcucaugccuguaauccugacacuuugggaggcugaggcaggcagaucacucgagcucaggaguucaagaccagccugggcaacauggugaaacccugucucuacaaaaaauacaaaaauuagcugggcaugguggcaugugccuguagucccagcuguucaggaggcugaggcaggaagaucacuugagucugggaguucgaggcugcagugagcugugaucaugccacugugauagagugagauagagugagauagagugagaucaugccacugugauagagcugugauagagugagaccuuggcucaaaaaaaaaaaaggugggacaugguuagugaucaguuuaaagggacagaacaucccuaccucaaagcggucucuauaaauuucuucuggagacccuagccaauguucuuccucuacccaucauuuauaucuauuggaccugaaagggacuccaacgagauaguuuggggagcccccuccauucugcauggaguccauuccaaagggguagagcaggguuccagggggugaggguucuaggcaagaguccguggaugugaaaaguauuaaggcuagggguuguguuagggaugaacaggagauacugccccuuuacuagagaccucagccuccucucuuccaguaagaguagguuaggaggacagugacuaaaagagccugacaugugcagcuuacacauuuucagccucuucuuccuuucuuucccuauagcaccuucaguuuucagggucugcgacuggacgaagcccuccgccucuaccuggaagccuuccguuugccuggggaagcaccagucauccagagguugcuggaggcauucacagagcguuggauggugaguuugagugucaggggcugagcccaggauccaaggucaguuugacugagggcugaagaauccagcugcugucucuuuuuuuuuuuuuuuuuuuugagacagagucucgcucugucacccaggcuggagugcaguagcgcagucucagcacacugcaaccuccaccccccggguucaagcaauucuccugccuuagccuccugaguagcugggauuucaggcaccugccaccaagccuggcuaauuuuuguauuuuuaguagagauggguuuugccauguuggucaggcuggucucgaacuccugaucucgggugauccgcccaccucggccucccugagugcugggauuacaagcgugaaccaccgcacccagccugcugucucuuaaaaagucagagagcaaaauuagugaccuuuccacaaagagaucagcuucuguuaaggaguuggcaagagacuggccacuuucuggaugguaccucuccucuguacuagcacugaccaguggguugguagugaggguuuaauuggccagagaagggcauugacacaggcgggaucuuugcuuuuucagaauuguaauggcuccccauuugccaauagcgaugccugcuuuucccuggccuaugcugucaucaugcuuaauacugaccagcacaaccacaauguucguaaacagaaugcacccaugacccuggagguaagcuugggucccagucaaggcaaagaagacccagcacagcuugggagguagcaggaaggacauaggauuuccagugggcaugauggaugggguucuguccaagggaaucaggaagggcuggccaaccuagaaaagggacugggguggggaaguggguuuuuucgcuuaccuuuuccuaaguccuauuuacugaaaacccaggaguuccuuagguggggcuucaguguugacacaaggggaaaaaacuuacuggccugucucuaggaguuucgcaaaaaucugaaaggugugaauggaggcaaggacuuugagcaagacauccuggaggacauguaccaugccaucaagugaguauacauagagaauagugcaguaucucuguuaagaagaagcacauugcuuccuuucccaguuuuuagagucaugucagacugcagugacucacaugcccuggauuuagccucaggacuuaguugggcagcccccucucugccaacuguuucuuccuuaaagaagcccaaaugauauugggacucuaguacucuaagccaggguccaaagugcugcucuuaaguaggauaucauggccccauuuucugaacuuaaaacagguacauuuuccuguauagauuacaagaugcuggcugguagagaacccaagaugggcacuggagugugaggcccagguuacaggucagaaaugggccacuuaguuuuuuacuguaaaucagaaaagguagaauuguucauuuuaucacaccuaguaagaaugugugaucuuacuauagaacuaaaggccucacuuacagauagggcuuugagauuaugggacacuuccuuucuuucugucugcucccacugguggguggaaagcagaccacugagcugcaguucugaugaccucucaucaguggagagugcuaguauggaugaacuccuagucuugguuuggaacuagucagguucaaagcagugcaacugcuccuucccuuaccuccugacaggaaugaggaaauuguaaugccugaggagcagacaggcuugguucgggagaacuauguguggaaugugcugcuucaucgaggugccaccccugagggcauauuccugcgugugccuacugccagcuaugaucuugaccucuucaccaugaccuggggccccacuauugcugcucucucuuaugucuuugacaaaagccuugaggagacaaucauccagaaagccaucucaggcuucagguagcccagcuuuggccuuggucuucaccucccacuagcucugugagcuaacaugguuuucuccaugccucucugacuccuacuguuacuucauuagaaugggguucccccugaguuuuuggagggaggcugaagcuuggguaggcucagucuuaaacagaaacaaaauuaaaagguuucuuccugggacugacuggggaagagccccaugcaagcucagggacuuggaagggcugcuuggccuuccagugacucuguuucugggaugggggguaacauuacaggaagugcgccaugaucuccgcccacuauggccucagcgauguguuugacaaucucaucaucucucuaugcaaauucacagcucucagcagugaggugagcaggugcaggaacuguguacuuggagcuccaaaggaggaccucucuuuuagccauggaucuacccuuaucaacagaccugguugcccucagcgucuucccucacugcccccacuugaauauaccagagcuuaggccauuucugucuugcacacucugggauaaaacuaguguuacuucauguaauggggaugggaaaggagauacaggaguggggaaggccuuaacuagguuaacccacucccaccaguauuaugggggauugaagcagagccaacaaaaggaccugagggaaccaucauaggcagagaccuaagagauuuuccuuuccagacauuagcucggccuuaagucuguucucuuccucuuuuccagucuauugagaaccugcccaguguauuuggaagcaacccuaaagcccauauugcagccaagacaguauuccauuuggcccaucgucauggugacauccugcgggagggcuggaagaauaucauggaggccaugcugcagcucuuccgagcccaacuacugcccaaggcuaugauagagguaauucuuaguaggagacuagugagcgauaacaaggcaagagcugcaacauuguaugcuaccuguacauagaaguaagugguugagaguaauguugggccugaugccugccacagcucaccaggaaugccucaaauguaagaccacagaucuugggggauagcuguaaaagaaggcugguagaugccauugccagucaccaauuggcacaauagcauaggggcagaagacuagaggaggaaauccagagaacuuugguggguggaggcgggcacaaaugcaaaggacacauggaaagaaauuauuuugacuuacuuuuccagguagaagauuucguggaucccaauggcaagaucucucuacagcgggaagagacaccaucaaaccgguaagagcagaccagaggcucaggggcuuggggagggagagucagaacuuuggggcucaccaggccaugugcccuuuuucuacagaggagagucaacagugcugagcuuugugagcuggcuaacacugagugguccugagcagucuaguguucggggcccauccacugaaaaccaagaggccaagagaguggccuuagaguguauaaagguaacugcccauccaccccuggugagaaagccuaaacaccuuccuauuagaugcuacuuggugaacugaagaauaaaucauccaggauuuguaaccagggcugacucugcccucucccccuggcucuuggggacauucuguucucuucagccuuugucaaagacccccucucucuuuugcccucucuagcaaugugacccagaaaaaaugaucacagaaagcaaguuccuccagcuggagucacuacaggagcucaugaagguaaaggaugaagaaaggaaacauggaacaacuggcugaaucugggaggggugacagggacaguauuauuucugucagggcagggccagugguuggcuucuuuuccaugccuacuuuccugcugcuguuccccuucaggcucuggucucagugacaccagaugaagagacauaugaugaggaagaugcugcuuucugccuagagaugcugcuaaggauuguguuggagaacagguaagaugagcguagucuuuaggcagaccccaugcugggcuugugccaaagggauggaagccaucuugcugagugggcucuggggaacuguaggcagcaggggagaagcuuacucaucauaccugucuacuuaggguauaauaccaaugaguccugaaaggccuaggggaccuguugcccaguggccccucuggcugagacuaucuucauuccuuuaugucuacacagggaucgugugggcuguguguggcagacuguucgagaccaucuauaccaccucuguguucaggcacaagauuucugcuuccuuguggagcgggcaguggugggguugcuacgccuggccauucggcuucuccggagagaagagaucagugcucagguaagcagaaugcaucuuggagagugggcagguaugcaagggauuaaggccacaguugucaauuaugaauauggccugagacagagaguacauuuagugccccauagcaugaguccagugaccaaccacagggcuggugcagucuagcgggugguacugggagugagccuggaauggccucaggcauggagcuuguguuuggcaccucagccuccuaugaaucugcuuuguaggacuggccugcuacugccuuauaauagucucagcccuauaccugguuuccugucaugcuuaugacccucuugagaucucuuugcuuaacuacaaaaaacaacaagcauagaacuaauaaguggauucaacaaggucacaggaugugagaucaauacacaaaaaguaauuauaucucuacaugcuaacaaugaacaauauggaaacugaaauuuaaaauacaauaccauuuacaaggguuccaaauaaagugaaauacuuaauauauagcugacaaaacauguauaagauuuguaugaugaaaacuacaaaacuacaaaauaaauugaagaagauguaaauaaaugaagaggcauacuauguucauggauuggaaggcucaacauaguaacuuugucacuucuccccaaauugaucuguaaauucaacauaacuccuauaaaaaucccagaaagguucuuguagacauagguaagcuuauucuaaaauuuagauggaaaggcacaagcucuagaauagcuagaaagaauaaaguggaaagaaucacucucucugggccgguugcugugguucaugccuguaaucucagcacugcgggaggccacagcgggcagaucacuugaggucaggaguucaaggccagccuggccaacauggugaaaccccaucucuacuaaaaacacaaaaauuagcagggugugguggcacacaccuguaauccuagcuacuugggaggcugaggcaggagaaucgcuugaacucaaggcggagguugcagugagcugagaucgcgccacugcacuccagcugggugacagagugagauucugucucaaaaaaaaaaaaaaagaaucacucugguauuaagacuuacuguccacuuuggggggcugaggcggguggaucacgaggucaggagaucaagaccagccugacuaacguggugaaaccccgucucuacuaaaaauagaaaaauuagcugggcgugauggugagcgccugauugcuacucgggaggcugaggcaggagaaucgcuugaaccugggaggcggagguugcagugagccaagauugcgccacugcacuccagccugggcaacacagcgagacuccaucucaaaaaaaaaaaaagacuuacucucggcuggacacaguggcucacgucuguaaucccaacacuuugugaggccaaggcaggcaaucaccugagguugggaguucgagaccagccugaccaacauggagaaaccucgucucuacuaaaaauacagaauuagccaggcaugguggggcaugccuguaaucccagcuacucaggaggcugaggcaggagaaucacuugaaccugggaggcagagguuguaguaagccaagaucacaccauugcacuccagccuggacagcgaaacucugucucaaaaaaaagacuuacuguauagcuauaguagucaagauuauguggugucgauggagggacagacacguagaucaauggaaaagaauagagagaccagaaauaagcucaacacaaauauguucaguggauuuuuugaccaagauguaagaacaauucaguggaggaggaauagccuuuucaauaagugguggagugauuaaaauccauaggaggaaaaaccaaaugaaccuugaccuaaaccucauaccuuacaggaaaauuaacuccaauggaucauagauuuaaauguaaagcuauaaaaacuuuagaaacaggagaaaaucuucaggaucuagagcuaagcaaagaauuuuuagcauguuuggcaguccuguggaucugucucuugccucaacacugucuggauggaacagauccgggggagacucucuuucaaaaaaaguaauaauuuuuagacuugacauuaaaagcacaaucuagaaaaggaaaaauugauaaguugggcuacauuaauauuuuuaaaaguuuuguucuaugagagccuaugugaagaggaugaaaagacaagcuguagacgaggaggaaauauuugcaaaucacauauuugaagaaagguaucuguaauauaaaaacucucaaaacacaacagugauaaaacaauccaauuauuaauagaaaauggacaaaacauaggaacagauguuucaccaaagaacacauacagauggcagauaggcacaugaaaugaagauagcaucauuaaccaucagaguacugcaaacuaaaaccacaaugaggcucacaccuguaagcccagcacuuugggaggcugagguggguggaucaccugaggucaggaguuugagcccagccuggccaacauggugaaaccaugucucuaccaauaaauacaaaaauuagcugggcguggucacacacaccuguagucucaccuacugaggagauugaggugggaggaucgcuugaacgcaggagguugcagugagcugagaucgugccacugcacuccugccugggugacagagcaagacuccaaaaaauaaaaacacaaugagacaucacuacccacuuuucagaauggcugaaauaaaaaguagugacaauaccaaaugcugaaaggacguggagaaacugggucauucauauauugcugggugggaauguaaaaugguacagcuacucugcuggcaguuucuuauaaaaugaaacauauaauuaccauacaacccagcaauugcacccuuggacauuuaucccagaaaagugaaagcuuacuuucucauaaaaaccuguacaugaauguuuauagaagccuuaguuguaauagccaaaaacuggaaucggcccagaugacuuucaauaggugaauaaacugugguacauacacaccauggaauacuauucagcaauuuaaagcaacagacaucuccagggaacuaugcugagugaaagaaaagccaaucuaaaaagguuauguaauauauaauuccacuuauauaacauuuuugaaaugacagaacuuuagaauuugaagacaggcugggcgcaguggcucacaccuguaaucccagcacuuugggaaacugaggcuggugaaucacuugaggucaggaguucgagaccagccuggccaacauggugaaaccccaucucuacuaaaaauacaaaaauuagccaggcgugguggcucgcaccuguaaucccaucuacuugggaggcugaggcaggagaaucacuugaacaugggaagcagagguugcagugagcugagauccugccugcacucuagccugggcaacagaguaagacuccaucucaaaaaaaaaaagaauuugaagacagauugcuaaggauuagggaugggggcaggaaggaggaggugggugugguuauaaaagggcaacaugagcugggcaugguggugcaugccuguaguuccagcuacucuggaggcugagacaggaggaucacuugcgcccaggaguuugaggcugcugugagcuaugaucauaccacugcacuccagccugggugacagagcaaaaccugucucuaaaaaaagaaaaaggcaacaugagggauacuguugugguggaacuguucaguauguuguuuugugguggauacccaaaccuacacagguaauaaaauuguauagaaauuaauacacacaaaaaugcaaguaaaacaggaaaucugaauaagaucagauaguaucuugauuaugauauuauacuauaguuuugcauaauguuaccauugggauaaacugggcaaaguguauaagggaccuuuuuguauuauuucuuuacaacugcauaugagccuauaauuuucucaauaaaaauuuguauuugaggcugggugcaguggcucaugccuauaaucccagcacuucaggaggcugagacgggaagaucgcuugagccugggaguucaagaccagccugggcaacauagcgagaccccaucuuuccaaaaaagaaaaaaaaaauuagccagguguggucacaugcaccuguagucccagcuacuccagagacugaggcaggaggaucacuugagcccaggaguuucagguugcagugagcugugauugugcuacugugcuccagccugggagacagaccaagacccugucucaaauaauauaauuaauauauuucuauuugaaaaaaaaaaaaaagaccagagcaguauccuaaauuggguccuagccaaacugucuucacuggccuaaggagacuggugggaaagaaaacuagacaggaagcugugugcccacacagcuccccgcuuccccgcucccugcccuaaccccacuccaggugcugcucucccugcgcauuuugcuacugaugaagcccagugugcuaucccgagucagccaccagguugcguaugggcuccaugaacuccugaagaccaaugcagccaacauccacucaggugaugacugggccacacucuucacacugcuggagugcaucggcucaggugugaagccuccagcugcucugcaggccacagccagggcagaugcaccugaugccgguaagcccuuucccagggagacucaggcuggcagauaaacaguuacaccccaggaguugggacaggaaaacaaaacacagguuacuguguucagcagauuaaacagcccuggcuccugccaucacuuccagagcuuccagugcccgcuggcuaguacccauaaguuaaauagcaugagggcaaauaagcaaugcagacggcugugaagccaggcuuccuacuguccugaggacugauuuguccugaggacuguuucccaguuucuguuucugagcugucccgaggacuguuuucccagaauucugggaaaauagaauucugugagcagacuuuauaucacuaaaucgauacaucacuaaaucccagaaacugggaaaacaguccucaggacaguggaaagccuggcuucauagccuucugcauugcuuauuuguccuugccaccacucccuagaguggugcuacagcugccacuagaugccaucaggaacccagauuagccugccaccuuauuuggucaacagagaaacuguuccggccauccuuuggcccucuggugacagaaauuaaacuaugccagagagaggggaggccaggccucagcaucuuuuuucugagagccugauuuaucccucaucccagugccccauccccacccugacucugcccuucucccugccuaccauaggggcccagucagauagugagcucccauccuaccaucagaaugacgugagccuggaucgaggguacacuuccgacucagaggucuacacugaccauggcaggccgggcaagauacaccgaucagccacagaugccgauguggucaacagugguugguuaguggugagugacaauaugggcagcaauugagucucuccugcuugaccugugggaagaauuccugguccucugcaaggacauucacacaggggccaagccuguguccccagcuccucuguguacuuuacagguugggaaggaugacguugauaacuccaagccagggcccagccgcccaggcccuucaccccugaucaaucaauacagccuaacagugggacuggauuuggggccacacgacacuaagucucugcuuaaguguguggaaucgcuguccuucauugugcgugaugcugcccacaucacaccugacaacuuugagcucugcgucaagacucuccggaucuuuguggaggccagucugaauggcggugggucagcugaugagggggcagcuggggaguagccaugcaauuaugcaggggagaggcugagaggggagaaaaggcaggguaucuaugccuauauagacacagaaaugugaccugagucuggcucugcucaggaugcaagucccaggagaaacguggcaagagucacaaauaugacagcaaagggaaccgcuucaagaagaaauccaaagagggaucaaugcuucgccggccucgaaccuccagccaacaugccucucggggcgggcagagugaugaugaugaggacgaaggcgugccugccagcuaccauacggugucuuuacaggucagucaggacguaaguauggcacccuuuacuuccucuccuccccugcaccugauacugggagccuggggcggccagggaaagccagggcugaggggaagggcccaugugugccagcccaggcccuggaccaccaucuucacaauauucccuuacccaaaaccuuaccuguaagucuuuauuugcuuaaauuuauuuauuuauuuauuuuuauuuuuauuuauuuauuuauuuauuuauuuuuugagauguagucucucugucacccaggcuggagugcaguggcgugaucucggcucacugcaaccuccaccucccggguucaagcgauucuccugccucagccuuccaaguagcuaggacuacaggcgcgugccaccaugccuggcuaauuuuuuguauuuuuaguagaaacgggguuucaccauguuggccaggauggccuugaucuccugaccucgugauccgccugccucggccucucaaagugcuaggauuacaggcaugagccaccacaccuggccuuuaaauuuauuuuuaaacuaagauuuacuuauuuuuugaguagguucaaaauauacaaaaggguaaacugauaaaacuaaguuuccaauccauuccuguccccagcuucugaguuccccucacuagaggcagccacugucaccaguuucuugucuauccuuccagaguuacccugugucuauucaaaggcauauaaaauuaauuaugugagcagaguuuauaucacuaaauugauggagaaccaauugccuuaaauagaauaaccauacaaaaaugacaaaaguggcugggcuugguggcuccugccuguaaucccagcacuuugggaggccgaggcggguggaucaugaggucaggagauggagaccacccuggcuaacacggugaaaccccgucucuacuaaaaauagaaaaaauagcugugcaugguggcaggcgccuguagucccagcuacucgggaggcugagacaggagaauggcgugaacccgggaggcagagcuugcagugagccgagauuaugccacugcacuccagccugggcgacagagcaagacuccaucucaaaaaaaaaaaaaagaaagaaaagaaaaauaacgaaaguaaaaauguauuaaaucuggccagacacuauugcccaaucaaagccucugagccugagguuuucuguuuuaaaaaugagauuaacagccagguacaguggcucacaccuguaauuccagcacuuugggaggcugaggcgggaggaucacuugaggccaggaguucgagaccagccugggaaaaauagcgagacccugccucuacaaaaauaaaaaugcaaaaauuaucugggcaugguggcacacauuguagucccagcuacuggggaggcugaguagcugaguaggugggaggauuucuugagccuaggagauccaggaggcagugagccaugauggugccaugcacuccaguuuugcacagagcaagacccugucucaaaaaauaaaauaagaaauaaaauuaggccgggcaugguauaaucacaccuguaauccuaaaacuuugggaggacuauugcuugggcccaggagcucaagaucagccugggcaacauggcaaaaccccaucucuacaaaaauacaaaaaauuagcuggcuguggcagcgcacagcuguaguuccaucuacucauaaggcugaggugggaggaucaccugagcccaggaguucgaggcugcagcgagccgugauugugccacugcacuccagccugggugacagagugagacccugccucaaaaaauaaaauuaaauuaacaacaugaggcuuucucugucaucagcaggugugaaauagaauugaaaagaaaguaucuuucucacugugaguaaggauugugaaauacucaguccacacaccuccuaaggcucucucucucaugaguaaucucugacuuggagaguccuuuacaaggacuggaacaaccaggaagucaagucaagggaaagaguagcgagggggugagguauggcaugauuggugcuagggacaccuugaggacuuaguuagggacagugaguggggagggggaaagggauccacgagaccuaaccccacucacauccugcccccuccugugauccuaguugcuagaccugaugcacacccugcacacgcgggcagccucuaucuacagcucaugggcggaggagcaacgccaccuggagacagguggccagaagauugaagcugauucucgcacccucugggcccacugcuggugcccuuuacugcaggguaaaccaggaggggcagagguagggaguuuggggagcaucaggaucaagaugccugaaggauccugacccugcucuugcucucagguauugccugccugugcugcgaugcccggcgccagguacggaugcaggcacugaccuaucugcagcgagcacuacuuguacaugaucugcaaaagcuagaugcccuggaaugggaguccuguuuuaacaaggugggacuuccuacuggucuuaagauaaaguucaaauccuaagaaaaggaaagccaggcagccugaagagccccuaaugugagucuucagccugcaucauaccuucccuucagcucuaugcccauccaguuccuggcuuccuuggggcaaggcugccuagcugaaccucauagggagacauugcacauuuacccccaccaggugcuguuuccucuacuuaccaagcucuuggagaacaucagcccugcagaugugggugggauggaggagacccggaugagggcuuccacauugcucucuaagguacugcucaccacccuauacccacccucucucccauaccugccuuuucccgaggagggaagccagggcuucuggcaggaccuagagaugcacuguaggugcucacaaccccccagcuauggacacuaagcaggaccuagggaccugagaggauucugaaucuuaaaucagagauuccuccaucucugaucuaagauucucaugcaagauaggacaggcuuagcuacccagccucagagagggguccagaggcuccuacaguccccucagcugaagggggcuggugggccauaggucuuccugcagcaccugucuccacugcugucacucucuaccuuugcggcccucuggcucaccaucuuggacuucauggacaaguacaugcacgcaggcuccagcgacuuacugguauguucuaccucagcucugcugccugccuccugucccaccuguuggaaggacuugcccuuucccccuugguagcuaccucccuuuaccauacuccccccaugcccucuuuccuauucucauggucccacugccaccugcagucagaggcgaucccugagucucugaagaacaugcuucuggugauggacacagcggagauuuuccacagugcagaugcacggggaggcggccccucggcccucugggagaucaccugggaacgcauugacuguuuucucccucaccuacgagaugaacucuucaagcagaccgucauccaggguagggggcucagcccagcuuuaucaaaaagagucuccugccugggcacaauggcucacaccucuaaucccagcacuuugagaggccgagguggguggaucacccgagggcaggaauuugagaccagccugaccaacauagugaaaccccaugucuacgaaaaauacaaaaauuagccagguguggcggugggugccuguagucccagcuacucaggaggcugaaacaggagaaucacuugaacccgggaaguggagguugcagugagccgagaucacagccugagugacagaacgagauuccaucucaaaaaaaaaaaguccccaaagcugaauuuauugucugugcccuggguggguagaaaggcuguuggguagcuagggcucugcuggagagagaaagcacuaagaggugccaucucaauucucuaccgucuccagaccccaugcccauggagccucaaggccaaaagccucucgccucagcccaccugacuuccgcugcuggcgacacuaggacaccuggccauccaccgcccccagagauuccaucugagcugggggccuguggugagucucucuagccuagccugauaggcacugaguagcaagcagggggccuaagaggaggcccaagggggcgugggaaugcugcugagcagggucugugagccgagggaagaaggccacuagagagaacuguugccgcucuucccaugggaaaugacaggaccauaagcuaugaggaacuagcugcuugcagucuucaggcuugggaagagaaggcugggucagggacuuggaaugaauuugcagagguuuccuuucagggauucuaguagagaguaaccuggcggccaggcgcaguggcucauaccuguaaucccagcacuuugggaggcugaggcagguagaucaccugaggucaggaguuugaaaccagccuggccaacauggugaaaccccgccuguaccaaaaaaauauaaaaauuagcugggcgugguagugcacaccuauaaucccagcuacuggggaggcugagguggaaggaucgcuugaacccgggaggcagagguugcagugagcugagaucaugccacugcacuccaaccugggugauagugagacccugucgcgaaaaaaaaaaaaaaaaaaaaaaaaaagaguagccuggcaaaggagauagaagguagcugaacauugaaaugaguuuugaggggagacucccaacuuuuuaggcugguggggggccguguugcuuacuggaacaaggaggaacagagacucuauaagcagccagcugggcaaugugagaguugucuuguaccaacaagggaaucugacuguaaccaccuugcuuucccuacagacuuugagaagcccgagagcccccgagccgccagcagcagcuccccaggaucaccaguggccucaagccccagcaggcugagccccacccccgacgggccuccacccuuggcucagcccccacugauccugcagcccuuggccuccccacugcaggugggcgugccaccuaugacucugcccaucauccucaacccugcgcucaucgaggccaccucaccagugccccuccuggccacaccccgccccacagaucccauacccaccucugaggucaacuaaggcaggucacucagagaucaggaccagugcuucccaccaggcuuuccuugaccccacuucuggcuguccugcgggccacaagcucuucaggccaagucagagcugcuguugcugccacuuggauggggaccugaaaaagagaauguugauagccccagcuaagacccccaaucagcugugggaccuuuuuccuccucugcgcuccauuccuggggguucagccugagagugaacucagcugucaucugcagccucugccuccagcccggcagcucuggggaggcauccgugugccggcccugcagugccugcccacggucaggcauugaaaacuaagcccaaccacucugcacuuuguuucccacucccauuagcccugggccaccuccuccaguucuuccucuuuuacuaauuaguuggucaguuuggagaguugacuggcaccauggaggguaggcaggugggggcugggugggggacugcccacaggagcauguacauauggaaaaacagaacaacaguggacuuuuuaugauauaauaaaugucuuaguaccagcauca

SEQ ID NO: 192796 - RNA, 10752 nt, Homo sapiens
agggauuuaaagcaugcuuauuuucuuauaguacugcuuugguauuaucacacaaauuuucuuuuauggcauuugaacauuuguuauuuuaaaaauauuaucuuccggcacaaccucuacaacuuagacguuauuuagugaaguauuuuuuccauguuuuugaucaccauuuaauucuauguauguuguuuauuuccauaaaaaaacaaaccaucaaauaauguauacauuuccaccuguucuaacauuucuggcuacuuuuguuucauguauuuuguuacgauguucucuagugacuaaauucaguacaaauacguuuucauuauuuaauauaaauuuuaucuuauauuuacuauuaaaauuuugauugugaaagguauuauuuuaucacauacauuguaagcaaucacugcuucuuuaacauuuguuccagcaugaagaaaacuuagaccaucccuucauuuuaauuuuuuucuaacuuaaguauuucuuugcuucuuguaaugacugcacuuagcuuuguuuucuaaauuaguggucuuuucaaagguacauugaguccaucuguauuuaauaauacugcaauuauuaauacauguuuauagaauuaguacauaaauuaaugccuuuucagauccuucacauccagcuuuuuuaccuuaaguuaauauccauauguaugagaaauaaacguaaucugauaaugcuuaguuaacuugaugauuggacaauaacaauaugaacuauauuggauucacuguuacuuccucuuuauuccugcagugaaaacaauauuuucuuaugucagauuucucucaaucucuuagucaaugaagaccugaacuacaacaauauagagucccauuuuaaauucaaacaaagauauuuagguuugacaacagacucaugguaaugucauuuaaaaagauggauccaaugaacacagacaaacaucaaaguuuucaccauggcacaaaccucugccacaaucacucauaauaauucaacugccuucauauuuggcaguaacgucaugcaagugaauuugcugaugauuagcaaaauuacaaaaugaaagucaaggucacuuaaucaagaauuacagcaacaaagaaauucuaggaaugcaggucaaggcaagaggcugcagcuggccugauaaugauaccacuugccuaauguucauuuaggaauuugcuaucacaaauaaaacacguaucuccucugaguuacuagaacagaaaaggaaacaaucagguauuacuuaucaccauuauaugaccaugaaauuaaaauauuuccuuaauaaugauuaagagaaaaaaaucauucucauguguucauaauagaagcucuauuucugaauuuaaaacacuacucaguauuugcuuaaguacugaaauuuagacaauauagcuuuugacauauuaaaaguucuauaggaaaaacuaagaccucuuaauuuugcuuuaauaucaaacuaaacagagcagaugaaaaaauucaauaagagcauggguuaauccgauucaagaagugcuuccaaaauucaaccaccucgcuucuucuuaggagaaacuguacaucaacacagaacuuuucuuuuuuuuuucuuuuuuuuuuuuuggagauggaaucucacucugucgcccaggcuggagugcaguggcgcgaucuuggcucacugcaaccuccaccuccuggguucaagcgauucucuugccucagcuucccgaguagcugggauuacaggcgcccgccaccacgcccagcuaauucuuuguauuuuuaguagagacgggguuucaccaucuuggccaggcuggucucgaacuccugaccucgugauccacccgccucggccucccaaagugcugggauuacaggcgugagcuaccgcgcccggcccuaacacagaacuuuucuaacuuaacuuuuggagaagaaaauagaaaaccaaacccagaggacagcuguguaagguauuuacuccucagcauuaggcaaaggaguccuacagcacucuuacaugucauucuauuucaacagaugauucaacugguccuguagauccgaugacuguucaacacuaggaauuagaauagagacaggguuuaucugaaaugagcaauaauaaagacaucuuuguacaacuauuuacaaauuuuuuuuuuccauuacagacagggucucacuaugcugcacaaggcaaucucaaacucugggcucaagcaauccuccagccucagccuuccaaaguccugcaauuacaggcaugagccagccacuacaccuguccuguacaagcuaucuguacuuuaaugcauaaauacuguugcauguaaaucaaaauuuauauugguccaguugugucccagaaguguuuaaacucugaagaaagguuugcaaagccaauuaguaauguaaacaauguugcaagggacaaauuuaauccauuuuagaaaacaaggcuguuuaaugguuuuugcacauuuacucugcuuaaugaauauuaccaauguaaaagguuuucuacuccuuaagguuggucucuauaccccauaacuuuuagaaaguuuuacuauuaauagcagugaguugaguuacugcacaccuuugaaauaugcuguaucuuuaaaucccaagugaguaucccagagcauauuucaauuugagggcaggugucaaccaggguuuuguauugauucuggacccagcaguauaaauccccccagccugcuucaguugguucccuacuccucuaccuuugggguuacuuacuucuucugaauagcuucuugccuaaaucagaaaaggaaagaggaaaauacacauaagugaacuaauaaguuucauuuaugaccagauaauacauauaggcagaagaaauuucagcuuaugucacauccuguauuucuguccauccuauccuaagauugugcuauugaacagggauuccugucugagugcagagcugcugaaaagauggaaucuaaacccaaacagauaguaacauucucccagagugagaaaugugguucaacagacuacaugcauggcuuaaaauuagucuguguauauggaaucaaauggucacauaccuaauaccuaauauguagauacccaaagaaugacuaaugauuaugacaaacauuagcuauuuaaauaucgaagagugaaauuccuaaccauauauauauauuuuguuuguuugcuuuuguuuuuguuuuuuuguuuuuuuuuugagacagagucucacucugucgccaggaugcaguggaguggugcccgaucucagcucacugccauuuccgucucccgggcucaagcaguucuccugccucagccucccgaguagcugggauuacaggugugugccaccacacccggcuaauuuuuguauuuuuaguagagacgggguuuugccguguuggccaggcuaaucuagaacuccugaccucaggugauccaccugccucagccucccaaagugcuggaauuacaggcaugagccacugugcccagccucuuuuuuuuuuuuucuggaggcagaguuucacuuuugucacccuggcuagagugcagaggugcaaucuccacucacugcaaacuccaccucccagguucaagcaauucucaugcuucagccuucugaguaucugggauuacaggcacccaccaccacacccggcuacuuuuuuguaucuuuaguagagacgggguuucaccauguuggccaggcuggucuugaaccccugaucucaggugauccgcccuccucggccucccaaagugcugggauuacaggugugagccaccaugcccagccccaaccauauauuucuaagagguacauaaguauaauaucaaguacauaaaauauaaaacaacaugaaauaagaugaagagcaaauuauaauggagaaagagggggucuuauauuucaaaauucccuacaugauuuauauguagcaggugccacacuuaccuauguaccauguaggauacagguauguuauacuucauucccuaguagaggacccaacuuaacuucccagaagagaccuugggcacagucagucaucaaauacugaucaacggccucacaggugccaaguacagugcuagcaugguccuggcacgggcccugccuuuacaggguuuauagucucucucugaggagcccucaauuuaacauggggagguucauaaaggguggacucugcuccugauucucauccuuuacccccacuucuucuguagucucaggcaucuuugccaucgagaaagucauccuuggccacccccaccuuuacucccacucuggccuccacaggaaagugcugaagcacaaaguccaugaaagcagaccagggauaaugauucugcagcaaauaguugcuggagggggcauacucacugguauugaagauguguuguuauuauugccaucuuccuuaaacucugcauaaaaaagagagagagaaauagaacauuuccacuucccuguggccacacaaaccauauacauaaacccaaaucauuaaaaaaaaaaguuguuucuuacaucuucugagugcaagauggcaucuuccuggaguaccauguuucgagcugccugaccuagcagcuggaagacaaaaauaaaaugguaauaaucaaaauucccaaacuuccuguaaucuucucucugcagcuguuacacuacuacccucucuccucucccacuccuccacccuauacaaccacaaacacucaaaauguaaugaaggauaauuuucuauuuguucauguugaaaauucauuucauuggcacuauggcaguucuggcauggacccgacaucuguuucaaaggccacugccugagaaaucaagugcuuccuaacugcugggcuguuggcacaguguauucauuaagugcuaagagaagucugcaaaaaaacuuuggcuccacaaguccagugagagaacaugacucguaauucuuuaaaggcagauuugagauuugggguuguuugaaaguaguaaagaugcaagaguuagaauggggcugaaaaggacagaggaauacagcuauuuagaaaugaaauaagagaaggccaggugcgguggcucaugcccguaaucucagcacuucgggaggccaagguggguggaucacuugaggucaggaguuuaagaccagccugggcaacauggugaaaccgcaucucuaccgaaaaauacaaguuagcugggcaugguggcugcgcuuguaaucccagcuacuugggaggcugaggugggagaauugcuugaacccaggaggcgaaaguugcagugagccaagaucucaccacuguacuccagccugggcgacaaagcaagacccugucucaaaaaaaaaaaaagaaaaaaaaaauggaauaagagaaacagugggggguguggggaagccaugaggagaagcucagggcuuaaaauggggaaccaccccauaaaagaugaccagacagggcugggaaaaagaaaagaaaggagauggccaggugcgguggcucacaccuguaaucccagcacuuucggaggccgaggcaggcaaucaccugagaucaggaguucaagaccagccuggccaacauggcaaaaccccucuaccaaaauuacaaaaauuagccaggcgugguggcacgugccuguaaucccaguuauucaggaggcugaggcaggagaaucucuugaacuugggaggcagagguugcagugagccgagaucgcaccauugcacuccagccuggcaacagagugagacucugucucaaaaaaaaaaaaaagaaaagaaaagaaaggagaaaugugcaggcagaauuuaaugagguuacugaguuuaauggguccugaguccaaaagagaaaagcagagcuuggauuuggcuggauggucuacagucaaggagagcugaccacauuagcacugagaggcaagcagagaccaacagagauuucuggccuaauacugcacccugcuccuggcauaccuaaauucagccaaguaaaaggagcuacuguuauguguauccuaccggcccuucccuguucucuugggucagggagacucuagugaaaaggguagcgugacuucaaaguaacuaggauugccagauuucuuccccaacacagggcaacuuuauuuaaaguuuuaaaguuaguaaccccuucuggaugucuaaagucaaaacaauaaaauaggauuuuccaucucugucccuuucuuucccuguucucucccccauaugcaaaacuauuuuuuuauuuuuuaauuuucauuuuuuugaaacaggguaucacucugucacccaggcuggagugcagugaugcgaucuuggcucacugcaaccuccgcauccuggauucaagagauucuccugcagcagccuccugaguagcugggauuauagguacaugccaccacgcucaccuaauuuuuauauuuuuaguagagacgagguuucacuguguuggccaggcuggucucaaacucccauccucaggugauccacccgccucagccucccaaaguacugggauuacaggcaugagccccuacacccagccccaugcauaacuauuuuuauuagcuuugugguuuucuuuccauuguuccuuuuuaaacaauggacacauguauuuauuuuccuccauaccacuuuccuacuuaaaauguaacauacuauguguacuuguuuacaccuugcucucucucucucucucucucgcucgcucucucucucuauauauauauauauuuuuuuuuuuuugagacauggucucacucugucacccaggcuggagcgcaguggcaccaucacuguucacugaagccucaaccucccggacucaggugauccuuccaccuuagccuccagaguagcugggacuacaagugcaugccaccaugcgcagauaguuuuuuguauuuuuuuguagagaugggguuuugccauguugcccaagcugguuucaaacuccugggcucaagugauuugccugccucagccucccaaagugcugggauuauaagcaugagccaccgugcccagccuacaccuugcuguuuucacuuugcaauagaucccugaggguuaucugcagcaauacauauugaaucuccuauucaauugcuaucuccuaaugaauccauugcucuuuuacaacugcagaguaccacacucuacaggugaccauaacauuauucagucaguucucugcugacggauuuggaggcuguucccagucuuuugccacgguaaguagugguacaaaaaauucucaaaucuuggaucuuaucucauagcuuuuacuguuacaaauaucuccuaucuuugcaucuuuuugccagcauauguuugggauggacucacaggacugugauuugugacugugggguuuuaauuuugcuacauauugccaaauuccucuccuuuagggcuguaccacuuugcauucccaccaacaauuaugagaguaccuguuccuccuguggcuacuuuuaaggguaaacuucaaacuccuauagaugggagauggugacuuacaaaccgauggcagaaaaaaaaggguuccaacaaucuacuucauucacuuacucauuuaauaaacauuuguugaguguuuaacauaugcccuuacucugguuaagagugauaacggggcucagaaucuggagggguuacaaagggaacauaggcacuuacaucaccuuaugguaagugcugauggggaagcauuggcugcuccgggagcauguaguggggcaggagugucuaacugauuacagggguagguguucaggaaaggucccuaaaagaagugacuucuaaucugagacuuaaaaguuaggguuuagaauucaucuuuguguguaauucuagagaaaaauggcaugauccauuuuucuguuuuagaaaugugguaagcagguggacuagaguggggaaugaggcagagagauugguuaggaugacacagcaguacucuaagcaaggaaugaggauggccugaaacacagaaguagccaagaaaaaaagaaacaaaggauuugugagacauuuagaaaacagacucaaugggaguugugguugccuugaaggcaggggcuguuguaauguaaagccaaggcuuuuccuugauauauucauuggcauucugcaucacuuuccuacauaaacagaccagacacauaacauaccaucugagauuucuaguuuugcuuucuuuaaaauggaagaacaucuugaauacaccuguaaaacaaucuucacuacagaaucuuuuuagauuucuauaaauuuuucuccuaggcuuuuaccauuaacuuguucauaauuaacucaauaacaauuugucuuagcuacucaucuucaacaaguguuucugauuuucaacuuaguuuucauagcaauagcaacccucuuuuuugguacucauauuucauuuuucguauuauuucauuaaauuacguaguugcaacuguaagcauaagugccauacacacauuuaaaaaauuguuuucauucuuuuuuuuuuuccuuuuuuuacagagacaagauaucacuauguggcccaggcuggucucgaaccccugggcuuaagcaauccugccucggccucccaaaguguuaggauuacaggcaugagccacugcgcccagcccacagacacaugauguuuagaaaaaaacacaauggacccucacuaagcacacaacucaaauggaggaggagaagcgcaggcaugcaagagacaagccuaugagucauaaccacucauuaugcugugggcaaaugucaguguguuucuccucacaggcucucuccccagagaccccuucccugaucaucuguuuaagauuaacccuuucgaccgggugugguggcucaugccuguaaucccagcacuuuagggggccaaagcgggaaggaucacuugaggucaggaguuugagaccagccuggccaacauggugaaaccccaucucuacuaaaaacacaaaaauuagcugggugugguggcaggcgccuauaaucccagcuacucaggaggcugaggcaggagaaucgcuugaacccaggaggcagagguugcagugagcccgagaucgggccacugcacuuuagccugggugacagagcuagugggacuccuccucugucucaaaacaaacaaacaaacaaagauuaacccuuucaucacucucuauucccagauuaauuuugcuucacaggauuuaccaccaccugauuuuuuucuguuucacuuguuuaucgucugucucuucacuaaaauguaaacuucccaaguagagggauuuaguuuuguuuauuccguguaccuagagcaguuccuggcacauagcagacacccaauaaguauuuguuaaaugaauacuguggaaugaguuuuuuacacaugaaauucucagcuaaucaaacaaaauagcuauguggagacugcucaagaagcaaugcugccaggagcgguggcucacgccuguaaucccagcacuuuggaaggcugaugcaggcagaucaugaggucaagaguucgagaccagccuggccaacauggugaaaccucaucucuacuaagaauacaaaaauagccaggugugguggugcgugccuguaaucccagcuacucaggaggcugaggcgggagaaucacuugaacccaggaggcggaaguugcagugagccaagaucacaccacuacacuccagccuggcgacagagcuagacuccgucucaaaaaaaaaaaaaaaaaaggaaaaguacuuccuucaauuagucauucuaaagacuucaugaauuaaacuccauaaaagacaacagugucuagcauauauaaaaugcuaaauaaauguacguuuauuaugaugaauauguugaauauuuacaggugguuaacuauaaacaccucuaguugaaaauauauauaauauauauuacauauauuauauauaauauauauguauauuauauauguaauauauacauacacauuauauauaauauauacguauauauauuauauaauacguaauauauaauacuuauauauauaauucgccucccagguucaagcaauucuccugccucagccucccaaguaacugggauuacaggcaugugccaccacgcucggcuauauauuuuuuuaauuauuauuuuuuaguagagacggggguuucuccaugauugucaggcuaguuucgaacucccgaccucaggugauccgcccgccucggccucccaaagagcuguuuuaaagcacagguucccauggcaucgcuucuucccccaacccucacacacugucccuaaccaaagagacugcacaccccagaaugcaacacgcgccuccgcgaagaagaccuacucauagcaaguacuucacagccuacaauucccaagaugcaacgcgaccuccuucccacagcaacgaaagacugcgacuccccggacuaucaggccgggagaguccacuuccagcucaccucggagcuccgggagccuuucagcaccugcuuggugagcgcgauuacgucaguaccacagguggucaccuucuccgugagaagccccuucacggacugaccgaaccgcgcuugagacucuggcguuccagucgccaucauuucaguuagcgaacgguugcgcacugacgauggugagucgccggggccaaaagacaagcaaagcggaaggaaaagag

SEQ ID NO: 192797 - RNA, 48339 nt, Homo sapiens
uagguuaaaauacauuuuuauuaaauguuagaauaaauuuauacacaauucacaaauucuuuacaaagaauugccaaucuuuuuccaauuuuguaguagucucuacacauucagaaauucugcuguuaaacaggauuuauaaaauauuucuuucagaaagcaucacaaugcuaauuuuaggcaaauaauguuuuaaaacugaagucuuugcauggaggugagcucaaacacccuuauucuuuauugcagugaugaaauaaugagaaaaauaaacauuaaacugacuuacuaagaaaacaaugaauaaguaauucuguaaacuucucaaauucuccuaaaauuuuuuauuacuuucagaagcaauacuauugcaagguaucaacaaccacacuauguacccaaauaaaaugaaugucagaaauaaaaauacugucacaaagaagcaccccuuauuggaagauguauugaagaagucuuauuacacugaaauuuuauggcacagaucauaaacucagagucucuucacacauaauaacaauucauccauuuugaaaugaguaacuucuccuuuguaguguugcuaguauaaaaaaagguacaaguucaaaauaugcuggcaacauacaaaaguggccaauaguuuuggucuuugagaguacacccugcaguuuaacaaagacuggcuuugaaucuuccacucaaaagcacacuucucuuccaaaaagaugacugcccaacugaugccaucccagagagcagauaucccaaccaccaacuugaaauggcugaacaaagaaaacuaaccaauuacuucaaagaugggaagcaaaaucaaugucaagguauuuaaaaucauaagaaauuuuaaaauucaauuuuugaaaaauuuccccugagcuuuggcugcuuuuuauauacagucucuaguaacagaugcauuccaucguuccaaguuguacuuauaaacgcuauaauucuuggugcuaaaaauagguaaguuaugucuugaacagcaaagugguagcaauuacauuucauggaaaucuuuggugagaugcaguccugcagaagccuccuuuguuucccuccucauaaugugccuagaaucuucaaguuaucuucagaggagaaaccacaagaccauaaugaaggacaagcagaccauccugaaaaggggagaaaaaaagacgauuuugcaguucuuucaaaccaguaaugcaaaugaucaagucaaagcuggcuuacuuuuuuuuaauaaucuaacacuaaggugaaauucuuuaauuuaaagaaaauaaguggaccauauaguuucuuauucaccaaacacuccuugugaaugugcuuuuuuuuuuuuuugagacagagucucacucuguugcccaggcuggagugcaguggugcaaucucagcucacugcaaccucugccucccagguucaagcaauucuccugcuucagccucccaaguagcugggauuacaggcacccgccaccauacucagcuaauuuuuguacguauguaucauaugcauguauguauguauacauuuauuuauuuuuugagucggaaucuugcucuguugcccaggcuggaguacaguggugcgaucucugcucacugcagccuaugccucccagguucaagcaauucuccugccucagccuaccgaguagcugcaauuacacgugcgugcuaccaggcccagcuaaauuuuguauuuuuaguagagacaggguuuugccauguuggccaggcuggucuugaacuccuaaucucagaugauccuccugccucagccucccacagugcugggauuagaggcgugagccagaacaccuggcccgacacccagccccacuuuuuuuuuuuuuuuugaagacagggucuugcuguguugcccaggcuggaguucaguggccaaaucuggacucacugcagccuugaccaccugggcucaagcgauccucccaccucagccuuaugaauagcugggaaaauagacacgcaccaccaccagacucauuuuuguauuuuuuguaggagacagaguuucaccguauugcauaggcugggcucaaacaaucugccugucucagacucccaaagugcugggauuacaagcgugagccaucuagaccagcuugucaaugugucuuuuuaaugacucucaggagccaauucugaaacuaucauguagccauaaacacaaacuggagugcaauggcgcgaucauagcucacuguagccucaaucucccaggcucaagugauccuccaaccucagcuucgcaacuagcugggaccacacacacgcaugugccaccaugccuggcuacuucaaaauuuuuuuuuucccaguauaaacgaggucuugcuauguaacccaggcuggucucaaacucuugagcuucaagcaauacccccaucuuggcuucccaaagugugggauuacaggugugaggcacgcauccagcccagacuuuuuuuuuuuugaaacacagucuggcucugucaccaggcuggagugcaauggcgcaaucuuggcucacugcaaccuccgccucccggguucaagcgauucuccugccucagccucuugaccagcuggaacgacaggggcccgccaucacgccuggcuaauuuucguaauuuuaguagagacgggguuucaccauguuggccaggcuggucccgaacuccugaccucaggugaucugcccaccucagccuuccaaagugcugggauuacaagugugacccgcugcacccggcccuagacuucuuaauagacuauuuaagcauuagauucuccuaaaaaagacucaacuacuacaacgcaucgcagaucuguucacuuccacauaaaugcagcucaccacuauaauaauugcuaaagcucugaaacacuuacucauuuaaugaaagccuaaaauauauauguuuuacuucugccuuaaagaaugcccucagcuggaugcaguggcucaugccuguaaucccaacacuuugagaguccgaggugggcaggucacuugagaccgggaguucaagaccagccugggcaacauggugaaacucccccucucuacuuauauaauuuaaaaaaaaaaaaaaggaaaaagaauuuuuuaaaagaguaaagaaugccccagggcaguuaggcaacuuaacccccauacuauaugauuccagaugcuauguguccaagucuuuuuaucuacuuuuuguggcguucuaucuccuuucuugauaccagaucuuaauucuuuggcucucaccaaggcugcauccgcaagcaauccaccuuuuuuuuuuuuugagauggaguuuugcucucuugcccagguuggagugcaauggugccaucucggcucacugcaaucuccgccucccggguucaagcgauucuccugccucagccuccugaguagcugggauuacaggcaggcgucaacacccaccgcuaauuuuuguauuuugaguagagaugggguuucuccauguuggucaggcuggucuugaacucgcgaccucaggugauccgcccgccuuggccucccaaagugcuggaauuauaggugugagccacaacgccuggccgcaauccaccuuuuuaagggacuauuucuaauuuccugcagacuggauaacuagcuaaaaggaaaggucauugggaaaugugccacagaccugaacugagcaacacagagaagggguugcagcucauauauccuguauuuccagugcugcucuggcuauuacucuccuucgcuucuuugcuaagcuuuuccauggcuccacuuccucacuccucaacucacugcaaucugguuuguguuccuggcaauuacaguaaaaacucaccagaauucuagaaaaagguucacaaauucaagugcccacaaggcccaggccaguaacauaaaugaauacauaaguuagguaugugaagucaauagggaauguugaagaccagugguaaaccagagagagcagaugucuaucuaaagaaauuuaaacucaaggccaggugcaggggcucaugccuauaauccuagcacuuugggaggccaaggcagguggaucaccugagcccaggaguucaagaccacacugggcaacauagugagaccccgucucuacaaaaaauacaaaaauuagccaggugugguggcacaugucuauauuuccagcuacucaagaggcugaggugggaggaucacuugagccugggaggcaaagguugcagugagccaagaucaugccacugcacuccagccugggugacagagccagacccugucucaaaaacaaacaaaaaauaaaaaauaaaaaaauaaaaaaauuuaaacacaaggccaggugugguggcucauggcucaugccuguaaucccagcacuuugaaaggcugagguuggaguaucacuugagcucaggaguucaagaccagccugggcaacaaagugagacccccauuucuaugaaaaauaaaaaaauuagccaguggcacaccucugguaaccagccacacgggaggcugaggcaggaggauugcuugagcccaggagguugaggcuacagugaaccauauucaugccacugcacuccaaccugggcaacacgacaagaccacacagcaagacccugucucaaaaaaaaaagaaagaaaguuuguuuauuucauucauuuauuauuuugagacagggucuugcucugucgcacaggcuggcaugaaugaucagagcucgcaacagcccugaacucccaggcuuaagugaucuucucaccuuagucucccaaguagcugggacuacaggugcaugccaccaugcccugccaguuuuuguauuuuuuguagagacaggguuucagcauguugcccaggcuggucucaaacuccugggcucaagugacccucccgccucggccucccagaauacggggauuacaggugugagacaucaugccuaaccugaguacauuuuaugaugcuugcacaaucauuaaauugccuaacaaugcauuucucagaacauaucccuauuguuaagugacgcauaacugcauauauauuugcagacuuaaugacuaugguuuauuguggaaaucuuuauugaauuuuuaaaaauaaaauuaauuuaaaauguucuuuuuggccaggcaugcuggcucacgccuggaaucccagcaguuugggaggcugaggcgagcagaucacuugaggucaggaguucaagaccggccuggaugucuaggcagaagccugcuguaguggcagagcccucacagagaaccucuacuagggcagugcggaggggaaaagugggguuggagcccccacauagggucuccacuggggaacugcccaguggugcugugagaagagggccacuguccuccagaucccagaaugguagacccacugagagcuugcacccugaguuugaaaaugccauaggcacucaacaccagcucgugagagaagccaugggggccaaacccugcaaggucacagagguggagcugcucaaggccuugggaacccacccuugcaccaguguaccauggauguagggcagggagacaaaggagauuuuagagcuuuuuuuuuuuuucugagacagagucuugcucuguugcccaggcuggagugcaguggugugaucucugcucacugcaaccucugccucccagguucaagcaauucuccuaccucagccucccaaguagcugggauuacaguagugcaccaccaugccuggcuaauuuugagcuuuaagauuuaaugagagccaggcaugguggaucacgccuguaaucccagcacuuuggaaagcugaggcagaaagauugccugagcccagggguuugagaccagccggggcaacaugguaaaaccccaucucuacaaaaaaauacaaaaauuagccagguuugguggugugcaccugcagucccaccaagcugggaggcugaggugggagaaucacuugagccugggaggcagagguugcagugagccuaucacacuacugcacucuaaccugagugacagagagagagagacuccaucucaaaaaauaaauaaauaaauaaaaauaaaaaaauuaauggcugcuguucuguguuucagacuuacauggggacauauagccucauucuuuuggccaauuucucccuuuuggaaugagaguuauuugcccaauguuuauacccccauuguaucuuggaaguaacuaacuuguuuuugauuugacaggcucauaggcagaagggacuagccuugucucagaugagacuauggaauuuugaguuaaugcugaaaaugaguuaagacuuugggggacuauugggaaaucaugauugucuuuugaaaugugaggacaugagauuugguggggggggggcaugauuuggguggaaugauaugguuuggaucuguguccccaccaaaucucauguugaauuguaauccccaauguuggagguggggccuggugggaggugauuggaucacgggguuggauuucucaugaaugguuuagcacaauuucccuuugguaauguccucacaaaagugaauaaggucuugugugauaugguuguuuaaaaguguguagcacuucccuccuuauucucucucuucugguuccuaucauguuuuugccuucagccaugauuggaagcuaagcugcuaugauuccuguacagccugcagaacugugagacaauuaaaucuguuuuauuuguaaaucacccagucucagguauuucuuuauagcaauguaagaauggacuaauacaguaugugaauuacaucuuaacaaaacugcuauuuuaagaaacagaguucaggcaugguggcucacaccuauaaucccagcacuuugggaggcugagauggcugauugcuugaucucaggaguucaaaaccagccugggcaacauggcaaaaccccaucucuacaaaaaauuaaaaaaaauagccagaugugguggugcacaucuguaacgucuguugucccagcuacuugggaggcugaggugggaagagaucaauugagccccccagguugaggcuacacugagccaugauugugccacugcauuccaugcauucuaggcugggcaaaacagagugagaccuugucuuucuuuuuuuuuuuuuugagacagaguuuugcuguuguugccuaggcuggagugcaauggugcaauuucagcucauugaaaccucugccucccagguucaggcaauucccugccucagccucccgaguagcugggauuacaggcacccgccaccaugcccggcuaauuuuuuguauuuuuaguagagaugggguuucaccauguuagccaggcuggucuugaacuccugaccuuaggugauccccccaccucggccucucaaagugcugggauuacaggcaugagccaccacaccuggcccaaccaugucuuaaaaaaaaaaaaagaaagaaagaaaagagaaaacuaauccccagugacaaaaucauaacaaugguugccuuggugcuagggagaagaauuaacugggaaggagcaugagagaacucucugggagugacagaaagguucuguaugugaaggagggguuugaguuaaacaaauagguauuuguugaaacucaugcauuucauuauaugucaauuaaaauauaucauauguacauuaugcacauauaacuaugcauauguguauauuuucugcuucuuccaaggaacuguauaauuugcauuaagaaaauaauucuugggaacagauugugaggacaagaaaaaaagauaauucuuauaauauucacaucuucuuuugagcaguuguuccauugagacaaaggaacauaggcaauuauaccaaaaaaaaaaauauuauuucuuuucuuucucuuuuuuugaaaaagggucuuacucugucgcccaggcuggagugcaguggugugaucauggaucacugcaaccucaaccucucgggucaaucaaucuucucccuccucagccuucuaaguaguugggacuauaggcaugugccaccacaccugguuaauuuuuguauuucguagagaugggguuucaucacguugucuaagcuggucuugaaguguuggacucaaacaaucccucugccucagccuccccagguaacugggaccacagguaugcacaaccaugucugcuaauuuuucuauccuuuguaaagacgggacucgcuauacugcccaggcaagucuuggaacuccuggggucaaaugauccucccaucuuggccccacaaaauguugggauuauaggagcaagcgacuaugccuggccaagaaucacuuuucuuuucuuuuugaaaccgagucuugcucugccguccaggcugaugugcaguagugcgaucuuggcucaccgcaaacucugccucccggguucaagcgauucuccugccucagccucccgaguagcugggauuacaggcaccugccaccacgcccagcuaauuuuuguauuuuuaguagagaugggguuucaggauguuggccaggcuggucuugaacuccugacuucaaaugaucugcccgucucugccuuccaaagugcugggauuacaggugugagccacugugcccggccucucucuuuuuuuuuuuuuuugagacaugguccugcuccguugcccaagcuggaguacagagccacucaugggucauugcagcugcgaccucccgggcuugaagcgauucucccacccugccucccgaagugcugggauuacaggcaugagccaccaccgcaccuagccgcauuucuugucuuuaauagagauauuuaccauauguuuucuauacuuaagauacacaaaauguuuguccuuguguuauaaucacccacaacauuuaauacaacaaaccaaucacauaaccuagaaacagugcaucacaccacacagcccuaagagggagcagaaaccuggauuuacccaauaggccaugacugucagccacgugugguggcucaugccuguaaucccagcacuuugggaggcugaggugggcagaucacuugaggccaagaguuugagauuagccucgccaacacggugaaaccucaucuguauuaaaaauacaaaaauuagcugguguggugggacaccuauagucccagcuacuuggcaggcugagguacuagaaucacuugaccccaggaggaggaggugcagugagccgaaaucacgccacugcacuccagccuggugacagagcaagacucugucuccaaaaaaaaaaaaaaaaaaaaaagucacgguugggcaugguggcucacgccuguaaucccagcacuuugggaggcugaugcaggcagaucaggaggucaggagaucgagaccauccuggcuaacacagugaaaccccgucucuauuaaaaauacaaaaaauuagccaggcgugguggcaggcaccuauagucccagcuaccugggaggcugaggcaggagaaucccuugaacccgggaggcagagguuguagugagcugagaucgcaccacugcacuccagccuguugacagagcaagacuccgucucaaaaaaaaaaaaaaagucacaacugucuaauuuacacaacaaguaagggcuacaggaccaaugaucaccagcugcccaaguaccaaaaaauuaugcuucugaaaucucuugauguugauucuggcaccaagagcaaacgaugcccuaugugugccacucacagcagaagcccuuuuuuccccaagaauuauauuucuagcaaacaaaaauuuguuugagaguucaucaaaucuucauuaguacuucauaagcuucucagagucauauagcucuuaaaacaauuuucauggccgggcgcgguggcucacaccuguaaucccagcacuuugggaggcccagguggguggaucaccugaggucgggaguuagagaccagccugaccaacacagagaaacccugucucuacuaaaaacacaaaauuaguugggcgugguggcgcaugccuguaaacccagcuacucgggaggcugaggcaggagaauggcgugaacccgggaggcggagcuugcagugagccgagaucacgccacugcacuccagccugggcgacagagcgagacuccgucucaaaaacaaaaacaaaaacaaaaacaaaaacaaaaacaacuuuccacuauagauucagaaauacauuagaauaugugguccuauuuucucuucauuaaacuuguagauccuaucuugguuuuuauuauuuugacuaagagacuucacauuauauucccacucacauuauagguuaauuaaaacaucaaaauaguuaccuugaguucuuaucuacuguauaagaaaagcuaugugaaucucuaaagcagggguguccaaucuuuuggcuucccugggccacacuggaagaacugucuuuggccaacauaaaauaugcuaacacaggcugggcagaggggcucaccccuguaaucccagcccuuugggaggccaaggugggcggaucacuugaggucaggaguuugagacaagucuggcuaacauggugaaacccuguuuugacuaaaaauacaaaaaucagccgggugugguggcacaugccuauaaucccagcuaauagggaggcugaggcaggagaacugcuugaaccugggaggcagaggcugcagugagcugagauagugccacugcacuccagccugggcaacagaucaagaccuugucucaaaaaaaugaauaaauaaaaauacaauauaccaguacgaacaguagcugauagaaaaaaaaaaaucucaucacguuuuaagaaaguuuaugaauuuguguugggccccauucgcagcuauccugggccacauguggccugagggccacagguuggacaaacuuggcucuaaagccuaauaaguacuugcaaguuuuucuugaaauguccuucuggaugcauuggccuagaagccuucaaaauuguauuauagcacuggacaggcggaaaaaaacaaggcuuuuagaaucaaacugccuagagucugagcccugucucacccacugacuguaggaaguuauauguccuuacuguaucucaguuuccuuuaucuuuaaaaugggaaauaaaaaacugccugcuuucuuagaauaauuaugaagaauaaauaagcuaaucuacauaaauuacuuagaacaguaccugacacacagcaagaauuugauaaauauuaaauauaauuauuauuuauaguguagguaauuuuaagaguauuguagaauauuuaugaaaacuuacugauaacauggauaacuuucacuaaguaacuuaucuguuagacauggguaugucuauaaccuaccugcauugcugcaucaccuauugcacgucggauuucccuuagaguuugauacugcuccaacaggugaucaccacagauuauaucuaccuauggacaugaagagaguauuagauugauuucuugcuucaaaauaccaucugaagaaaugaggaaaacaaaucaacauaaauuguuuccaaacuagauuuuguaauuuuauuuuagacugauuaaacgcucuugaaaagagaguuuuagaaacuuuuuacagaaguaaauaagguaacaugggaagagcauuagaggauacagcaggacaacagcacaguauaauugauauucaaaaugauuucccugaaucucaaagaaauuaagucauuuuagacuuuaauuaagaaauucauuuugacauuaauuaagaaauuaagucaaauuagauguauucaacaucagguagcaaaggaaaguauaucuuuuuaaauaucugugauaaaaaucauuaaggccgggagcaguggcucacgccuguaaucccagcacuuugggaggcagaggcgggcagaucaccugaggucaggaguuccagaccagccuggccaacauggugaaacccugucucuacuaaaaauacaaaaacuaaccaggcacggugguaaucauggugccuguaaucccagcuacuugggaggcugaggcaggagaaucacucgaccccaggagguguugguugcaaugagccgagaucaugccauugcauuccagccugggccacagagcgagacucugucauaaaaaaaaaaaaaaaaaaaaaaaaaaaaucauuaaaagguauuaaugcuuaaaaaggcaaucauccauuauuugaaaaaauucucuuaggaggaauaucucauuuuccaacaaugccacauaaaucauaguacaacacugacuugaaguucacacuaaggaaacuguuuuguagauggaacaauuucaacaaggacuuuucagcccuuugguaauugcaaagcuccaagauauaucuuuuuauuccccccagacagggugucacucugucacucaggcuggagugcaguggcccaaucauagcucauugcagccucaaacuccuaggcugaggcaauccucccaccuuagcaacccaaguagcugggacuagaggugugcaccaccacaucuggcaaauuguguguuuuuuaguucguuuuuugagauggagucucgcucugucgcccaggcuggagugcaguggcacaaucucggcucacugcaagcuucaccuccuggguucacgccauuccccugccucagccucccgaauagcuggaacuacaggcacccaccaccaugcccagcuuauuuuuuguauuuuuaguagagacgggguuucaguguguuagccaggauggucuagaucuccugaccugaugauccgcccaccucagccucccaaaaugcugggauuacaggcgugagccaccgugcccggccaauugugugguuuucuuuuuucaauuuuuguagagacagggucucgguauauugcccaggcuggucucaaacuccuagucguaagugauccuccugccuuggccucccaaaacacaggugugagccagugugcuccggccaauauacugacuuuuauauagaauucucuagagagaauauuguuguauauauacauuuuauuaagacucuacuauacuuacuugcuaagauagaaaugcaaaucuuuaaucuuucacugaguacuacuuccuauuaccuuaaaaugggguuagagccucaacagcuuauauguguguguguguguguguguguguguauauauauauauauauauagagagagagagagagagagagagagagagauaucucacuuaacuggcuccaucuccuaacauuacuauuuagauuaugguaugaaauuucucauugucuuccauaccagaaugucaccucugcuuccucuuucuccuuuuccuuucuucuuacaugcaaucaauuacaaaguccuauugcuucuuucuuccuaucucuugaauucauaucauaccuuucaacuacugcccauagacuuaaaccacuaaaacuaccuccuagccagacuucuuaucuucaauacuguuuacuccaauaaauuuuauacacugucaacauguuaaacucuaaaaacuuuuagcaugguugggaaagaacaguaauagcagcugcauuuaaauaagcagccacuauguacaauaaguuacauauguauuugacauguguuaucuaauccucauauuccuaugaauuagguaacuacaauucugauuuuacagauagggaaacuaagaaguaaagacauuaaacuuuccugagaucacaaagcuaguaaauagcaaaguucagauauaaacccaggucuguccaagaucuaauuuucuccaaagccuaaaugccaucucaggggucggcaaaccguuucugcaaagggccaaauaauaaaugccucaggcuuugugggccauagcaucucuguuauaucucuucaauucagcuguuauagcacaaaagcagccacgguguggcugugcuuucaauucauuuugcaaauaccacucugucaauuuaaaagcuaguaagucuaaaauccaaaaguuguuacuaaucugagauuauauagaauuaugagauagaacccggguuggcauacucaagggccaaaucuagccugucaccuguuuuuagagugguauuuccaaagugacuugaaaguaaugauaugagaucuugcacagagaacuuagauccauaaaaaguuaaagaauuugguaccaucauuguuuuauuaauuuuauuuuauuuuauuuuuuuagacaagagucucacucugucgcccaggcuggagugcaguggcgcaaucucagcacacugcaacccuugccucucagguugaagcgauucucaugccucacccucccaaguagcugggauuacaagggcacgccaccacacucggcuaauuuuuguauuuuuaguggagaugggauuuccccauguuggccagccuggucucaaacuccuaaccuuaggugauccgcccaccucaggcucccaaagugcugggauuacaggcaugagccaaaucaccgggccuauguuucauuaaauauuuagcaauccaaaaacuaucacucuuagugggcuuuauaccacgugguauacauucacgguauuauuacuauauuuucaacuuugaauuuuuacagaucuuuaaauuuuuuguaaaaagcuuuacaaaaaucuuuacaaaauaauucacuguaacaaauucagaaaacacagaggugcuggguacuguggcucucaucuauaaucuuagcugcuugggaagcugaggcaggaggacugcuugaguuugagguagugagauaugaucguaccgcuccaccccaagccugggcaacaaaacgaaaccucaucucaaaauaaauaaauaaauaaaaagacagguauauaguaacaaacuuaaaaaaaauuguagaaaguagaaugauaaauccucacuucaauccuagccccuagaggguggucaguuucuuuuuucuguuuuuuuuuugagacagaguuucgcucuuguuguccaggcuggagggcaaugacgcaaccuuggcucacugcaaacucugccucuccuggguucaagcaauucuccugccucagccucccaaguagcugggauuacaggcaugcaucaccacgcauggcuaauuuuguauuuuuaguagacacgggguuucucaucuuggucagacuggucucgaacucccgaacucaggcaauccgcccacuucagccucccaaagugcugggauuacaggcaugagccaccgcacccagcugggguuggucaguuucuaagaguuugauguguaugguccuagaacacuaugugugcauguggguuuuucuguuauucauuuuuugcuuuaaaaaaaaugggaucaacugggugcgguggcucacgccuguaaucccagcacuuugggaggccgagacgggcagaucaccugaggucaggaguucgagaccagcuuggccaacauggcaaaacccugucucuacaaaaaauacaaaaauaagcugggugugguggcagacaccuguaaucccagcuacucaggaggcugaggcaggaggaucacucaaaccugggagucagaaguuguagugaaccgagaucgcgccacugcacucuagccuggguaacagagggagacuccaucucaaaaaaaaaaaaagaaaaaagugcgggugcgguggcgcacaccuguaauccuagcacuuugggaggcugaggcaggcggaucacaaggucagcaguucaagaccagccuggccaagaugguaaaacccugucucuaccaaaaauacaaaaaaauuagccgggcaugguggcggucgccuguaaucccagcuacucaggaggcugaggcagagaauggcuugaaccugggaggcagaggcugcagugagcugagauggcaccacugcacuccagccugggcgacagagcgagacucugucugaaaaaaaaaaagaaaaaagaaaaaaaaaguugguuuuguuggcacucgcugucuaacaacuaccaaauugcaguuagaaaacuuuucacauuaguguaggaaacuuuuugcaggccuaguuccucgauagccaaaggccagcuuuguaagcaggcccuucuaacgacagcagccucaaggcugauacguuaacucuuuugugcauaauaucuuacccucuggaguaucaagaagagauaacaaaaauauuuuugaaucucagagcagaaaucagaccaugaaaguagucuuauuaaaaggagaaaaaguccucaucuuuuuaaaagcaagaucaugcuagagcuuccaaguuaagauuuuucaaucagugugcuuugauaagccacacuggcucauuccuuugaucauacauacucuucuuuucgagauggagucucacucugccgcccaggcuggaaugcaguggugggaucucggcucacugccaccuccgccuccuggguucaagcgauucuccugccucagccuccugaguagcugagacuacaggcguaccaccaugcccagcuaauuuuuuuuuuguauuuuuaguagagacgggguuucaccauguuggccaggauggucucgaucucuugaccuugugaugugcccgccucggccucccaaagugcugggauuacaagcgugagccaccggaccuggccauacauacucuucuuugcuacuaaguucuuuuuuucugugucuggcaaauuccuauuuguucuucaaacccauuccugaguuaaaucauucacuuuuguguuaucuccacuguugcauucauuacauccuauuguuaguuaguuguuuacuuauauaucuuuccuacaaaauucugaguccccugauggcaugaauuuugucucaucuuuguacuccuaaggucaaauacauagacccucaauuuaguaacaauauauaauaaaugguauggaaacaucauauauuaguccuuaaaaaauuauuuggaaacuaaauuuaauagaaggcuuaauaucauacaccaaauaaguaauaauaauaaccuaacuuuuuugagauggagucuugcucugucgccaggcuguagugcaguggugcgaucucggcucaccgcaaccuccaccuccuggauucaugugauucuccugccucaucuucccgaguagcugggacuauacaggugcauaccaccaugcccagcuaauuuuuguauuuuuaguagagaugggguuucaccaugugggccaggauggucuccaucucuugaccucgugauccgcccgccucagccucccaaaaugcugagauuacagguaugagccaccaugccuggccagccuaacuuuuaagauggaauuaguuauggcaggauuaacaaaaucaaauaucacaucuuauagaagaauuuuuagugaucaaugugagguguauguucuaaauuucaucucauaaaagcaaaauaaggucugaauaucaaacaaagcaaaauacaauaagacaucaaagaguaaauaccacuaaaucaaccacaguaacccugagacacuggagucucuaugagaaagaaacauauuuggauaauuauugaucucuaaauuuuaaaugaacuuaaaucuuucuuaagaacacaugauggccgggcgcgguggcucacacuuguaaucccagcacuuugggaggccgaggugggcagauugccugaggcugggaguucaagaccagccuggccaacauggagaaacucugucuacuaaaaaaacuagaaaauuagccaggcaugguggcgcaugccuguaaucccagcuacucaggaggcugaggcaggauaaucgcuugaacccaggaggcggagguugcggugagccgacaucaucgcaccauugcacuccauccugggcaaaaacagugaaacuuugucucaaaaaaaaaaagaucuguauuuuuuaaacuuuuggaauugucuuguuuuuaaaauuugaucugccacaaaaaacuuuaaaguuuaacagucccgugggaauuacucguuccuguuaguaaauaaccauaaaugaaggucacauaucuguaaaccaugcacacauuucccaccugggacuaacugguucaaagaaagucagcauagcaggcucgugacugcaggacaccaagaauuguagucugaugacuagcaaaccagcucaauguuuuguucauauuagaaguaacucuuaauuacuuacucuaccuuaaauuuaggccucaacaauuuuaguccccaauuaaugggucuguauauuugauaauucuaacauuuugguuaaauaauaauuuaugaacauuaccagcuauacaguagcugagugguagaauauuuauuuagagagccaagagcugacaaagaaaauuaaagguugaaacaaauuuuauaucuuucuuuuugagacagggucucaucaugcacugccgccuugaccucccaagcuuaggugauccuccuaccucaggcuccagaguagcugggauuacagguaugagccuuuauaucauuuuauuucaaaaugcuaaaagccuuaaauucuaugauguaagcaaaaaagaaacccacauuuuuagguaacaaaaucaacuuagaagagaaauacuguacaagauggugacuauauguaauaauauauuguaggcugggcgcgguggcucaugccuguaaucccagcacuuugggaggccaaggugggcggaucacgaggucaggagaucgagaucauccuggcuaaauggugaaacccugucucuacuaaaaauacaaaaaauuagccaggcgugguggugggugccuguagucgcagcuacucaggaggcugaggcaggagaauggcaugaacccgggaggcggagcuugcagugagccgagaucgcgccacuguacuccagccugggugacagagacuccgucucaaaaacaaagaaacaaacaauaauaauaauaauaauauauuguaauugcugaauagaaauuucaaguguuuucaccacaaaaaaugugagguaaugguauguuaauuagcucaauuuugccaucccacaauguauacauauuucaaaacaucauguuguauacaauaaauagauauuauuuauuucauuucacuuuuuuuuuuuuugagacagagucucacucugucacccaggcuggagugcaguggcauggucucagcucacugcaaccuccgcuuccuagguucaagggauccucccaccucagcuucccaaguagcugggacuauaggcaugugccaccacacccggcuaauguuuguauuuuuacuagggacaggguuacaccauguuggccaggcuagucuugaacuccugaccucaggugauccacccaccucggccucugaaagugcugggauuacagggugagccaccuugccuggccuucacuucacuuauuuuuauuuuuuuugagacaguguauugcugucgcucaggcucagugcaguggugcaaucauggaucacuguagccuggaucucccaggcucaacccaccucagccucccuaggagcuaggacuacuaggauuacaggugugcgcuuaauuuugugugcagcuaauuuugguauuuuuuguagagcugggguuucgcuauguugcccaggcuggucucaaacuccugggcucaagcuauccauccacuuuggccucccaaagugcugggauuacaggugcaagccaccacggccagcccaaaauauuuuguuucugucaauuaaaaaaacaggcugggcacaguggcucaugccuguaaucccaguacuuugggaggcugaggcaggaggaucacuugaggccaggaguuugagaccagccugggcaaaaugaugaaaccccaucucuacuaaaaaauacaaacaauuuagccgggcaugguggcaugcaccucuaaucccagcuaccugggaggcugaggcaggagaauugcuggaacccgggagguagagaccgcagugagucaagacugugccacugcacuccagcaugggugacagagcaagacucuguaucacacacacacacaaaaaguccagccugggcaacacaguauguuauccuugccaccaaaaaaaaaacaaaaaacaaaaaacaaaaaaaaaaacaacccacaaaacacaaaacauacacacacacagacacauaaauagccauagaauaaucuguauucuagagaggguccuccuggguaucacuucuuuuucuauaauaagggcaagucuucugcuuuuagaaauaacaggcuguuaugggaucacucauaauucuuaauccaggagucacuaaccagcuuugucucuaacaaaaaccuaagaauaaccucaagugugcuguggcuacaagguaaaaauaagucauuucuaguuuucagcugccaugagauauaaccaggauaugucaagcucaguuagagaagucauauuucacuggauuuaguauauauuuacuaccaguaaauaucgguacuaaaaacacuagcaaacuuucagucacuuuuuuuuuugaguuggaguuuugcuguuguugcccaggcuggagugcaguggcgccaucucggcucacugcaaccuccgccuccuggguucaagugauucuccugccucagccucucaaguagcugggauuacaagcaugcgccaccacgcccggcugauuuuauauuuuuaguagagaugcgguuuaccauguuggucagacuggucuugaacuccugaccucaggugauccaccugccuuggccucccaaaguguugggauuacaggugugagccaccgcguccggccccuuuucuuuuuuuugauauagagucucccucuugucgcccagguuggagugcaguggcaugaucuugacucacugcaaucuccaccucccggguaauagcgauucucuugccucagccuccugaguagccaggacuacaggugugcgccaccauaccuggcuaauuuuugguagagacgggguuucgccacguuggccagacuggucuugaacuccugaccucaggugauccaccugccucgaccucccaaagugcugggauuacaggcaugagccacuacacauggccagucacuguuuuaacauaucuauuaauuuaacuaacaauacaguauuuuauuauuuuauuuuacuauuuuuuugagacagauuaucacucugucgcccaggcuggagugcaauggcaugaucuaggcuaacugcaaccuccgucucccagguucaugcaauucuccagccucagccucccgaguagcugggauuacaggagugugccaccaugccaagcuauuuuucauuuuuuaguagagacaggguuucaccguguuggccaggcuggucucaaacuccugaccucaaaugauccaccugccuuggccucccaaaguacugggauuauauaggugagucacugugcccagccacaauacacaguauuuuagauaaaaaauuauucuauaaaacuuaacacaugauggagaauaacaaaaaggcuuuuuaaauuugacuaaugaaaaaaaaaaaaagaaaaagcaaagcuauauaaauguucauuuuuacuaacuggaccacagaacuagaacuaugaguauauuuuacuuuuauguucaaugauacaugaaguuugagguuuccaucguacaacaagaagaaaauauuauggcugggcgcgguggcuuaugccuguaaucccagcacuuugggaggccgaggcgggaggaucacgaggucaggagauggaggccagccugaccaacaacauggugaaaccccgucucuacuaaaaauacaaaaauuagccaggugugguggcacaggccuguaaucccagcuacucaggagccugaggcaggagaaucacuugaacccgggaggcggagguugcagugagccgggaccgccccacugcacuccagccugggcaacggagugagacuccgccucaaaaaaaaaaaaaaccaaaaaaaaaaaaaaagaaaauauuacauagcuagaacaggagaucucuuuuaauccauaaaaaaaacuaauagggucagcugggcaugguggcucacgccuguaaucccagcacauugggaggccgagguaggcggaucaccugaggucaggaguucgagaccagccagaccaauauggagaaaccccaucucuacuaaaaauacaaaauuagccuggcaugguggcaccugccuguaaucccagcuacucaggaaggcugaggcaggagaaucgccugaacccggggggcggaaguugcagagagccgagaucacgccauugcacuccagccugggcaacagagugggacucagucucaaaauaauaaauaaaauaaaauaaaauaaaauaaaauaaaauaaaauaaaauaauagggucccuauuagauaaaaauauuucacuucucuagguguccugagcuuugcuuguuuuuuuguuuguuuuguuuuguuuugagacggagucucgcucugucguccaggcuggagugcaguagcgcaaucuuggcucacuguaaccucugccugccagguucaagcaauucuccugccucagccuccugaguagcugggauuacaggugugugccaacagguccggcuaauuuuuguauuuuuuaguagagauaggguuucaccauguuggucaggcuggaauuccugaccucgugauccacccaccucagccucccaaagugcugggauuacaggcaugagccacugcgccuggccgagcuugcuuguuauacuugaacaacuaauaaaugcaaggauguccuauaaagaaagcggaugauaagcaauauuuuucucuacuaccaaaauggaaagagcuggaacugaggccucuuuaauauuucuaucuucagcuuuucuaugacacuaauagauugccaucaguggcaguaggaaauggauacuagccuggcacaguggcuaacuccuauaauccuagugcuuugggaagcugaggcaagaggauuacuugaggccaggaguuugagaccagccuggacaaaagcaagaccgcaucucuuaaaaaaaaaaaaaaaaaaaaauuagcugggcaugguggcaugugccucuaguccuaacuacucaggaggcugagacaggagggaggaccacccaagcccaggaaaaccucaagguuguagugagccaugaucgugucaauguacuucagccugggcaacagaaacagacccugucucaaaaaaagaaauggacaguaaaucaaaugugauuaaagcuggaggugugaaucacuauguaucaauauucaauuagcauuaacaauguccaggcgcgguggcucaugccuguaaucccagcacuuugggaggccgaggcgggcggaucacgaggucaggagaucgagaccacagugaaaccccuucucuacuaaaaauacaaaaaaaaaaucagccgggugcaguggcaggugccuguagucccagcuacucgggaggcugacgcagaagaauggcgugaacccgggaggcugagcuugcagugagcugagaucgugccacugcacuccagccugggcgacagagcaagacuccaucucaaaaaaaaaaaaaaaaaacaaugucuacaacaucauaaaacaaaaauaacaaaaauaauugcaugaaauccuacagaguucuuucuacagugugcuaaagguaagcucacaacuuuaccuauucuuuuacauauauguacuguaccugacaagcuggaucaagacccauuuuucuucugaggaauuuuucuacauguccaauaguugcuucuccugaaacucgaacaaacuucuuuuccaauggcuacaaaaacagacagauaaaacuauuuuuagguuaaauauaccuguacaugcaugacguauguguauauauauguaauguguaaacauuaaagaaaauuuuauagcgaagaugauucaauagacucuugaaaaaacuuacuaugaaacaaguuaauacacauaucagagaagaaaaauggaaauucugcuuagcuuucccuuucugaaaaguaugucaacaauuuuucuaaauaggcuugcugguuuauuuuaauguuucauugaaaaaacaaaacucagaguaaaauuuauucauucauuucaaguacugaacuuacacuuuaaagacacagagaaaacacccaauaccaaaugucugaaacaacuuugaggccgggcaugguggcucacgccugcaaucccagcacuuugggaggcagaggcaggcagauuguuugaggucaggaguucgagaccagccugaccaacauggagaaaccccgucucuacuaaaaauacaaauuagcugggcaagguggcacaugccuauaaucccagcuacucgggaggcugaggcaggagaaucgcuugaaccugggaggcagagguugcagagagccaagaucgugccauuguacuccagucugggcaacaagagcaaaacuccgucuaaaaaacaaacaaacaaacaaaaaacccaaaaaacugcaaggaagaaaaaacaagauggagaaggaauggcgagacuaaaaaacauuaagggguguaaaugacaaauacauuaaccaauuacaauguauggaccuuacugaauccugauugaaaaacuaucaacaauuuucaggggacaaucuaggaaauuuaaguaguacaugaauaucugaucaagggauuaucauuaauuuaaaaaacuguaguaucauuauuauguugccauaaaaggacacuuaacaugaauuuauaauuauuggagugguguguacaugggaguucauuauacuauucugccuacuuuuguauaaguuuuaaaauuuucauaauaaagggaauucuuuuuuuuuucuuuucuuuucuuuuuugagacagagucucacucugucacccaggcuggagugcaauggugcaaucucagcucacugcaagcuccgccucccggguucacgcuauucuccugccucagucucccgaguagcugggacuacaggcgugcaccacuacgcccaacuaauuuuuuuuuuuuuuuucauuagagauaggguuucacuguuagccagcauggucucaaucuccugaccucgugauccacccgccucagccucccaaagugcugggaguacagguaugagccacugcgcccagccagggauuucuuuuuuaagugaaaaauaaaaagaucacuaucuagacacauguggcuggaaugugggacccaauaguuugagguguaggaggugauaaguagaugacagaguuugaaaguaaaaacuaaugcuuacccagcuccgaucugagacaacuaacgaugcuacgaccucaugcaaauaaaaagcugaaguaaucagaacuaaacagucccuuacaggaaaagcacaaaguguuuuuuuaggacuuacagacugggagccuagaauggcuaccuagggaaccgaggcacacauuuguuccauguuacagcacucagcuuuccuaucuguacaguaguuuguucuugagaacuuucccaacuaaaacucagagucuauauuagauagguauuuuauuuuucuaggugucuugggcuugcuuguuauacuugagcaacugauaaauggucugcccguuauuaccacaguacagcauacagaauagguguugaguguaggcacuccaggcagacaccugggcucaaacccugguucugccauuuucuaauagugagucuuugggcaaguuccugaacuugucugugucucuauuuguaaaauagauaaaaauagcaccugcuucauacaauuaucaugaaaauaaguuaauguauguaaauaauaaaaauaccugucacauaguaagcacugaagaguuguuaguguugugagccauuugucucuaagauuauuugcaucauuuuugcucuuuauguacaggauuuuaacuuuuuuuguuuguuuuuuguuuuugagauggagucuugcucugucacccaggcuggagugcaguggagcgaucguggcucacugcaaccucugccuuccggauucaagcgauucucuugccucagccucccaaguagcugggacuacaggcguguaccaccacgcuauuuuuuguauuuuuaguagagacaggguuucacuguguuagccaggauggucucgaucuccugaccucaugaucuaccggccucagcgucccgaagugcugggauuacaggcgugagccacugcgcccggcggauuuuaacuuuugagauggagucucgcucugucacccaggcuggagugcaguggcacaaucucggcucacugcaaccucugccucuuggauucaagugauucuccuaucucagccucccaaguagcugggacuacagguacccgccaccaacgucuggcuaauuuuguauuuuuaguagagaugggguuucaucauauuggucaggcuggucucaaacuccugaccucaggugauccacccgccuuggccucccaaagugcugggauuacaggcgugagccaccgcacccggccccaauuucuuaaaccuaguagaaaaugauuuuauuguuuuauagggcugucauuacuaaaagagaaaacugaaacaaagauuucaugaaaaaaauauaaccaguaacgggcuuaaacaaaaauucuaacauaagcauauacauauauauguuuuugagauggaguuuugcucuuguugcccaggcuggaguggaauggcgcggucuuggcucacugcuaccucugccucccgaguucaagcaauucuccugccucagccacccaaguagcugggacuacaggcgugagccaccacacuaauuuuuguuuuuuuaguagagacaggguuucaccauguuggccaggcugguuucaaacuccugaccucaggugaucugcccaccucagccucccaaagugcugggauuauaggugugagccaccgugcccggccaguuuuuuuguuguuuguuuguuuuugagacagucucgcucugucgccugggcugcagugcaguggcacgaucuuggcucacugcaaacucugccuccugaguucacgccauucuccugccucagccucccgaguagcugggacuacaggcgccugccaccaugcccugcuaauuuuuuguauuuuuaguagagacggguguuagccaggaugguaucgaucuccugacucgugauccacccgccucagccucccaaagugcugggauuacaggugugagccacugugcccggccuguuuuuuguuuguuuguuuuuuuuuugagaugaaguuuugcuuuagcccaggcuggaaugcaguggcgcaaucucggcucacugcagccucugccucccggguucaagcaauucuccugccacagcccuccugaguaccugggauuacaggcaugcaucaccauaccgggcuaauuuuuguacuuucaguggagacaggguuuccccauguugccgaggcuggucucaacuccuaacuucaagugauccucccguccuggucuccuaaagugcugggauuacaggcguuagccaccgugccuggacaagcauauauuguuucaaccagauacauuuuuauauccccaaaauguuuacaccaagcaaauuacaaacaauguuucuauucaaaguuucuaucgaaucuuggcuuagguauuaaaaaaaaaucaacagcuuuauugagauguaauucacauaccauuaaauucacccuuuaaaaguguacgauuaaauggauuuuaguauaucuacaaaauuuugcaaccaucacugcuauguaauuucagaauauuuucauuacccuaaaaagacgccuggcugggcaagguggcucacgccuguaaucccagcacuuugggaggccaaggcggguggaucaccugaggucagaaguucaagaccagccuggcuaacacggugaaaccccguuucuacuaaaaauacaaaaaauuagcugggcgugguggggcgcaccuguaauaccagcuacuugggaggcugaggcaggagaacugcuugaaccugggaggcagagguugcagugagcccagauugcgccacugcacuccagccugggugacagagcgagacuccaucuccaacaagaaaaaaagaaaccuguaccucuugguagucacuccccauucagccucuuccccaagccucugacaaccacuaaucugcuuucugcuccuguggauuuucuuguucugcacauuucagauaaaugaaaucauauaauauauggauggccuuuugugacuggcuucuuuuccuuagcaucauguuuucaauguuuacccaugucagaccauguaucaguacuucauuccuuuuuacugucaaauaauacucuauuauaugaaaauacauuuuguuuauccauucaucagcuaauagguuauauacacuguuuccaguuugggguuauuauguuuuuugagacagagguucgcucuuuugcccaggcuggagugaaguggcaugaucucagcucacuucgccaaguucucugcccuccggguucaagugauucucuugccucagcuucccaaguagcugggauuauaggugcccaccaccacgccuggcuaauuuuuguauuuuuaauagagauagaguuuuggcauguuggccaggcuagucucgaacuccugaacucaggagauccaccugccuugggcucccaacgugcuaggauuacaggcaugacccaauguccccagcccaauuugagauuauuaaaaauacauauauauuucaaaucaaauccaaauaaugugcacacaauguaauuaauuuauaugucccuuaaguuacuuuucucaauagguuucaucuguagguuuauucuucaucucuuuccuuuuuaauuuauuugcugaagaaacagaauugguugcuauguaguuuuccacuaucuugaucuggcuuauuauauuccuucagugucauuuaauacaucucucucucucuuuuuugagacagagucucgcugugucgcccaggcuggagugcaguggugaggucuuggcucacugcaagcuccgccucccagguucacacuauucuccugccucagccucccggguagcugggacaacaggcacgcgccaccgcgccuggcuaauuuuuuuuguauuuuuaguagagaugggguuucacuguuagccaggauggucuugaucuccugaccucguaaucugcccaccucggccucccaaagugcugggauuacaagcuugagccaccgcgcccggccuaauacaucucuguguccccuguauuucuuguaaauuaguaauuaaaucuagaagcauagucaccuuccuauaugucuuggcaagaacacuucaaggugauauugcuaccauguuuuuucauguguaagaaccacaacuauauauucuggguugcacauguguuucugaggaagcaguagacuaauacuuuaucuuuucuguuuuuaagacagagucuuacucugucaccuaggcuagaguguagugacgcaaucacagcucacugcagccucaaucuccuaggcucacgugauccugccaccuuagcuuccugaguagcuggaacugcccaugccaacaugcagagcuaacauuuuuauuuuugauagagacaggguauuccuguguugcccagacuggucuugaacuccuggcuccaagcaauccuccugaguuggccucccaaaguacugggauuacagaugugagccaacgaacccggccuaauauuucaauucauucucuaguucuuucuucaugagguuuuaaaacucuguuggacugacuacuacagguuauuagacaggcgucuucagggaacacugguagcauauauccuggugcuuaaaccauacaaaaacguaucugccacuaucccacccacuacauggcuacgagaauuuccuaaagcugaacaccaccgguuugauguuuuacaacuuagaagagguucaacgcuaucaaaaaucauggggauuuauggucgggcgcaguggcucacaccuguaaucccagcacuuugggaggcccaggugggugggucaccggaggucaggaguuugagaauagccuggccaacauggugaaacaccgucucuacuaaaaaugcaaaauuagcugggcgugguggugcaugccuguaauccuagcuauucaggaggcugaggcuggguucaagaauugcuugaacccagacggcggaaguugcagugagccaagauugcgccacugugcucuagccugggcaacagaggaagacuccauuuaaaaaaaaaaaaaaaaaaaaaucaugaggacuuaaaacugcauucccucuaucacaucaaucucugagacacauguauaauaugcuucacccagagaauuaccuaucuauuccuaugcuuuaauucaugucucugagcuaguguguucauaaaacaguacaguauauccaacuagguauaauucaccuaacuuucaguacagacacuugacaaagucacugaaaaucuaaacagaucaaagucaccuauuccuuguauauuuaccucccaagaaacuauaaggucugauuuaccccuuuuuaaaaaguuaccuuuuccugaugacucacauuauaguaguaacacuguauacaauguuaccugugauuucggaaucuuuaaaucaacucugaacuuaaauauguuacaaaggaguucauucuuaccucuaaaacuucagugaauaauugaaguaacaaguagggcaaaauaacuugagcaaaaaauguuacaugcaaauaaaauuuuaagcucauauuuaauucuaaaugccaaauaugcaaaaaugcuuugagacauuuuuuaucaccaaauuaacauagcauuugguuuuaguuuuaaaaaguauucacuuaauuuuccuuagacuacuguucugaaugaacaaaucccuacuuaauaacuuuuauucauaaaucuauaauauuauuaaauguacuucauauuuaaauaacuuauuuauacaaucuccauuugguugcuaaucugacucgaauuugugugcuacagaguccucuugugaaaugaaugaaaaaaaaaguaaaauaccuuaaaaugucccgugccuucauuagcacugaaaaaugagagcaaaauuaaucaauauuuaauacuuuaagcuauauguuuaaucauaaaacaacauauauaaauauuugagaaacaucaauucauuguaauucuagaacacagucaccugaaguuuuaugaaauaaacaaauguaauugucauuucugccaccuagugguuaaggcaaaggcaguuuuauccaguauuuuagucuacuuucuauacuuaauuuuagaaguuaaaaguauauucucuuuuuuugauggaaaauaugagaauuuacuuauuuuuuccagcuuuauuaggggauaauagacaaauuaaaauuguguauaucuauagguuuugauacguauauacuguaaacuaauaaaaucaagcaaaucaacauauccaucagcucacauacuuauuuuacuguagugagaacauuuaggaucuacuuuuagcaauuuucaaguauauaauacauuauuaacuguagucaucaugauguacaauagaucuccaggaaaaaguauauucuuaaauauuagauucccccucaccccacauuuagcauccuaacauuuuacagcuuagucuaauuucauauuuuucuuuuaaucauaaucaaugugauuuuccucucuauaguaacauuuacaauauaaaauuucuuacaagaaggcugcuaugcuuccuauugcuuuuuuugcagaauaauuaccuggacauaauuuuacucaguuuccuuuucaccuagaagccuacagauuucuugguuaaaucaauuacuuuuaagccaugagggagacaaggguaucuaacuuuuuguugagaaaguacuaugugccaggcauugaauuagguauucaugugcauaugcaugcuuuucauuuaguccucacaauagcccugcaaaugagguauuaguaccccuuucuacagaugaaaaaaaauuaagcucacagaggucauaacuuucuuugggacacacaaauaugguagguaauaaaacugaaauucacacucaggugugccuaacaucaaagccaauguucuuucuuccuuauguugugaagauuagacaaguucacaauuccaucaucuccaaaguauucuuuuuuucuuucauuuuuuucuuuaagagauagggucuugcucuaucacccaggcaggaguguaguggcucacugcagcuucaaccuucugggcuuaagugaacuucuugccuuagccuaccugagcagcugggaguacagauaugugccaccaugcauggcuaauuaaaaaaaaaaaaaaauuuuaagagauagggucucgcuguguuggccaggcuggucucaaacuccuggccucaagccauccuucugccuuagccuccccaaaugcuggaauuacaggugugagccaccacacccagacuccaaagcacucauuuuuuuuuuuuuuugagacagagucucacugucacccaggcaggagugcaguggcgugaucucggcucacugcaaccucugccucccggguucaagcgauucucuuugccucagccucccgaauaggugggacuacaggcacccaccaccacacccggcuaauuuuuguauuuuuaguauagacgggguuucaccauguuguucaggauggccucgaucucuugaucucgugaucugcccaccuuggccucccaaagugcuaggauuacaggagugagccacggugcccagcaaaguacucuuuguaagaaaaaaauaggcugggcgagguggcugaugccuguaaucccagcacuuugggaggccaaggugggcagauaaugaggucaggaguucaagagcagccgggccaacauaaugaaaccccgucucuccuaaaaauacaaaaaauuagcugggugugguggcgcaugccuguaaucccagcuacucgggaggcugaggcaggagaacugcuugaacccgggaggcggagguugcagugagcugagaucgugucacuacacuccagcccggugacagugcgagacuccaucucaaaaaaauaaaggaaaagaggccaggcgcgguggcucacgccuguaauccuagcacuuugggaggcaagguggguggauugccugagcucaggagcucgagaccagccugggcaacaaauuagcaaggugugguggcgugcaccuguagucccagcuacucgggaggcugaggcaggagaaucgcuugaaaucgggaggcaaagguugcagggagucaagaucaugccacugcacuccagccugggcaacagagugagacugcgucuccaaaaaaaaaauuuaaaaaaaaauaaauaaauaaaaagaaaaaaguaauagagauacagaaauauuuauauauuauaaaccuauaaaugauauauuauuuuauaugaaauuauaucaauauauaaauguaaacuguaaauccguaaauguacaaauaaauauaaaauauacacauaaauagaauguuaaauuauauuaucuuagaguuauaaaauaaaacaucccauucauuguaagaauuaucucuguagaauacuugguacaugggcaucagcuucuaccugaauaucuaaagacagcuuaacugacaagucagcaguuucauuugugggugacuuuguuagaaauugcuugcuugcggccaggugcaguaggucacaccuguaauuucagcacucugggaggcugagguagguggaucgcuugaggucaggaguuugagacuugccuggccaacaugguaaacuuaugucuccaauaaaaauacaaaaauuagccagguguguuggcacaugccuguaauccuagcuacucgagaggcugaggcaggagaaucacuugaacccgggaggcggagguugcagugagccgaggucgugccacugcacuccagccugggugacagagccagacuccaucucaaaaaagcaaaaaaaauuacuugcuuccacuuaaucaaacacgcuucacccuguaacauauaccuagaagucauaguuuugccuucugguauugugaaucagaccaauuuuucuuuuauuugguaacccuuuaaagauuuuaaacuaauuugagggacuuaccauugcuuuauuuccaaacaaaauauuuuuguuccuucugcuaccacaugacguauuuucaaacuuuuaccauuccaguuauaccuguuuaccaauaucucucuuaaaauaugguacccagagcugaacacaauacucuuguuggacuaaggcagcacagagugggauacuacucucggguuuacuaaacaccacugagcuuaaaauggcauuaaauuuuugcuguaucacacaucuccuaagacucuauuuucuuugguaugcagguguauguauuauagcaccauggaccacuuuaaccuuuauuuuugaacggcccugcauuauuucaauacucauauugauaauaauucagacuuaagaauaucacauguugauucuuacaacaauccuuugaguugcuauuguaaccuccaguuuagaaauacagaaacugaugaucaguucagagaaguuacaucccaaggguuaccuacucugaguuagucuucaaaaccuauacucuuucaacauaccauacugucugucuuggguuauuucuuuuuauaaucuacuuuacacauagaaacuauagaacaaaaaggauaagagucuaucuuaagaucauaaagcugggcacgguggcucacgccuguaaucccagcacuuugggaggucgagguggguggauaaccugaggucaggaguucaagaccagccugaccaacaaggagaaacccugugucuacuaaaaauacaaaauuagcggccgggcgcgguggcucacgccuguaaucccagcacuuugggaggccgaggcgggcggaucacgaggucaggagaucgagaccaucccggcuaaaacggcgaaaccccgucucuacuaaaaauacaaaaaauuagccgggcguaguggugggcgccuguagucccagcuacuugggaggcugaggcaggagaauggcgugaacccgggaggcggagcuugcagugagccgagaucccgccacugcacuccagccugggugacagagcgagacuccgucucaaaaaaaaaaaaaaaaaaaaauacaaaauuagcugagcaugguggugcaugucuguaaucccaguuacccgggaggcugagacaggagaacugcuugaaccuaggaggcagagguugcagugagucgagaucaugccacugcacuccagccuugacaacaagagaaaacccugucucaaacaaacaaacaaaaaaaccggucaggugcaguggcucaugccucuaaucccagcacuuuaggaggccaaggcaggcagaccacgaggucaggagaucgagaccauccuggcuaacauggugaaacccugucucuacaaaaaaacaaaaaaaaauuagccgggcgugguggcaggcaccuguagucccaucuaccugggaggcugaggcaggagaauggcaugaacccgggaggcggagcuugcagugagcugagaucgcgccacugcacuccagccugggaaacagagcgagacuccaucucaaaaaaaaaaaaaaaagaagaccauaaaacacacauacccuguugggugcaguggcucacgccuguaaucccaauacuuugggaggcugaggugggugaaucaccugaggucaggaguucgagaccagccuggccaacaugaugaaaccccaucucuacuaaaaauacaaaaacuuaaccgggcaugguggcacacgccuguaaucccagcuacuugggaggcuaaggcaggagaaucgcuugaacccuagaggcagagguagcagugagccgagaucacaccacuacacuccagccuggacaagaagagugaaacuccgucucaaaagaaaaaaaaaaugcauacccaauuuaggggagaaaucuaauuucauauuccaguaacagagaaauuagugcagaggcugaacccaccucaguguuuuuccuccuccaagucaagcagagucaagcacugaaccaaauuugccccugugcuuccaucagacuaaaacuccccuuguccugucaugaaaacaguuuccuacagguuacccccaauagccuaacuuuugcgguaacauaaaugcuuuucuauguaauaaaaagggugaggugcaguggcucacgccuguaaucccaucauuuugggaggccaaggcggguagauugcuugagccaggaguucaagaccagcuugggcaauaugguaaaaaauuagcugggcaugauggugugugccuauagucccagcugcucaggaggcugaggcgagaggauugcuugaguauaggaggcagaggcugcaguaaccugagaucgcgccacugcaguccagccugggcagcagagcaagacccugucucaaggaggaaaaaacagauaaaggacugucuuaggagguacacugaauacccaucauaaccaacaauuucuaagguucaauuuuuauuuacacaggaggaccuuaauauauaccuuaugaguccaggugcaguggcucacgccuguaaucccagcacuuugggaggccaaggcagguggaucacgaggucaggaguucgagaccagccuggccaacauggugaaaccccaucucuacuaaaaaauacaaaaauuagcuggguguggaggagggcacuuguaauccccgcuacucuggaggcugagguggcagaauugcuugaaaccggaagacugaggacugagguugcaguaagccaagaucgcgccacugcccuccagccuggggaacaaaagcgaaauucugucugucucaaaaaaaaaacacacacacacacacacacacacacacacacacacacacacacacacacacacacaaaagcaucuuaugaggccaggugcaguggcucaugccuguaauccgagcacucugggaggcuuaggcagguggaucaugaggucaagaguucgagaccagccugguuaacaaggugaaaccccgccucuacuaaaaauacaaaaaaaaaaaaaaaaaaaaaaauucaggcauggugguaugcgccuguaaucccagcuacuucagaggcugagguaggagaacugcuugaacccaggaggcagaggcugcagugagccgagauugugccucugcauuccaaccugggugacaaaguaagacucugucucagggaaaaaaaaaaaaaaaaaaauauauauauauauauauauauauuuuauauacauaccuuaugaauaaacaaaagcaauuuauucaagguuacaaagcuagaaaacagcagagcuacgacuuaaauccagaucuccuauuccaagguagggcuuuuuccucuacagcaggaaaugcauuaauaauguaacaacuuuaguaaugguaaugacugccuugagcaguguggucaagucucaucaggaaagccugcuaugauuaauuauugauuucugcuacaaguaaagaaagaagaaaugguggcacacccaucacacguuuaccaucguuguauuacaauaucugacuuuucaaaaaagguauaaaaaguggauccaaguuccugcugugauuaguggaaaguguuacauuuccccaaaauaauuuuuuuuuuuuuugagacagggucuugcucugucacccagguuggaaugcaguggugcaaucaaaccucacugcagccucaaacucccgggcucagucgauccucccccaucagccucccuaguagaugggacuacaggugcaugccaccauggccaauuaauuuucuuuucguauuuuuuuguagagacaggguuuuaccauguugaccaggcuaguguccagcuccuggacuccagcgguucuccuaccucugcuuuccaaagugcuaggauuacaggcauaagccaccaugccugacccucaaaauaauuuuuuaaaauuuaauuuuuuaaaaauauaauuccuuacaggcgcgguggcucacgccuguaaucccaacacuuuggggguccaaggugggcggaucaccugaggucgggagauugagaccagccugacugacauggcgaaacccugucucuacuaaaaauagaaaauuagccaggcaugguggcuggcaccuguaaccccaacuauuugggaggcugaggcaggagaaucgcuugaacccgggagguggagguugcggugagccgagauugcgccauugcacuccagcaugagcaacaagagugaaacuccgucucaaaaacaaaaaaaaauccuuuuaauuuucuuuuuuauuuuuuuugagacggaguuucacuccugucacccaggcuggagugcaauggcacuaucucggcucaccacaaccuccgccucccggguucaagugauucuccugccucggucucccaaguagguaggacuaaaggcgcgcaccaccaugccuggcuaauuuuuguauuuuuuguuuguuuuuguauuuuucgagacggaguuuggcccuuguugcccaggcuggagugcacuggugugaucucggcucacugcaaccuccgccucucggauucaagugauucuccucccucagccuccugaauagcugggauuacaggugcaagccaccacauccagcuuuuuuuuuuuuuguauuuuuaguaaagacggguuucaccauauuggccaggcuggucucgaacucuugaugucaaguaaucugcccaccuaagccucccagaaugcugggauuacaggcgagagccacugcgcccggccaacucuuuaauuuucaaauuguaauuagcuagucauuaaaagauauuacuccagccuucuuuugauuaguaugaaaacaaaacaaaagucacauugucacauguguaaaaauucaaacacaauggcaaguaagacuuguucccaucccagacucaauagacuccagugccgcuuccuaggggcacugccauuaauauguucuuuuuuuuuucucagcagucuuucucugucacccaggcuggagugcaguggcacaaucucagcucacugcaacguccaccucccaauucaagcgauucuccugucucagccucccaaguagcuggaaucacaggcacgugccaccacaccuagcuaauuuuuuauacuuuugauagagacaguguuucaccauguuggccaggcuggucucaaacuccuaaucucaagugauccgcccaccucggccuccucaagugcugggauuaagagugagccacugcacccggacuuuuuuuuuuuuuccuucagacagaguuucgcucucauugcccaggcuggagugcaacagcauaaucuuggguuacugcaaccuccaccucccagguucaaguaauucucccgccucagccuccuggguagcugggacuacaggcaccugccacaacaccuggcucauuuuuauauuuuuaguagagacaggguuucaucauguuggucagggugaucuugaacuccugaccucggguaaucugcccgccucggccucccaaagugcugggauuacaggugugagccaccaugccuggccaagauuuucuuauauggccuuucaggaauggccuguacacauaaaaaguauacguguacuugcguauuuuccaccauccucuuuuuaaaaaacuuaagugagcacaagguacaugggcuugccuuucugcaccuugcuuuucccacuuaauacaucuuggagacuauuccacaucaucacacacauuauuauauuagugcauacucauguauggguauaccauuauuuaaccuacucccuuauagagauauaaauugcaacacucuuuaauaauagaaauugcuggauuaaaauuuggaauuacaugauuucuucuaauuuuuccaaagggaucuuuaugucauuaucaucaaccacuacuaugggcuucuuggggacauaacaaaucucuugccuuuuagggguucuuuucuuuuugagacggagucucugccgcccaggcuggagugcaguggcaccaccucggcucacugcaagcucugccuccuggguucacgccauucuccugccucagccucccgaguagcugggacuauaggcaccuaccaccacgaccagcuaauuuuuuguauuuuuaguagagacgggguuucaccguguuagccaggauggucuugaucuucugaccucaugauccgcccgccucggccucccaaagugcugggauuauaggcgugagccaccgcgcccggccuuagggguucuuaauaacaguugagagcacgaaguggauauacaaggagauaaauacaauaaagcacacacuagauaauaaaugauacaaguagccuagaguuauaaagagaugacugagaaguaaaauagucaucagugauacaacaugagaaaucuagauuuuuuccaagaaaggcauuuuaguuuacugggccagccaguuaagcguuugaaaacuaguuugauacaugccaacucugggaccaugacagucuguuuaacauugcugcacuaaaauggaguacaccauaugcuacaguguaugaaagaagcaauuuauaaguaucuagcagggcacgguggcucacgucuguaaucccagcacuuugggaggcugagguggguggaucaccugaggucaggagaccagcuuggccaacauggcaaaacccugucucuacuaaaacuacaaaaauuagccaggcgugguggcaugugccugcagucccagcuacuugggaggcugaggcaggagaauccccugaaccugggaggcagcaguugcaauaagcugagauugcaccacugcacuccagccugggcgacagaguaaaacucugucucaaaaaaaaaaaaaaaaaagaaagguaucuaacuaauuuggcaaaaucagguaaaguugaagaggaacauacccuaagacucaguaaaucuacacucguggagaacuaucuaucucacauauacacaggagauacauaugaauuuguuuacggcaacauuguuuaaaacagcaacaaguaaauaaaccaacaaaccuggaaacaaaccuaaauauucaacagaacaggaaaagauaagaaauaauauauucauuuuaauggaaugccaaauaauggugaaaaugaaugaacuaggcuauauauuucaacagggaugaaucacacaauacugagugaaaaguauaccauuucaaguuuggcaaaaacaaugcuacauauugcuuaggaauagauauacacguggcaaccacaugaaaaaaaaaggcaugggaaugacaaacacuuuuuuuuuuuuuuuugagacagagucucacucugucacccagacuggagugcgguggcacgaccucgguucacuucaaccuccacugcccgauuucaagugauucuccugccucagccucccgaguagcugggauuacaggcaccugccaccaugccuggauaauuuuuguauuuuuaguagacaggguuucaccauguuggucaggcuggucuugaaauccugaccucgugauccgcccaccucagccucccaaagugcugggauuacaggcguaagccaccaugcccagccuuuuuuuuuuuugagauggaguuuugcucuugucgccuaggcuggagugcaauggcgcgaucuuggcucacugcaaccucugccuccuagguucaagagagucuccugccucagccucccaaguagcugggauuacaggcacccgccaccacgcccagcuaauuuuuuuuuuuuguaauuuuaguagagacgggguuucgccauguuagccaggcuggucucgaacuccugaccucaggugauccacucaccucggccucccaaaguguugggauuacaggcgugagccacugcacccggcccuuuauaccuuuuucuaauuauuucuaauauucaguuauuucauaauuuuccaaggggaugucagaaaacuugauuuuaccugaguucacaaugauuuccuauuaggacuuuuaacauucuuuaaguuaaaagguaaauuuuuaggguacucacccaaugaacuccaguaauaaagacauaucaaguucagguggaauacgaaacacugauucuaggacuuuuuuagaucuuccuuugcuugaagggacuggcuguggaacagcuauuuaauagucaaacaaaaauguuaauuaagaauaaaaaugccauaaauugagaucuuuggaaaaauacacaaguauuauaauuauguugaguauuuaaaagaucauaaaccacucaaucucccugucuuuaaugacauuggcuaaucugucaaagccagugaaaugagaggcaagccuggggaccacuccacaauggaaggcagacauguggcuggcuuauuagggacgcagagagagcucauuagaacagcaacauguguagacaacccugcauaagcacuacuaugugucagggcucauacuuagcacuucucaugcaucaucucauucguccuuacuauagucccaugauauagguaccagugcuacugcuuuuuuuuuuuuucuuaacuaauaaagaaacugagaccgccagucgccauggcuaaugccuguaauuccaacccuuugggaggccaagguggguggaucaccugaggucaggaguucgagaccagccuggccaacaucgcaaaacccugccccuacuaaaaauacaaaaauuagccaggcaugguggcaugugccuguaaucccagcuauuugggaggcugagacaggaggaccgcuugagacuggaaggcggagguugcagugagccgagaucaugccacugcacuccagccuaggugacaagagagaaacucugucucaaaaaaaaaaaagaaacugaggcuuagagagaguaagcaauuuguguaaagucacucagcuaagucaaggaaccaggauuuaggccaagcaagguggcucaugccaguaaucccagcacuuugggaggccgagguggguggaucacuucaggucaggaguucgggaccagccuggccaacauggugaaaccccaucucuacuaaaaauacaaaaaaaauuagcugggugugguggcacaugccuguaaucccagcuacucaggaggccaaggcaggagaauugcuugaaccuggaggcggagguugcagugagccaagaucaugccacugcacuccagccugugcgacagagcaaguccaucucauuuaaaaaaaaaaaaaagccaggcgcgguggcucacgccuguaauccuagcacuuugggaggccaaggugggaagaucaccugaggucaggaguucaagaccagccugacaaacauggagaaaccccgucucuauuaaaaauacaaaauuggccaggcacaguggcucaagccuguaaucccagcacuuugggaggccgaggagggcagaucacgaggucaagagauugagaccauccuggccaacauggugaaaccccgucucuacuaaaaauacaaaaauuagcuuggcguaguggcgggcgccuguagccccagcuacucaggaggcugaggcaggagaaucgcuugagcccagaaggcggagguugcagugagccaagaucaugccacugcacuccagccuggugacaucucaaaaaauaaucauaauaaauaaauaaaaauacaaaauuagccaggugugguggcgugugccuguaaucucagcuacuugggaggcugaggcaggagaauugcucaaacccagaagguggagguugcggugagcugagaucacagcauugcacuccagccuggcaacaagagcaaaacuccgucucaaaauaaaaagaaccaggauuuaaauccaaaucuauuucauguccauuccgugacauuacaucaucauaaaaacuaacguuugaacaguuacugugugccaggcacuguuuuaagugcuuauauuacucaauauauuuuuuuaaaugaagugguaugauuaucauuauuuuguagaugaggaaacagacauuuacguauguaacuggcuuggcuuaaguuauacaccucauaaaguggcagggcuaggaacaaacucagagaaucuagcuccacagucugcaaucucuaauuuuuauaaauaaauuggauuacacacagcauuaccuucaaaaucucucugaucauauaauaagcuacccccaaaaggaacuucaaagggcauauauuuuauuguuaguauucuuuaaucuguaaguacauuauaguauacacccaaacuuaccagguuuagguacuucuagaccucuuucuuuauagaaaucaugcauuugcuuuuuuucuccuaaaaaaugauaaaacacagacuaaauuacacuuaaaauguaacuacuagagucagagauucugggauucacaaccauguaauaaaagaaacuuacuuuccucuagauugaucacuaauuuguacacuaugucuuguaacugucgguccaaccuaauaaaaggaaaggauggagaauaccucagaauucagaaaaaugcauuuugguacagagugaguuaauuguguuuucucuugagaguggguaucuuuuuucucagaggugaguuacuuuuaaguagcauuuacaguuccuaaaauauaacucacucaagaaaaccuuaaguaaauauauguaaucauaaguauucacagauucuugaaugggucacuaaacuguuucaugugcauuguuuuuugugugugugugugacaaggucucacuuuugucacccaggcuggagugcaguggcucaaucauggcucacugcagccuccacuuccuaggcuuagguggauuuuucccaccucagccuccuuaauagcugggacuaaaggcgcgugacaccacgccugguuaauuugauuuuauucccuucauaagaauacgaguugagggcagagacuguauuuugaacuucugucuaucaucugcaaagcacuccugugugaagguaguaaaaaucaauaguauuuguugaauaacaguaaucuacuguuaguauuuuucccucucuuaagaaacugaguaugaacuggaaauuugaauaauaagccacaaugagcuaaugacaaaugggcuuuacuaaagaggccaguuguuucagguauuacuucuaaaaaaacagaauuuggaauaccuauauacuggaaaugaaaagccuaaacuagccucauuaaccugaguaagugaugggauuaaaauucucaggaaaaaggccugugccucuuuuaaguccucagcagauauuacagugccuaguacauaguaagugcucuauacauauuucuuaaaagaauauguaguucccuuuuaauuuugagagaggucaagaguuuuuuuguuuuuuuuuuuuuugagauacucucaucagucugucgcccaggcuggaauacaguggcacgaucuuggcuccugcaaccucugccucccagguucaagcgauucuccugccucaaccucccaaguagcugggauuacaggcaugugccgccacuccuggcuaauaguggagaugggguuucaccauguuggccagguuggucuugaacuccugaucugaagugauccacucaccucggccucccaaagugcugggauuauggcauuagccacugaacccauccugagaggucaauaauuuauuccaacuauauaacuucaagcuuucagaaaaaguauauuuaaaauacaauuguaauuuauauauucuucuuaccuuauguuauaaagagguugugucugauguacuacuauauugcauuuuggacaucuguugcuguaguaaaaaugucuuacgaugcagcuuuuacaaacuguugaaaaagaauguugaagucaggaugcuuucaagacauuucaaaaacugaaaaauuauucagaaaugugaucgguaugcuuacagguaugaagacauucugugaugguaguugcaucuauuaaguaaccuuugcaaauggaacacaagauguauggggucagcucagagagauuaaucaggcgcugcaaauaaacggaaacaguuuuaaaauacaaguccuugccuuuuacaaauucuuuuuuuuuuuuugagacagagucucacucuguagcccaagcugagugcagugaugucaucucgguucacugcaaccuccgccuccuggauuaaagcgauucuccugucucagccucccgaguagcugggauuacaggcgcgcacaaccacgccuggcuaauuuuuguauuuuuaguagagaugggguuucaccauguuggccaggcuggucucgaaccccuggccucaggugauccacccgccaaggccucccaaagugcuaggauuacaagcaugagccaccgcgcucaguccaccuucuucaaaaccuuaaaccauaaucucaaaaugucauugcaacauggaaacauacaccuccaacccauuaaaagacuacugaaaguuacaauaauaacacaauauaaauuauuguuucuuucuuuccguuuuuuuuuuuuuuuuuuugagagggagucugccucugucgcccagacuggagugcagcggcaagaucucggcucacugcaaccuccgccucccagauucaagugauucuccuaccucagccuccugaguagcugagauuacaggcgcgugccaccacgccccgcuacuuuuuguauuuucaguagagaagggguuucaccgcuuuggucaggcugaacuccugaccucguguuucgccugccucggccucccaaagugcggggauuauaggcgugagccacaccgcgcccagccaaauuauuguuucaaaaggaucuuuacgcugggcgcaguggcucacgccuguaaucccagcacuuugggaggccgaggcgggcggaucacgaggucaggagaucgagaccauccuggcuaacacggugaaaccccgucucuacuaaaaauacaaaaaauaagccgggcgugguggcgggcgccuuguagucccagcuacucuaaaggcugaggcuggagaaucgcuugaaccugggaggcggagguugcagugagccgagaucgcgccacugcacuccagccugggcgacagagcgagacuccgucucaaaaacaaaacaaaacaaaacaaaacaaaaggaucuuuacugccuaguaagcaguagcuucaauaauuauacaggacaggcaacguggcucacgcauguaaucuuucggaaggccagagagggagaaucucuugaacccaggaguucgagaacagccugggaacauagggagcccuccucgcuacaaaaaaaaaaaaaaauguuuaauuagcccggcgugguggcgcgugccuguagucccagcuacuccggaggcugaggcgggaggaucgccugaggccaggaguuggaggcugcagugagccauggucgcgccacugcacuccagccugggagacccugucucaaaauaauuauaauuauuaacagaacgaaugaguuggacucgcagagccuaagugaccugcaagaacuucacaaaauaagcggguaaagacccaggccgggccggaggccugucggcgccacacgccuaggcagccggggcagaggucgggggagguccgcuccagugcuccgcgcggcggcggcgcacuaggaucgggccggcgcccggcagacgagggccagcuacgucccugacgccgcuugggcccagcggggucgcgcgggggcucuaaauaccuccuccucguccuccgaguccugccggccucccuccagccucaacgagaagugacucauguccuccuccuccuccucuucuuccuccuccagcuccucuucuucuuccaacuccucguccucguccucgaagcggccucugaagcggcccaggcugcgcuccggcuccagcucagggggccgggagccggagcagccgggagcccccgucucagacagaggcgccggucccuccucacccgcugcgggugcaggggugagggcgggcggggagacaggaggcggaggcggcaaggcugcagcucccucgguuuuggcagcgccuacgcugcccgccgucaccaccgcgacccccuccauggucgggagagacaccaggcgaggcgaggcggcgggagagcgcgggaguucggccggccucggacgcc

SEQ ID NO: 192798 - RNA, 12397 nt, Homo sapiens
gcccccugcauugcugaugcugcugcuggcggacauggacguggugaaucagguacgcgcuccagcaccguggacagagcccgccgccgcccggcugccuaggccgggucgcucaggccagccgacucugggaggugguggccagggucuggcagcggagacccgguccccggcgcuggggaugggggucugcggcaggugaaggggaggaagggggagguggagaaaaggagugcgcucuuugccgcagcgagggccguccucacugccgcagcgggggcccccggagccccguuuauuacuggcgaccgcgaggggaggaauaggggccugggggcuggagugagggcaagggacaaggggaggggagaguggaaggaagauggggggugcugcggauaagcuaggaaauagagcgacagaaggugugggggcggggaugggggagagggcuggcacccgccccucccaaacagagacuguacccccauaggcgaccaccccuucccccagagcacaccuaggggacaauccgguuuuacuccuuccaaaacccccagccuccucacccccaacacauagcgacugaagccgugucccagcccucccccaccuuaaucaguccagacccucuccgccaugucucucgucuuugccaccucagaaacucacccccaaucagucccaacccuuccccauccccaucaccucaaauaucuaccgccaccgccgucuaacacaccuuuaccccugcagacccuucccccaccugagccaaaccgacuccugccccguuaugacucaccuucaccaucacaacccccccacccgaaugcaccccacuccauccccauucucuacccgaaccccuuccccauccgacucgccuuuacguuucaaaccugcucccccuccuuaacuaguccugaccucauccccaucucccucacccccgacuuccucugccaucugacucaccaucucuucagaccuucccaccaguccuuggacccuggggcucacaccauccccaaggugucacuuucuccuucucacccucuccccgaggucacaugcuccauccccuggggucauugaugggcagccuugccgcucaccucccuguaccuccaacaaccccaccccuuccccacuguuucucuccucagcugguggcugggggucaguuccggguggucaaggagccccucggcuuugugaaggugcugcaaugggugagugugguccgggcuguuggggcagagugcagggagagagggaggucaugggguccagaagagcagggguggaguaggggcgaguagccagggaugagugcggggguuguaggggaugggggaauugggcuccagggugagguuucaggggucugaagccagaaaacagaugagcugugacgucacauagggcugaggguacccccguugugaagugggagacugugacguccuaccuccucucuugaagugagggaggggugggggagguggagccuguagcagaugcugggugagagaugcaaagucagagaaacccagagacagugaaggugacagagagaaugagggacagggaaugauaaagacagagauggaaauacugagaaaaaaaaaagaaauauggagaugagaagagauacagacauaagagagaagagacaaacagaaacaaagaaaaaggagacacagaaaacagaugcaaagagaaacagacgcagggagagaggcaggaaaacagggugagggagagagagacacagagagaaagagacacucagaaaaaagagaaaccaacacacagaggcaagagggagacagagagagaaccauccggagaccgagugagagacaggacagagagacagagacaaacagaccaagaaacagaaagacacagacauacaggcauacacuuacacagacagagaaaaaagagacaaaaagagacaucgacagaucagauaggcagaggcagagaggaucagagacacagagagacaaagagacaucugagaaagacaaagacacauagagaaacagagauaccgagagaaacagagacacagugagauacacagagaacaacagagacaaacagagaagagggaggucagcauggaaaggcagagacagagagagacacagagagagaaacaggaagagacagccauacccuuguaaucagcuuguccuuggucccgaugagcccugauuaggggguggggguggggacugcuccaucugcugcugccugugcugggcccccgaucuguccagaggagggcaccucccucccacaugcacacagguucacuguggccauccccaucccugcugcccaaggucuucgccaucuucgccuuugccacaugcggcagcuacaguggggagcuccagcugagcguggauugugccaacaagaccgagagugaccucagcaucgaggucgaguucgaguaccccuucaggugugcucccacccugggauaccaacagaccugggagaggaaggggcaggguggaaccggccaauaccuccccccgcaaguagcuccugcccagcucccaccucgaggcuacauccacugggaucacugagcaccugccuuguaccuggcacugcucuggacucuaggacuauguggugagcaaggcagacauaggcuguggcccucuggcucuguuccagcgaagggguaagggacaggcaauaaacaagauacaaaaguaagacagguguauauacauaccuuaacccaguagguacccaauuaauguuagccaauauuauuauuuaauccccauucauucauucuauacacauuuuugagaacuuauuuuauaucugguacuacucaaagugcuggaagcaugauaguaacuaaaacagacccaacucccgccaggcacaguggcucacgccuguaaucccagcacuuugagaggccgaggugggcggaucaccugaggucaggaguucgagaccagccugaccaacauggagaaaccccgucucuacuaaaaauacaaaauuagccaggcguggucaugcaugccuguaaucccggcuacucaggaggcugaagcaggagaaucacuugaaccugggagccgaaaucgcgccauugcacuccagccugggcaacaagagcgaaacuccaucuccaaaaaaaaaaaaaccagacccaacucccuaccuucauggagccuacauuauaacaaauaaauuaacaaagaggauaauagcagacugagagaaacucgaggagauccucauguaggguuuuaugguagagaauagaauaaugaggggugcugcuuagauauagggaaaaauuaaacccaauuaaacaauucugacauuuauugagcucacacugugugccgggcaauacacugggugcuaggugcacaagaaugagcacggcuggcaugggcacuacccucacaaugauguuuaccuccugcagggugggaugacagagacccacagacacaauccccgcacagguuucugagacucccccacuauuuggccaaaucacauaaccacucugggucucaauuuccucaucuguaaaaaggaauacuaauaauaucuaccucacagggucgugguuagcauucaaugaguuaauauucaucaggugcuuagcacagugccuggcacacaauaagugcuccaucagugucuguucaauaaguaaaauaaauuuaagggacucaggaaagaggacagggguugaguuggaaacugggggucuucgaguacugaggguaaauguaggcucaagugaucacccaguggggagauggaagagugaaaguagaagaaaaccuagcacaggcccugagcaaugauggaaaagagaggagaugccgggaaaguguggccugagaggcagaggggcagccagguauccauggguccacaaaggcaagggagaaaagagucuggggaaggagggggagcuggcagcaagggacacugcuuagagccaguccuuuggggauccacaagaccacaaccauccccugugcccccuccccacgccucccaugucuagaacuuuggguccuaaggcucuagcccacaaguccccuagaaaaacagucuuggcccugggucccccugagcaaaaucccucccaaacugcccuaauacccaaggaccucucauucccucuuagggacccccucuccugacccagcccacuagaaacagaaacucaaacccagaugcaacuccuagcuccaucauuuaggagcuguacaaccuugggcaaguaauaaccuugcuaagccucuguuuauucaucuguaaaaagggucuaauaaugccuucuuuagagaauugcuggaggcugucauuaaugagacauuuauguaaacugcuuaguaggugacuaauaagugcaagccucuucccucagggccuuugcuacacaaaggcauuggcaccauuugcucagucucaggauccuggccuccaaucugagacugugcuccagaacuucucccacagacauuuucucucuacaacccccaccucuccuccaucacaccacaggaaaggccuuagucccaggacaccuccccucuucccucacauacacacacccuguuccaagaucccuuuacccuccuuucuuucugucugucuuuuccuguuaucuagucgcuggccucuccucugcuaugcauacauuuuuuucucucggggaccugaacuggggugggggagaaaagucaacaugagauagggagaaaacaagguucagaucucaacucugacauucccuugccagcugugugacuuuaggcaaguuaaugcacuucccugagccucuguuuccgccucuguacauuucauuugauaaacauuucuugagugucugcuaggugccagcacuguuccagggccuggagauaaacggaggugaaaacacaggaaaaagcccugcccucuuguaguuacagcaaaaaccaagauuaaaaaaaaaaaaaauaccugguacgucagauggguaccacuacuaucgagaaaaguggagcaaggaagccaggcuaagaagugcugguugagagaauguuucaauuuaauuuuaaguagggagaucagggaaggucucaaugagaaggugacaguugagcaaagcuucaaggagaugagggaggccgggcgcaguggcucacgccuguaaucccagcacucugggaggccaaggcgggcagaucacaaggucaagagaucaagacuauccuggccaacauggugaaaccccgucucuauuaaaaguacaaaaauuagcugggcguagcggcgcaugccuguaaucccagcuacucaggaggcugaggcaggagaaucgcuugaacccgggaggcagagguugcagugagccgggauugugccaccgcacuccagccuggugacagagcaagacuccaucucaaaaaaaaaaaaaaaaaaaaaaaaaggagaugagggaguaagacccgaagcuaucuaggggaaaagcauuccuggcaaagggaacagccaguacaaacaaagauccuagggagggaggaugccuggcaaguucuagaaauaaucaagaggccagagugcuuggguuggagugagggaugaauaacaccuaucucaccaggauguuuugagcaaucagugaaaugugacugguacauaguaggugcucgaugaaugguuauuuccuccucuuccuggggccuugucagaaauggggggacccaugauugggcuggaggguugaggguguucugaggggcugggccacaccugcccaccucuguuugcaggcugcaccaaguguacuuugaugcacccaccugccgagggggcaccaccaaggucuucuuaguuggggacuacuccucgucagccgaauucuuugucaccguggccguguuugccuuccucuacuccaugggggcucuggccaccuacaucuuccugcagaacaaguaccgagagaauaacaaagggcccaugcuggugaguccccacagccacuugcauguagggaccauggggacacggaaccccagggacacagccaugcucacagaccacaccaaaucccagacaggcccacaugcaaacagccaccauaacagccacacauauaguugcugcugcuauuaauccacaccaggcauccgggacacagagucauagagucacggagacauacagccuaugcagaaucccagacaggcccacaccugagaaccuucccacucucacacaacuacacagccuagaucaaaggaagaggcccacagagguucgcugugacagucaugccugucaucaugccacacagacacacugauuccuacaccacuguacucacauacccucagccuagacacaaaaugacaaaaauucccacaugcagacaaaaguagaaagacacauuacuuuccacagauucggaaaucaucccagaguuccccuccccccaacacccacagccacauaucacaaucacacucccacauccucugugucauguacacacacaagcucaagcugggagggccaccuucaggugaaaguguugugggcuugagagcugaaaaggcaggggagagacaggccucuucugggggaccugugauccgaggaggccccagggccuagcgugaagcaguccacucacagugcugucuuccucaccccugccugccuuaggacuuucuggccacggcuguguucgccuucauguggcuaguuagcucaucggcaugggccaaggggcugucagaugugaagauggccacagacccagagaacauuaucaaggagaugccugucugccgccagacagggaacacaugcaaggagcugagagacccugugaccucgggacucaacaccucggugguaagcccugggugcuggcuggaggagggagaguggaaaacaguacaguccggcauggggagugguggagugggagaauaagaggagagucaggggagauccaaggggugucccugaagaacgcgugccaacaacaacguugaaggaugagcuagcaauuguaaccacugugacaccacagacuguccccaaagggggaacaugacagguuugggagaccuggaucccagacccagccuagacauguaaaauaagcaacucagcacccucuugggaccucaguuuccucaugugcaaaaugaaggaaaaacuugaaauguuuccccacuuggaugcccccuacuggcuggagucagacugucugcgcucaaaucccagcucuaccucuugcaagcucccugaccugaaacuagucacagccucucaagguucaguugagcaugcauaaucgaagacuaauaauagguccugcuccaaaguugaguauuuauugaacuaagaauacggagugcucagaaaagggccuggcacaagguaagucguauacaaggguuacagaugcuaagauuacaacuuuucuuuccugucacuugcuggaugugagacuucagguaacuuagccucuagggccucaguuuccucaacuguaaaauggagauaguauuuccugcccaaaacugaauuuuaagugagcuuauaacauguaaagcucuuagaagagggcuuggcauauaaggaaagguacagaaaguguuuuaugucuuaaaauuacuuuauguggccgggugcgguagcucacgccaguaaucccagcacuaugggaggccgaggcgggcagaucaccugaggucgggaguucaagaccagccugaccaacauggagaaaccccaucucuacuaaaaauacaaaauuagcuggugugguggugcaugccuguaaucccagcuacucgggaggcugaggcaggagaauugcuugaacccgggaggcgaagguuguggugagccgagaucgugccauugcacucccgccugggcaacaagagcgaaacuccaucucaaaaaaaaaauuaugcaaguuucauauaucuuauacaugugcacuuauacauauauuuuaucuacauuuauuuagaugcauguuagugguauagcuauauuuaauaaguuuguauccuuacauuuuacuaugaauauauuacaaauuuacauuuuaaacaugcauaaauguguauauaauguguauaugugcaaauauguaaauaauuguauauguaauacugauagaucgcagcauccccagggcuccaaauucuucuaacacgcccaccccgccagaggugauuuuucugcacaucgacguucucgcacugggacucagagagucuggguuucagaaacccccaccuugcggagccuacggauucauuccccgcaugcucauuccugcacgcagggccgccaaggcaaugggcgggguaccacagccgagccuugucucccugcagguguucggcuuccugaaccuggugcucugggucggcaaccugugguucguguuuaaggagacaggcugggccgccccguuccugcgcgcgccucccggcgcccccgagaaacaaccggcacccggggacgccuacggcgaugcaggcuacgggcagggccccggcggguacgggccccaggauuccuacgggccucagggcggcuaccagccugacuauggucaaccagccggcagcgguggcaguggcuacgggccucagggcgacuaugggcagcaaggcuacggcccgcagggugcacccaccuccuucuccaaucagauguagucuggugagugaccggcgagcggugcggccaaggaggguacaaggaaggagacgagcgggucagugaaccaauaagagucagggguagagaguacguaaggcguuuacuggggcaaguaaggacugaaguuugaaggagccaaucaagaggcagaacuaccugcuaagagcugaaaaacuagcuaaugaauggagaaaagaagaauggugcuucaagauggacagaaugaagagccaaugggagggagguagaagggcaacucggcggaaaggcagggggagagaagcagagcaaccaauaaagggagggaauaucgggggacuugcgcaguggcgaaucagcggagcgcaagagccacggaagcgacgaggaggugggucuuagaagugacugauaagccaauaggugauaaggccaauagauggugaggguaaaugggcguggaucuugaaggucagacgagcucaccaauccgggaggaggggauagaucugccgccucuccccaacgcuggaggggagggaaguaguguggaauuucaaaggaggaagagggauagggugggguucuggaaagguuugccggccuucuugcugggccuuaaaagagaagugagggucggggcuugguggcucaugccuguaaucucagcacuuugggagaccgaggcgggcgggccgcuugagcccaagaguucgagaccagccugggcaacaugaugaaaucccaccucuacaaaaaauacaaaaauuagccgggcgugguggcaugcaucuguggacccaucuacucaggaggcugaagugggaggaucacuuaagcccaggagguugaggcugccgugagcuaugauccugccacugcacuccagccugggcaacagagcgagaccuugucucaaaaaaaaaaaaaaauggaaagaaagaaaggaagaaaagaaagaaagaaagaaagaaaagaggccaggugagguggcucaugccuguaaucccagcacuuugggagaccaaggugggcagaucaccugaggucaggaguucgagacuagccuggccaacacggugaaaccccgucucuacuaaacauauaaaaauuagccgggcaugguggcgcacgucuguaguuccagcuacucuggaggcugaggcaggagaaucgcuugaaucugggaggcggagguuccagugagucgagauugcgccacugcacuccagccugcgcaacagagcgagacucugucucaaaacaaaaaaaaaaagaaaaagagaagugagauuucccucagauaggagggaggauauaggggaggaaaggcaggaggaaaaggcuaagggguggcuaaaaagugggggaaggcaagaagguggcaauacuuggauggagguagcuucugacacuggguuagccaggauggaaagggcaucccacaucuaauucaucaaaaaauccuguggguccuaccuucaaaaaauauauccuucaucuuccacugucaucucucccagaccucuucucaggucuccauuuccauucuguucuacucacagcaucuggagggauucuguuaaauccuaaauuaggccacaguccuccugugucagaacucugcccugucgcaggcugggcgugguagcucacgccuguaauccuagcacuuuaggaaugcuagacuugaacuccugggcucaggugauccucccaccucagccucccaaguagcugagacuauaagugugagcgaccaugcccagcucacuuuauuuuuuccauuucacuuauuauugucacccuauguuauacgagauaauccacucaugcaucauguucgcugugugaagucuaucucugcuucaguauaagcuccacaaagacagggaucuuuguuuugcucaauauaguuuaucacaaauggcuagaacaguaccuguuaagggacuauuuuuuugguuggaggaaggagacuguaaucucuuugguaccuaacccagugggggcaaggucagguauaucuucucagcagaggcagcugggaugaagcuggcuccaggaaagaagaaaagacauaaagccaggacaaaggcauaacagcccaaccccuaucugagggcgccacccaugucagacccccucuccuuucugugucuuuugucucuacaggucagugaagcccaggaggaccuggggggggcaagagcucaggagaaggccugccccccuucccaccccuauacccuaggucuccaccccucaagccaggagacccugucuuugcuguuuauauauauauauauuauauauaaauaucuauuuaucugucugagcccugcccucacuccacuccccucauccacuaggugcccagucuugagugggcccccucucuuaccccgucccuuucccugcaucccuuggccccucucuguuuacccucccuguccccugagguuaaggggaucuaaaaggaggacagggagggaacagaccucggcuguguggggagggugggcgugacuucagacucucuccucucucucccuccacuccucccaacucuggccuugguuccuccagcaaugccugccugaacaaaggccguuagggaaauccaacuccaggguuaaagaaaggcagagauugggggggcuugggguagagaggacaguuuaggacccaagguggucuuggagaggagguguggaguggaggggucagcagggggguuggguuccagacagaguggaucuggagucugaaggagaggagugcgcuagagcauucugggguggggcuuggaagggcgcugagggcaggguucuagaaggggcgaggcuuuaagcgaggcagaauggugggcuccagaguaggugggucuuggauugguaccagagccuauggaaaggguguggcuuggaacauuugggagacugagcuugauucuaaaggggacagaucuugagcaaggcaagaagugggauucaggaaugggccaagccaggguuccagacaggguggggcuuagaauggggcuuccauggugguuucagaaagggcagccccuccccauggugcagugaagaaaauguuuuacaauggcuggguuugggcaguggagaggggacuuggauaggagcuuccagauggguuuuguuaggggugggggagaauggcucuggcuacgacuugggacggaaguggccugagaagagucgagugauauggcuuguagggugaggcgugggauccagagagaagcaccccaccacacacacccuuccccacucccgugaugaaacagcuagguuaauaggaggacagaaccaacgggucugugggacuggcccaccccucuucccccuuccccugcgcccucccucccuccacaccuccacccguccuggggugguuggaggccuggucuggagccccuauccugcacccucugcuaugucugugaugucaguagugccugugaucguguguugccauuuugucuggcuguggccccuccuucuccccuccagaccccuacccuuucccaaacccuucgguauuguucaaagaaccccccuccccaaggaagaacaaauaugauucuccucucccaaauaaacuccuuaaccaccuaguc

SEQ ID NO: 192799 - RNA, 11058 nt, Homo sapiens
gucuucagauacaaggcuuuguuugugcacagugaacaaagggcauauugggaaggccuccuuauauuguccacacuucccugaauguaaggagcccuguccucaaaauggggaucagcagggcuccuuucaagguaaagcagaaaaagucccaguggccugucaagggagaccaggcgcuuuggcuggagcuagguguucuggacaaagggccauauucaagaacuuugggccccauuuucaagcguaggcuuaggagaaagaugaauuccaggaaaucugaagcugaugagauaucugcuuuagcauuguggcacggggaggagauggagggugucugaaauggccagguuauguuguguuacaggcagagacagagccccagugccauucccuggggagcuuuagcccuucucaaaggugcuaccaaggcugguuuauuaugauuggagaaaggaggaggccuccuugacagagugaagugcauaaagcauaggaaauggacuacuggacaugagaaguugggaacauccucccuacgauuaacaaaauacaagccagagaccaggcacgguggcucauuccagugccuauaaucccagcacuuugggaggcugagacgggaagaucgcuugagcccaggagaucaaugcugcugugagcuaugauugcaccacugcacuccagucugggcaacagaggaagaccccaggcucagcauauucucugggguccugcucuaaacugagagugaaagcauacucugcugcuaguugcuagaguucuugcucagaaaguuguucagagauacaguauuucagauuccacagcaucuaaagauuuuuuuuuuuuuuuuugagacagagucuaacucuguccccugggcuggagugcaguggcgcaaucugggcucacagcaaccucugccuccuggguucaagcgauucucuugccucagccuccugaguagcuaggauuauaggcgugcaccaccauaccucgguaauuuuuuguauuuuuauacuuuuaguagagacaggguuucaccuuguuggccaggcugaucuugaacuccugggcucaagcgauccauccaccucagccuccuaaagugcuaggauuacaggcaugcaccacugugcccaagcuuauaguaucuauauuccaagagugagcucacaaucaaaugaguccuuuaacuuguccuguacccugagcagaaaagcaaggcuuaaaagugaaaugguucccaccucagucaacucaguucccaccuuaacucgcagcucaucauaccacuuaugauuucaucuuucuauuaaguacuugaaaugguuuuuauuauacccuaaauuuugguaaauauuggguuuguuucuagcuucccuacugguucacccaucccuuucccuuguccuugucccaggacugcaccagaaguagaggauggaacaaugaucuucccaccuucugaaggcaacuuucucauaugguacagaacugguaccagccugggggaugggaggagucccaugggucagucaucaucugugucacuagggcccauguacuggcagauggcaucguagugaagcuccaccaccugauuuucucuuggcaguugcaccaaagcccggcuccgugcucugucccggcucagcaaaugucccaccuggaacagaggugaaguggaaucagcaaggcaagccuagauccugggacaggcccugaacgacccacaaaccucuacugccaggucugagacucacccuuccagucugugggcccagcaccaccaucacacggucacccucugccuugggaaccagggucuccagcaugucuucccucaggccuauggauaagggagaggggagugaggcccacagcaaggaccagcccaaccagcguccugucagaagggccuuuccuggccaggcgugguggcucacaccuguagucccagcacuuugggaggcuaaguugggaggaucgcuugagcccaggaguucgagaccaaccugggcaagauggucagaccucaucucuacagauuuuuuuguuuuguuuuuugagacugaguuuggcucuuguugcccaggcuggagugcaaugguguggucuuggcucacugcaaccuccgccuccuggguucaaacgauucuccugccucagccuccugaguagcugggauuacaggcacccacuacugcguuuggcuaauuuuguauguuuaguagagaugggguuuugacauguuggucaggcuggucucaaacuccugaccucaggugauccacccuccucggucucccaaagugcugggauuacaggcaugagccaccgcgcccagccuacaaaaaauuuuaaaauuagccaggcaugguggucagugccugcagucccagcuacucaggaggcugaggugagaggauggcuugaaaccaggaauuugagguggcagugauccaugauggugccacugcacuccagcauaggugauaaaaugagacccaaucucagcaugucauaagauacagaagccaaccugaaagaacuccuggucaggugcgguggcucacgccuguaaucccagcacuuugggaggcugaggcaggaggaucacgagguaagggguucaagaccagcuuggccaauauggugaaaaccugucucuauuaaaaauaccaaaauuagcugggugugguagcgggcaccuguaguuccagcuacucaggaggcugaggcagaagaauagcuugaacccgggaggcggagguugcagugagccaagauugagucacugcacuccagccugggugacagagugacucuguuucaaaaaaaaaaaaaaaaaaaaaaagaaaacuugacagacugggagaguggggcucaagauaaccaaccaccaucauggaagugucuaauguucuguaagaggaugcuaggccuugcaaaauaccugaacucugccaaaccucccagcuuugccugggccaggcucugggccuaaaacacucuucuugaucaaccuccagcugccaucgcucaaacucaccuuccaggacucggccuucaucuguccgacauacacagguaucugggcuuaggacaucuucaauuaucaucuggggauacaggucagggggaugugagauuuuagagagguaggggggcccagucccuaggagagggagggggacucaggcugcaggguucccaccuugguguuguaauauuggccuccuuuguacauguuguccacaaaccgcacacgcaggucccugugcaaccagugcugacuucugggggcugcuuucucacucuuggcugcaggcccauccugucuguggagaaggugccagcaccaggcuuagcucuucaucagaugcacuuuccaguugcccucccuuugccuaugcuaugaaacccacccacaaugcaguuccccguuccuucuaugagcccgccuugccuuggaagccuucccuggcugcucgagccuacccacagcccugccuucuugaccccucccgcaugcucagagucccaccggucuggaagguguuuccgcuuccucucugaguuguccugcuggauguagaguucuugauuccagagggucuuccgugaugaggcaguuccguucuguugcccuggggaaggaaguuuugcucaucuggccuguucaagagguuaugaggagaaccaggacagagccucagugucucacugcccuuuccuuccaaggccaugucucagccuagagccaccucccaccugccaaagugccccucucaccccucaugcauuugcuaguagaaugccucucccccaccucucaaccauuucagcuuccuucaggaacccucccgcagccaaccuagcccacaacaacaaugcucaccuaguguggacuagagauucccagagagcucugucuguacccauuugccaaacugccccguccuaccgaaacgccuucgccugugcuguucugucugccuagaauuccuuccuucuuggucacacccuaauccuagcaguucucacucccuaguaaaagagagguucaucaccccaaauggacaaagaucucgaagguaggaauugguuucugcaccuguuucuucucacucagacaggcuacagacccagggguaugacaucgaccuuucuccaaucaaauggaguaagucacuuauguccauucucaccuccugaccucugauuggaagucauaucugccaggcacacugcugccccucccugcugcagaucuaaaaccaccccauuagccaggcccugccaccccuaggaaugcguugccaacuccccuagcucuacaagaggcucacucacugagauccaagguguucuugucaaacuccugcugggagacaggccgcagguaguacucacuaacagucaccacccggcuccccacagccagacgaaccauggcccgaacauugucaggaucaaggccuuccaccuaaaguguugaggggaagaagucagguagggguuguggacuccacccacauuccuaggaccaagaugucaaccccuuaccucuaagaggccugcuuccucugucuccccaaccagacucugaccccugagaagugggaccaggucugguuccugugucucccucagcugacuguggggcuuccuuggauccuuuaagcauuuaaucuucagggacuuguggcauauggcauucucuuccuuuuagcugggaacugaggcucacaaaggccagcaagugguccuggguuacugagugaggcagugggccaagcagaccuaaaagacuaggagucccagccuuucuaccucaaauccaauuauuccuccaucugacccucggaucaaccuucccugcugccuguuuugggcucccgggauaucuugguuccuuaccuucccauagaggccucggugagggccagaaagaaccaccacagcuccuccaggcaccagcccuugaggcugaucuuccuuaucuuucucuugcuccucaucuggucuuggcaugcgggaggggccagugggggucaaggccugggccucggucagguuggcacccagcccuaaccccuugggccucagugaguugacacggggcuucacuacucugcagggaggaauauggguuuguuggagaggaugcaacagucuucaacaccuuauuuacuuccucuuccugcccaaacccgccccacccgccccauugacauuuucuuuucuuuucuuuuuuuuuggagauggaguuuugcucuugucauccaggcuggaguacaauggcucgaucucgacucaaugcaaccuccaccucccagguucaagggauucuccugccucagccucccgaguugcugggguuacaggcgcaugccaccaugcccggcuaauuuuuguauuuuuaguagagacaggguuucaccauguuggucaggccggucuugaacuccugaccucaggugauccguccucuuuggccucccaaagugcugagauuacaggugugagccaccguguccagcccccaccaauauuuucaagguugcccuuucugaucucauauuaggacuguuuuugaccuacagaaacagcaauuucauuugguucaaccuaauaacaugcugcauauaccaucuauuacauaauaucuacagugagaucagaggcagaucgcuguaaccaaauauacuauuucuacaggggaaaucauaugaacauucacaccgagcaggagaaaccggauuauaaauacucaacaugguugggcaugguggcucaugccuguaaucccagcacuuugggagaccgagguugguagaucaccuaaggucaggaguucaagaccagccuggucaacauggggaaaccccaucucuacuaaaaauacaaaaauuaaccaggcaugcuggugcaugccuguaaucccagcuacucaggaggcugaggcaggacaaucacuugaacucaggagguagaggucgcagcgagccgagauugcgccacugcaucccagccugggugacagacagagacuccaucucaaaaaaaaaaaaaaaaaaaaaaaaaaaacgccaauucaggucauauuuggcugccaauggguuaugaaaaaauguuugguuuucagaauuauugaguuugcaauugugaagaaaggguugcaagucugcaugacaauagcaaauguuuagucuacgcuuucuuggggucagggccuacuguaugugcuuuauguauauaauuucuuuuccuuuuccuuuuuuuuuuuuuuuugagacggagucucacugucacccaggcuggaaugcaguggugcaauuucggcucacugcaagcuccgccucccagguucacgccauucuccugccucagccuccugaguagcugggacuacaggcacccgccaccaugcccggcuaauuuuuuguauuuuuuuuuuuaguagagaugggcuuucaccguguuagccaggauggucucgaucuccugaccucgugauccacccaccucagccucccaaagugcugggauuauaugugugagccaccacacccggcccuaauuucuuuucuuaaaauuaauuaaucuuuuguagagauggggccucccuauguugcccaggccagucucaaacuccuggaguuaagugauccuccugccucagucuccgaaagugcugggauuacaggcaugagccacuaccuggccuauguguauaauuucauuuaacucucacaacagaccuaugaagucaguacuauuacccccauuuuucagaugaggaaauugaugucccuagaggcaaacuuuauauaaaugggauucuauuagaguuucaaagggcaaaugggaguuuaaaacaguaguggaaggggcugcugaauuaguuagggcgauaauguauccucccucccugccuaggugguucugguuuggcagugacccuggggaucuugauugcagccugaugaucugucuguccccucgacccuaucccagaacucacugauugaaggugcggccgaugcccucgccagguuuccagcccaugccccgcagcauggccagcccauaggccuccacggggaccgccucauaauuagccuccucuggcaccuacagguucagguagaggaaggagggucaggcuuugcuuacacugggucuucuauuugaagugcacuugcugccccccacugggagaccugcuacgcgucuuuuccaaucagcucaagggugaguuuugauuuccucuuuccaucccucacuguacuccuccauguucaguccuucaacaaauauaaagcaccuugucuauggcaaguacuguucuagguacuggggaugaagcugugaaccaaacagacaaaaaccccuaccccugcagagcuucugaucuaguuguggagacauacuauaaauaaaacccagaaaacaugauaugucagguggugauguaaagaacaagaaaacaggguaagaagaugcagagggauggagagggagugccacuggguugacauuuaagcagagaucaggagaugacagcagagggagccaugaggauaugagaagaaagugucccaagcugaaagcauaguaacagcaaaggcccugaggccggacaaggcuugguaugugugagggguaucaugaaagucaccaugacugaaauggagagagugagaguagacagcagagaaggguggggaagagaccaaaucaggagagcugggcaggagucagaggaccuugagccaggugggagccacaagagggaccagugaggaaauuacucuaauaguccagaugagagaugcugguggcucagcccuuugcagugguauuggugguggugagaaguggucaguucugggugucauuuugaaaaaagaugauaggauugugcuggcauauuguauggggcacgaaauaaagagaggaauugaggaugacuccaagguuuucuuuuuuuuuuuucuugagaugaagucuugcuguguugcccaggcuggagugcaguugcaugaucucagcucacugcaaccucagucuccuggguucaagcgauucuccugccucagccucccgaguagcugugauuacaggcacgugccaccaugcccagcuaauuuuuguauuuuuacuagugaugggguuucgccauguuggccaggcuggucuugaacuccugaccucaggugauccgcuggccucagccucucaaaguguugggauuacaggcgugagccaccgccccuggcugacuccaagguuuuuaugcugagugagaggaaggauggauggaauuuuuggucaccugauauguagaaagcugcaggaggagguuuauagagggaaaaauuagaagaaugaggccaaagcuggaacaggaugaaaggaugaagagggaagugaggaucuuuuuuuucuuuaaagaugaaggagcugggcacaguggcucacgccgguaaucccagcacuuugggaggcugagguggguagaucacuugaggucaggaguucaaggccagccugaccaacguggcgaaaccucgucucuacuaaaaauacaaaaauuagccaggcgguagugacacgugucuguaaucccagcuacuugggaggcugaggcaggagaaucgcuugaucccaggaccgggagguugcagugagccgagaucacaccacuucacuccagccugggcgacagggcaagacucuaucucaaaaaacaaaaaacaaacaaacaaaaaaauguugaaggaaaccagggcacaucugaaggcugaagagaacaguucaguugaaagagagagugguguggggcuguaggagaacuagacucaaaagaagcagugcaagaaauuuaugaaagaagaggugaaaagucaggucuguggguaugaaagacagacuugguuacuucuguagacaugccucucacguccccucuugucaccucccaucaucacuccuucccauucacuccagauacaccacauguugccucacugauggacacaccauaucgauuuucuaccacuaugccauugcuugggcuguuacuacuaacaggaguacucacucuguucuucccucucucacuaaacccuacuuauccuuccagaccacucuggucuaaguccccagcaucucuagccuggacuacucauccccuugcuuccaccuucacuaaugagucuguucacagcuuccagagggauacugucaaaucauaaaucauauuucaucuaugcucagggcuuguccaggcucucaucucacucagaguaaaagccaaaguccucacaauggccuacaaggcccugccuggucuagcacccccaucuccuuucugacuucaucuacuaccccuuccccuuacucauuccacuucagucacacuggucuccuugguguuccgcaaacacuuuaggcagugucuaccuucagggccuuuacauuuccuguucccuuugcugcacaccucauucagauaauccuaggauucaaguacguuuuuagcauccagauacccagauucauuugguaaugcuuccaaaaugaugacagaaggggcagguggcgggccucuagcacacacacagacuuucccugcuacgugcagggacacagccuggcggacagggcaaagaaaggcuggggcaggagggggacaaggggccagcucacugucucugcccgggguucgcugucugccccuuccccgcugggggugcauccuuucuggaucauggggauagcgagcguggggucgacacccgcauucucucucucuuccagagacuucuuggauucuaaaggaagaauaggagggagcaaugaagucccacucuauccuuccaccuucuuccucuucuuccuucaauggggaaggguaaagggguaucacucacccgcaaugagcuccuucacagccugggacaccaccccauccgccaaggccccaguaucuguggauggcccagggggccgggcugguggcugccugcgauggccauucuggaucaaagggaugacgaguuccuugggggccuccuggggcuucacacugauguggacacagaggggugggguugggagaauggcagggucagugggucacacuccuucauucagagaaaacacaagagccaaacucaccccagccccacagaccaugucuucccuacuccaugucuggaucuccuguuccucucugaucgugcauucucuggauuaucuccccagugcccccaacucauaaaugucagugccuucgagaaauaaguccugcacucucuguuuaacucaauaccggcuucuacaauggcccacaaaucacuaucuucagcccagaccuuccccagcuccagguucccaaacagcuuccuagaugccugauucucuucuggaaaucccucccucagaccccucagacacuccucuccucauuaagcugaugguggccuccaucaaccugaaucugccgcuccaucccguuccccauaucggggacgccucagcccuucaguugagacacuagcagguccugucauuuucucauucuuuccuucucccagaacgcacagaccuuagugucuucaaguccuagagacacuucuucucaguaauacauccucucuucgcaauucccacagcuaucaggcccaauuuccucacccccuccuauaaacucccgccuucuggccuccacgaauuuacucaggcuguguuucaggcuuaacaggucacugucaccaagacaaacaacugagauuccucccucccgcuuacgcccaccgcagagauuuccaaggggugaaagacccggcgcgucaccucugcagcucccucccuuccacgguuuucaagaaauccuucuccuccggagauggccccgcgccgucucccgagucggccagccgccuccgugcggacgugcgagugaagccgaaugaaauuggggcaguggaagcagccgucagcggcaaaacacccucuuuggagucagccaucuugcuc

SEQ ID NO: 192800 - RNA, 5473 nt, Homo sapiens
ggaaguagggccugauguaaacacccgagccgggcuccaaggcccgggaggucagaaaaccgggccgcgggcggcaccgacagcuggggcccgggucagggacacgcggaggucaggccggugaaggcggcaggaagcuggagcacgaucccaggguugguugggucugggggaggcuggaagucuuucgaguaggggucuaaggcagaggucuugagugggugcuggcguuggaaggagcaugcggcuggucuugggagaggggcgaggcaucccggacagagucuuggaauggaggugcaaaaaagggguguugaaaguuggagcuguccagagaauaacucuaaggcagagcuguccaaagaaagagcaugaggcauuccaguggaggguguaacugaaagaaaggaaggagauuuggacucuuggaggaugggggagggaguaugucuggccagaguuauuggggaguugaggauuugaagggaaguugggggcucuauggcaguaaucuuaguaggggacugcgcaggcaucuuagggguugagguucuccuagguaggaguuuugggugguuuguuuugggcaagggucuuagaaggcaagggugcccuggggcggggucuuggauaggggucuagagggggaaucuuaggaggaugggggggguuccugggguuggguccaggccagguuauguuguagucaaggacagcagaacacaaggaaggagaugucccagggguggaaaauuuagagugcuagggggaauccuaggguagaguccccagggcauaagccaaucuaagggaaugucuaggcuggcccugaaggguaguuaccaaggcaugagaaggggucaucccaagguaggcauccugaaggaguuuggggaagccgguugagggggaaaggugugagaggacucugggguggucaaauagguugggguacaguuagaaggguaugagcagaggaguuccuggggauggcagaccaagcauagcagucccagggccaagucagggagguacaagaagugcaucuccuagcccacuuuugucuauuuauugagagaguccggugcuaggucagguuugaagaugagaaauggguugggagugguuccaggccaugucuggcauugggaucaagauuggcuggcgguggggaggagauaucacgggggcacccccuaucacauuacuuccugacaagucagugagggccagcauguaaagaggaggugugggguccacgucagugugggccuggagcuugccaaaccugaaagaaggaggguuccuggccauguuguuugggaucuugggagcuuagagcagagacccugggacucucuguuuuuaucuuuuucuuccccccgagacggagucucgcucugucacccaggcuggaaugcaauggcucgauuucggcucacugccaucucagccucucggguucaagcaauucuccugccucagccuccugaguagcugggauuauaggugccccccaccacacccggcuaacuuuuguauuuuuauuagagacgggauuucaccauguuagccaggcugaucucaaacuccugaccucaggugauccacccgccuuggccucccaaagugcugggauuacaggcauaagccaccacgccuggccuguuuuuaucuuuuuugcagucacuccagagucaguaguuagcagaguaggaggaggaaaucaggugaggcagaacuuggaggggagauuccaggacucuucucaucuuuaucccauuuguaugcagaggaacaauccugcaccaugacucaacagccacuucgaggagugaccagccugcguuucaaccaagaccaaagugagagaggauugggccuguacccuugugggaggaagcgaggaaaagaggggucagaagugggccaugggcccccagcuuccuaccugggcauucuuuaaggcagucuggauuccuuccaucccccaggcugcuuuugcugcgccauggagacaggugugcgcaucuacaacguggagcccuugauggagaaggggcaucugggugagcuguuggcaggggaggggcaaugggcagaagagcugggcugggcauuggcucccaccuccacugacacccuggucccuguccagaccacgagcaggugggcagcaugggcuugguggagaugcugcaccgcuccaaccuucuggccuuggugggcggugguaguagucccaaguucucagagaucucagguaagugcccucauccugcccuuuggcccagauuucucggauuccuggccucccacaggcaccccaagguacuggcagaugaagacgucagaguacuucagagucacacagagaggaggccuacagcuuggaagucauggaucuuauagcuugagaagcuuggugcuuuguuuucauuuuaaaaauucugauugagugccuccugugugccaugcccuagagcacuuacugugagccuggaacugcccuaagcacuuuacguuuauuaacucauuuaauccucacaguaacucuaugggguaggaaggaucauuauccccaucuuuaccgaugaggaaacugaggcccagugcaguuaagugacucauccaaggucacacaagcaauagguuuuaaaaucuuggagccgucuucccaauacccccuuggcuugagccucaagugccaucuuacuuuaaggguuuuucuugaugaucccaucuggacaaggcaggaguugcccuaggugagucacagagcccuaggauuccucacggaaaucuccagggugcauggacuaggacccuggaggcagaaauaguuaccgaggggaaguuacaggccugagugugagucccuguuugguugcugaugagcuuugagguccuuggccagacacucaaccacuuugaaccucaguuuccucaucuguagaugaguguaacagucuagaacacuccucucagggaucauauccacaagugcucgugcugugcgaggaucucacugguuguuuauugaaaggcuaagcaaguagguugaggucccugggaagcagggguggauccugugucaccagggcugccccuuacccuaaaccuuggccccgacaacccacccaccugcccagcagugcugaucugggacgaugcccgggagggcaaggacuccaaggagaagcuggugcuggaguucaccuucaccaagccagugcuuucugugcgcaugcgccaugacaagugagccugaggaggaccggggugggagguaggagguccccacaguaagugagagggauaguccucccugggcaucccgccacccccucacggccauccuguguugugugauacccacaggaucgugaucgugcugaagaaccgcaucuauguguacuccuuccccgacaauccccgaaagcuguuugaguuugauacccgggacaaccccaagggugagagggcucagauacacagguguaagggcaugaaacaguggauggggcagaggggcagagaugaggaaagaaaggaaggggcacucacacacagagaaauggggaaagaggcagggagaugcucacacucauagccucuccaucuuuccagcccucagccaguucuccccaccuccggaccugccccaccccuggguaccccaguggcagagcaaaaacaccucgugaggacaugggugggugugucagggaucccugagcuucuggggcugugauagcagcuuacuagauuccacagcugcagagcaaggaauggaaucugccuagcuggcggggcgugcagcugagcugagcccccucaggguucuucggguuaagcuuaucguggaggguugaagucugguccucauccagcucuguccauucugagaugcugccuccucuucagccgcccaccccaccccccaucuucacacccuagggcucugugaccucugccccagccuggagaagcaacugcuaguguucccgggacacaagugugggagucugcaacuuguggugagccguccaguggacaaggguggguagguugguggacuggcuuccuuguggacucuuggccccuucccuccauaccaccccaaccucagacuccucccuccuaccccaggaccuggcgagcacaaagccuggcaccucgucugcuccauucacgaucaaugcacaucagagugacauagccugugugucucuaaaccagccaggcacuguaguggccucagccucccagaaggguacccuuauucgccucuuugacacacaauccaaggagaaacugguggagcugcgccgaggcacugacccugccacccucuacuggugagcacaggguaugcauggugggcuggugaccccauaccacaugacaugugggcaucacugcugaucugucuucuagcauuaacuucagccacgacuccuccuuccucugcgcuuccagugauaaggguacuguccauaucuuugcucucaaggauacccgccucaaccgccgcuccgcgugaguacccccuccccacccuaccgugucccugucccccugcccauuuaccauaccugggcuuagccagugcugccugcaggcuggcucgcgugggcaagguggggccuaugauugggcaguacguggacucucaguggagccuggcgagcuucacugugccugcugagucagcuugcaucugcgccuucggucgcaauacuuccaagaacgucaacucugucauuggugagugggaacagccccuugguuggggguacugcauggggcaaaggccugcagguuggaccugaaaggauuuuagggccaugugaggcucagcuucaucaucaguaagggggacagcacugggcaaaggccuggaggcagacccuagguccugagaugccugagaggacuggagccuguggcuguggcagccucugaccuuuuaccacccccccucccccagccaucugcguagaugggaccuuccacaaauaugucuucacuccugauggaaacugcaacagagaggcuuucgacguguaccuugacaucugugaugaugaugacuuuuaaggacccugggggcugugcuagggaccugcaguggcagaacugcagagcugagccuuggcaguggggcgugcuuggaagccaccagccagcaagcauuaauggggcuggugcccacuuuccacucagcagagcuaugucuaaauaaagagcucacuuccccccagcacuucuugaugacugugugccccaagggccaggccagagacccaggaaggcagcgaccccuugggaucccuaaccuggaggaaauugccagggacccagagggagugcccuaauccaaccuggggauuuuuuaaaagcuuccuaggaagagaugaucuccgaugugaugaauacgaauaaaaggcccuuaauggcauuuacggcu

SEQ ID NO: 192801 - RNA, 4697 nt, Homo sapiens
ugggggagcagagggcagcacuuccuccagcuccaaaagagugcacccaccccaacguuaccaauacacucgugcagguaguggaaggcugucacaccgcccgucucucucgugucgccgcuacgauaccugggcccacacgacucucuucccaaaacaccgaaugagaccuucucucaacgaggccuucacuccccgagccugaaaguaacuggacuacgcucaggaggcaaugaacaaauggcagaaacucgauuggccaaugagagugcguccuuggcgugacaugcgguauagcgacccaaucgcugcccgguaauaggcggaaagcuccgacgccggugugcgucuacgcugggggcguggccugacugcgcggccagacgccagcgccauggaggaguacgcucgggagcccugguacggcaaugggcacaggcauccggaauauugcugcgacgccaaggccagccgugggggucgggcgggggaggcaucggccgcacagagccauguaccagacucgggggacucuuaacguaucucccgcuacccccacucgguuccugucauucgggcuccguuaugaggggccacaaccagagaaggugcggcgaaggccgaaccacgccauguuucuccugacuucguaaucuccuagcccuguuaacgaaaaaagacacgcuggacgauccaucccggcuaggggugguacgguguugaccggaaauccccagaguugccgccagugguuuuucccaggucgccuuugucaguggggggcggggcacggaugaaccuguugagggccggcggggacgguggaugcuucccgcggucgcucuugguuuuucccaguugugccggauugaaaaggggcggggcaugguuggacgggcucaccgucggagaaggggugcgacgcgguccugcuuugcugacagucugucuuggcuaguuaacacgccuaugucgcuuauugaaacgucaacucugcgugugccaauucauuuaaucuuugaucacaguaaaaccguuggcugauuccuugguugguagacagggcgaagacuaauauuucucccccuuugccccauuucucgcuuuaauggggggguguguggaaaaagcgugacagaacuagcucauuauuaucugaaguguuuguuccuacuuaggaacuucccauucuggugacuugguuucucccaguuagaaaagaguucgugugacaggaccugggggagggcucacauuaaccccguccuucccuuccugcuugcagcccauggcgaauuguggaugauugcgguggagccuucacuaugggugucaucgguggcggagucuuccaggccaucaaggguuuccgcaaugccccuguugugaguccaggccuucccuggguuggugugggguuagcuaucuugcccacaagggaggcugcucugaaaacugcuuggagcugccagucacgugcacuuauucauucuggugcccacucaccuacuaugugccgagccuggcuccuguaucugggauuuuguagggauugcaaacauggccucugucuuccacccuccaccccacccaacuggagcuccucuguggaaaugcugugucguucaaagagucaucaccaaauuuuaaauguaugugcaaagccagacaguuuuuuuuuuuuuugagacagucuugcucuguugcccaggcuagagugcaguggcacgcucuuggcucacugcaaccucugccuccuggguucaggcaauucuccugucucagccucccaaguagcugggacuacaggcaugugccaccagaccugacgaauuuuuguaauuuuaguagaaaugggguuucacuauguuggccaggcuggccuugaacucuggaccucaggugauccaccuaccucggccucccaaagugcugggauuacaggcgugugccacugugccuggccauguuuuuuuuuuuuuuuuuuuuuuugagacagcaucuugcccuguugcccaggcuggcgugcaguggccugaucaugggucacuacagccuccgccucccaggcucaagugauccucccaccucagccucccaaguagcugggaccacaggacugcgccaccaugcccggcuaauuauuuauguauguauuuauuuauuuguagagacgggguuucaacguguugcuuaggcuggucucuaauuccugaacucaagugauccacccaccucagccucccaaagugcugggauuacagguguuagccacugcgcauuuuaccuagaggcagauucuggcucagaaacccggauagaggaaaaugacaggaauuuaauuggcagacggaagacagccuugaaguugagagaauucuuuuaacauaauucuuuuucucugaccaccuccccucccagaagaucgcaaaugccaugacuuuaaaugccaucuauuagccaaggucucugcaauuuauauauguagccccgucccuccccuagacuccuggaacucuccucccuggaucuuugcccaaguuugucauccucaaggucucagcacagauucccccuccuucaagaggccuuuccugaccccucagccccagucauauuucuucauggcauuuccucuacagugcagauugcugucugaagcucccuuguuuaucuacucuugcucaagaucugugucucccaccguuaaugugagcucugagagggcagagagcagaccuaccuuguucauggcuguaucccugcauauggcauggugcuuggcacauauaguagguacuuguuaaucauucacugaaugaaugaaugaacaaauguaugaaugaauuagcacuucucaaccuagcucugagaacacccauguuggggcgcucuccaggccacuaguucuuggccacuucuccacaucucuacagcucauaccucuaacaggucucccaucuucuucccucucuuaaaaguuggaaacgugucugccaguggcuucagcccugcccuaacgcccuuccuuccuuuccccagggaauucggcaccgguugagagguagugccaaugcugugaggauccgagccccccagauuggaggugagggacuuggggagauagauauaggagaugucuuggcaaaggugggagugguugauccuuugggucuaggcugcaaguuagggguucagauucuagccccugccagagacuuucuaggggggugauguuucccaacaauugaauauggaggggaagaaaguggguucuggaguuuaaaucuagguccugacuguucccugccaugugaccuugggcuaguggcuuaaccucucugaaccucacuuguaccguggggguggugauaacaguaaccauuucaucgguaguuuuauaguuuauguaauuuacauacuacuaagugcugguugcuaugcuaaacacuuuaauaacauuaacuaauuuaaaauugcagaagucaaauaacagagcaccucgaacagguccuggcacacaguaagcccucaguaaacauuuuaacuaucauauuaacuggguuuccuaaccuauuuccuucucacugaaacccaaaucagaauuccaacucuguguggugauuaugaagcucaaaguugcucuguuaaaagccauaugaagauaaaucugcuuguaaacauuugucaacuccccauaaagaugaagggaauguugauggugauuauagacggcuugaagugggagcuaccacaggauggggacagauaggaaauacucuguguggguuugcuaucugccuuugugucuggguuuuucucccuguucuuggccaaagcauucaggccuuggaaguccccugagaugugaauucucaggauuucccaggaacuaauuaggccucgguuccacuacagguagcuucgcagugugggggggccuguucuccaccauugacuguggccuggugcggcuucggggcaaggaggaucccuggaacucuaucaccaguggagcauugaccggggcugugcuggcugcccgcagugagugaccccuggcccuggccccagccccuuccacccuguucugccugcucucaccucuguuucucugccuccaacucccccagguggcccacuggccauggugggcucagcaaugauggggggcauccuguuggcccucauugagggcguuggcauccuccucacucgcuacacagcccagcaguuccgaaauggugaguaacugguggucgggggagugggaaauacuccaccuggccucuuccacucauccuuacccaagucucccuucuccagcgcccccauuccuggaggaccccagccagcugcccccuaaggauggcaccccggccccaggcuaccccagcuaucagcaguaccacugaggaagccacugccaccaugggagcuacuucucgguucccuccccgauggucuaccucgaagggagggcuggcucccaguuagcccugggacccuccagagaggguuucuacucugcucccuagucccaggguggggguggggcaccccagcugcccugacagauggguccccuuuuucucucucagggcaccccagccccacacucacauguacgaaguucucaccccagcuccuuuguguggcacccugaugaguauuuaaagcccguuuugaaaugccua

SEQ ID NO: 192802 - RNA, 7736 nt, Homo sapiens
uucaggacuuuggugguuuuauuuuacaaaagcuuugaagguucaagccagggggugccuggggcccagagacuuggguuguccagaauucuggcuacaagaggagaaggacaccaccccuccucuggaggccaugcucugugcccucaugagcugagcggagccaccacaguagugcuggugguggggggcauggggccuguggggaaggagcccgugggugagcccaguagggguccagggaaaggcaugagguggcuaacaggcccugacagcaccacagggcccaggccuugguagagaugggcaguaccuggggggcccagugucaggccugaagccaccuccccacaauucccgcuaccgcugcccccagccaccaccauaaagccaccagcugguccuucggcugcuccugugccucccagacuggagccccguuucuuuuucccuuuuccagaugccuugcgguuucgagucugaauaccauccuuccgcauggucaguggccgguucaccugccaaaaaggaggcugcggguguccccaacuccagaccuuugccucucugugucaaccagggacacccucucuaccccacuucuuucaggguaagauaauuuuugggugcugagauuguccaaggaauccugaggcugugaggcccugagcuuaggaaagccuccaaggcugauaggagcugcccaaggucuagggcaggggguuggacauuagcugaugccuggaggugggggagaggagaggaaggaggagggcggaggaggagggaauggagaaggaaggagggaggguaauaacagagaagggggaaaguagaagagauggaggaagggggaaaguagaagagaugggggaagggggaggaaggagggaaaggggaaagaggaaagaggguugugggggaagagagagguagaacaggaacagaguggggggcaguguggcaugaagacagggaaagcagagggguggcuccaaggggcagggcgucaccugguguagcuuguaguagaggccgcaggcauugcacacgggauccccacuggcauuucuccgccacagugucgugguggucgucuggcaguuggugcacugaguaccugcccguuuacugacaaucuaggggacgacaggaugugagaucagugcccuggggauguggaaguggggguaaggggcucacaggggaugucaggaggacccaagaagugagggucagguugaaggcagggcuuuguuuacagggugaugccugaggauucuguauggggccaguacagggguuccuaucugguauaaguuucuuuuguucuguauucuaugggggacuacauuggugguucucagcuuuggcugcguaucggaaucacuuggggagcuaaaauauccugaugcccaagcagcaucccaguccaauuccaucagcacaucugggagaagggaccuggggugauuccagugugaagccaaggacgaaaacacuggugugcagggugaggacaaagguuucuguuugaagcuuauaaggguagguugaggauaggagcuucuauagaucuggguuccuguacaaggaaagggcaggaguucucaugcagggugagggcaaggauuuccauaugggaugaggagauuuuccuguguaggaugaaggcaaggguuuccaugugauauugggacagggguucccauacaggguggccugcaguagcuuccuguaaucaugagaacagcguuccuauauaaugggaagauguggcuucuuguacagggugaggacagggguuccuguguauaaggugaagcaggucuguggucuuaccaggcgcuucuugggccggaugaggggccuguucugcccauucaucuugugauagaggccgcaggcguugcauagguaguggccuguccugucccuccgccacaguggaguggcuguugcuccgcaguucacacacucccuggccucuggugggguggagaggagaagagggagcuaggcucagcucagcuuuacuuugggccaccccucccaccucaacuucccuguccuuuuuugaauuucucaccacagggaggcagggggagaguuccacgaagcuugggagaggaauaggcugcugaauugagggggcucccggugggagaaaagaagguacuggaaaagucagggcccccauaagcacuauuggggacagggagugaugaaggcagugcaggucccagggucaggaggucugggcucagccgcucugucuucaaagucuccaggaagcuggugcugccuuuuccauccagaucuuccacggccuggggaggagaguccucgcgggugggacacacaguugaggcaggguagagccccgucuugccguaggcccagccggcauauggugagcccccugggauccccuccauacaguugagcaauggguacaccugaaagacuguugggggcagguagggauggaggaaagaagaggcaaaaucagucuagggucagcgcacgucagggugcagugguucccagcacccccaacaugguggccaaguucccagcuuuuccacaggcuaccagaacagcugcuggccauuggaugcuuccuggauccugacccccacuggucaguguggccucugcaauaaccucugaccauuuccaaguggguuuuugaggaugacuguugggauuuggagcuccacggaucacucgacaacuagggcaaccaccacauacuuccaguauugccucucaguguggccgccccaauauggcagguugaggagcauuggaauucccaggucugcacuuaacuagggaaaguggucggcacauccauuugagaagcuuccagccauuucugagauauccucacagugguauucugaccuagccaaggaucuccauggcaaccccaacagcacucagccaaugccaagacagccacucaauggaguuaccuggggagugucuguaggccucagcgucccuguaguaggccagugccgcagcugcagcgguggcugugcucggggcaguggaggaagcugcugcauccaagcccucaggcccagaggggaagaaaaccccugauucugguguggaggacaccagagcaggauccacaaacugggggaggggcucugagguccccagggaccccaggccagggaacuccauggagccucuggggauuaaccugcgaggacagaagggguccucagacacagaaauccuuccaccccacauccuuucaccugcuccucuuccuccuuucccccuccucccacuccaucaccucagucuccauauuucuccuucccaccuccccauuccccccuccuccucaccuuagucuccccucuccuuccccuccuucucuuccucccucuccucucuuuucccuccugcaucuccccguuccacuccugugugccccuccuuucaucuuccuccucguucucccccucuugccguuugucuuuccucuccucccuccucucgcucuuccuccacucucaucugcuucuaccucucccuucuuccuuccauucucucucuucuuccccccuucccuuuuccuccugucuuucucccgucucucuucuucccaucucuucuuugccccccucuuccccauuuccuucucuuuccacucuuuucucauucucuccugcuuccuuuuucuccuccaccuucuucuuuuccuccuugaccuccuccuucuccuuuccuguuuccccucuuccuuguccuccuucucuuuuugucuucauucuccuuuucuaccuuucucacacaccuuaucucccucucccccauccacacacacuuuuuuuugaggcagggucuccucuguugccaggcuggagugcaguggcacgaucucggcucacugcaaccacugccucccggcagugauccuccugccucagccuccugaguagcugggacuacaggugugugccaccaggccuggcuaguuuuuguuuuuuuuuuguagaaaugggguaugacucuguugcccaggcuggucuugaacuccuggccucaagugauccucccaccucagccucccaaaguacugggauuacaggugugagccaccacuuccggccucucuuccccugucuacaucuacucuccacuccuuucuccuacuacucauuuucuccuccccuccaauuucuucauccuucuccucccuuuucuguucauccuuuucucccuuuccccaucuccucuccuccccuccuccacuuccucuuauucuccccguccccccguccuuucuucccucccccucuagaagagucugggugagggugggauggcaugcaggaccagagucccuugccucuuggucacuucacccaggacuuugggguucaccauccucugcuccccaacuucaucccuaucuguuguaucuugcccucuaacuuucucagaaaccccaugguuuccgggcuugacucccuccucccuccaccucuguugcgucuacagacagaaggcccccuuaguuccucccuacuucuugguugggggggggucaguaccccccacugcuuaucucugccuuccccgcccaacuuuugaaaucaccccaaggccacugacuuccucugaagaggguggcaggugggagguaccucuaccgguacccucuccccuggagaggcccaccagaguucugcuuucaggcucuuucaguucccaggccucaguuuccccaucugcuguauuggggguggugaugggcuggggcugagcugagaccugugggauggcccuuugccuguuuugccuugugugugucugucaucuagcucuccacuucucuauccccuggggcucuuuccccugacucucuguucccucucaagucugacucuguagcuuccccagcuuucuguguuucuaugauauagcuugucuucuccuucugugcuuuuucuuuuucuuuuuuuuuuuuuuuugagacggagucucacucugucacccaggcuggugugcaguggugcgaucucagcucacugcaaccccagccucccagguucaagugauucucgugccucagccucccuaguagcugggauuacaggcacaugccaccacacccagcuaauuuuuguauuuuuaguaaagacgagguuuugccauguuggccaggcuggucuugaacuccugaccucaagugaucggcccaccucggccucccacagugcugagguuauaggcgugagccacugcgcccgaccucuuucugugcuuuuguaauguuugaugauuuucugucuucuuuucugucuucccauguuucucucucuggcucucucuuucuguuacucuugcuuucucccucuccucuccuaucucucugaacaucucugcaucucucccacucuuccugcuuguuugucuguucccucuguuucccucucuuugggcccucugaccuuauguccacgugccucuuacuagucccauaccccugaccguacccagccacaugcagcucaggauaaggagccuggaaugcuggcccuggcccuauugugcuggccugcucuguuucugugucuguaggguggagugacagggcuagacuagaaggcugucuucaaacugccccucacuccugcuuacaugacccaugguauagacaggcuaaggggcaggcccaggcuugggaguuaugcuaggaaagagaugggccacaagugugcccaccgccaacaccuucucagccccagggugccugcuguugcucucugaagagaguguuuugcuuccccaucuuggucuccaucucuuuccucucugucucuaauucuguguuagucucugccucuucacagugcuaccugcguguaucucugcauuucuaucuccuuuucugcucccgggucuuuccuucuuuuucuccggccaucugucugucucugucucuuacucguugaguuucucucucucuguuuuuccuuucucuucaugucucuuuugucucuugcucuuugucucugugucucugucucucucuucccaucucucccuguuucucccucucuucccugucucauugugugucuucugcucacucuuucaccacuauucccucauccccucaacuccaccuuacccaccaugaucucccuccagccccacugcccccaaccccugcaccucacacguuggugaguccagggcugcccaccccucccauggcaggggcccagccuccucacccccaguuaucacucuccggacagagauaaaguuuaucucgaggcugggggauaugaaagcuccuuaucagcugccccacuagaguaaguguugccccaacggcggcagcaggcagcagcuggcacccuccacucucccucggccccagccccucaccccagguaacguuccaaucccagcccucaagggagggucucaccgggcugaagggagcagauauaaggucuagggggcagauauggggcuuagggggagauagagguggaauuugaaggucagauaugggguuaagucagagagguuugggguguagccauggaguuuguggggaggcagauaugggcgggguuguggagcagagacgagcuuggaaguucagagacacauuuugggcucaggaauagguugugaaaacagacgagguugggggaucggggcgaaguuugagagucagaaauaaaguugagaaguagugugggagucagauucugagggucauagaaaagucuggggaguucaaggguuuuucuggaggagagauggaguuuaggagucaaagaucuguuugggcagacagaauguggcuaguaaaggggaguuugagaagccaagauagaauuggaguagagaaaggcuuggagcuggagagauucagggagacaaugagauguguuuuagggcugagauacgguuuggggaaggcagacaugaggguucaugcggcagaacagauuuuggggaguugacuugguguuugaagugacaaagauauuuuacugagcaggcagggaguugggagagauaaaugguuugcggagaucagagagaagucauugggaacaaagaguggguuugaaaggcagagauggugguaagaggauggagcuaggguuuggcagaucagagacagguuugggggcucagagagaguggggcaaagacaaggcguuguagagcagauaagggguuugggagcagaaaagugagguuuggaggagaagucagggagacagagacaaguuugggugaguggaaaucagauaugggacagggaaaggauuuggggagauaaagucauguuuugggagacagaguuaguguuuaggggagacagaccuagggguauagcgagcaaagugaagggauccagaggauauagauaucuuggacggaguggaugagagggcagaaagaggugggguuuaggggguagauuugggguagaaaugggaguuggaaagacagguggguuggaggagcuguaaagggauucagggcuggcugacacuuuggggaccagcuguggguuggggagccuggagcaagcauaaggguaggggcagcaggcccaggguugccuuggugggggcucucugggggcugagacugaccugggcuggugguugcggaggguucggccgccuuggggauguggcaagcucagugugaucccaggggguguc

SEQ ID NO: 192803 - RNA, 7736 nt, Homo sapiens
gacacccccugggaucacacugagcuugccacauccccaaggcggccgaacccuccgcaaccaccagcccaggucagucucagcccccagagagcccccaccaaggcaacccugggccugcugccccuacccuuaugcuugcuccaggcuccccaacccacagcugguccccaaagugucagccagcccugaaucccuuuacagcuccuccaacccaccugucuuuccaacucccauuucuaccccaaaucuacccccuaaaccccaccucuuucugcccucucauccacuccguccaagauaucuauauccucuggaucccuucacuuugcucgcuauaccccuaggucugucuccccuaaacacuaacucugucucccaaaacaugacuuuaucuccccaaauccuuucccugucccauaucugauuuccacucacccaaacuugucucugucucccugacuucuccuccaaaccucacuuuucugcucccaaaccccuuaucugcucuacaacgccuugucuuugccccacucucucugagcccccaaaccugucucugaucugccaaacccuagcuccauccucuuaccaccaucucugccuuucaaacccacucuuuguucccaaugacuucucucugaucuccgcaaaccauuuaucucucccaacucccugccugcucaguaaaauaucuuugucacuucaaacaccaagucaacuccccaaaaucuguucugccgcaugaacccucaugucugccuuccccaaaccguaucucagcccuaaaacacaucucauugucucccugaaucucuccagcuccaagccuuucucuacuccaauucuaucuuggcuucucaaacuccccuuuacuagccacauucugucugcccaaacagaucuuugacuccuaaacuccaucucuccuccagaaaaacccuugaacuccccagacuuuucuaugacccucagaaucugacucccacacuacuucucaacuuuauuucugacucucaaacuucgccccgaucccccaaccucgucuguuuucacaaccuauuccugagcccaaaaugugucucugaacuuccaagcucgucucugcuccacaaccccgcccauaucugccuccccacaaacuccauggcuacaccccaaaccucucugacuuaaccccauaucugaccuucaaauuccaccucuaucucccccuaagccccauaucugcccccuagaccuuauaucugcucccuucagcccggugagacccucccuugagggcugggauuggaacguuaccuggggugaggggcuggggccgagggagaguggagggugccagcugcugccugcugccgccguuggggcaacacuuacucuaguggggcagcugauaaggagcuuucauaucccccagccucgagauaaacuuuaucucuguccggagagugauaacugggggugaggaggcugggccccugccaugggaggggugggcagcccuggacucaccaacgugugaggugcagggguugggggcaguggggcuggagggagaucaugguggguaagguggaguugaggggaugagggaauaguggugaaagagugagcagaagacacacaaugagacagggaagagagggagaaacagggagagaugggaagagagagacagagacacagagacaaagagcaagagacaaaagagacaugaagagaaaggaaaaacagagagagagaaacucaacgaguaagagacagagacagacagauggccggagaaaaagaaggaaagacccgggagcagaaaaggagauagaaaugcagagauacacgcagguagcacugugaagaggcagagacuaacacagaauuagagacagagaggaaagagauggagaccaagauggggaagcaaaacacucucuucagagagcaacagcaggcacccuggggcugagaagguguuggcggugggcacacuuguggcccaucucuuuccuagcauaacucccaagccugggccugccccuuagccugucuauaccaugggucauguaagcaggagugaggggcaguuugaagacagccuucuagucuagcccugucacuccacccuacagacacagaaacagagcaggccagcacaauagggccagggccagcauuccaggcuccuuauccugagcugcauguggcuggguacggucagggguaugggacuaguaagaggcacguggacauaaggucagagggcccaaagagagggaaacagagggaacagacaaacaagcaggaagagugggagagaugcagagauguucagagagauaggagaggagagggagaaagcaagaguaacagaaagagagagccagagagagaaacaugggaagacagaaaagaagacagaaaaucaucaaacauuacaaaagcacagaaagaggucgggcgcaguggcucacgccuauaaccucagcacugugggaggccgaggugggccgaucacuugaggucaggaguucaagaccagccuggccaacauggcaaaaccucgucuuuacuaaaaauacaaaaauuagcugggugugguggcaugugccuguaaucccagcuacuagggaggcugaggcacgagaaucacuugaaccugggaggcugggguugcagugagcugagaucgcaccacugcacaccagccugggugacagagugagacuccgucucaaaaaaaaaaaaaaaagaaaaagaaaaagcacagaaggagaagacaagcuauaucauagaaacacagaaagcuggggaagcuacagagucagacuugagagggaacagagagucaggggaaagagccccaggggauagagaaguggagagcuagaugacagacacacacaaggcaaaacaggcaaagggccaucccacaggucucagcucagccccagcccaucaccacccccaauacagcagauggggaaacugaggccugggaacugaaagagccugaaagcagaacucuggugggccucuccaggggagaggguaccgguagagguaccucccaccugccacccucuucagaggaagucaguggccuuggggugauuucaaaaguugggcggggaaggcagagauaagcagugggggguacugacccccccccaaccaagaaguagggaggaacuaagggggccuucugucuguagacgcaacagagguggagggaggagggagucaagcccggaaaccaugggguuucugagaaaguuagagggcaagauacaacagauagggaugaaguuggggagcagaggauggugaaccccaaaguccugggugaagugaccaagaggcaagggacucugguccugcaugccaucccacccucacccagacucuucuagagggggagggaagaaaggacggggggacggggagaauaagaggaaguggaggaggggaggagaggagauggggaaagggagaaaaggaugaacagaaaagggaggagaaggaugaagaaauuggaggggaggagaaaaugaguaguaggagaaaggaguggagaguagauguagacaggggaagagaggccggaagugguggcucacaccuguaaucccaguacuuugggaggcugaggugggaggaucacuugaggccaggaguucaagaccagccugggcaacagagucauaccccauuucuacaaaaaaaaaacaaaaacuagccaggccugguggcacacaccuguagucccagcuacucaggaggcugaggcaggaggaucacugccgggaggcagugguugcagugagccgagaucgugccacugcacuccagccuggcaacagaggagacccugccucaaaaaaaaguguguguggaugggggagagggagauaaggugugugagaaagguagaaaaggagaaugaagacaaaaagagaaggaggacaaggaagaggggaaacaggaaaggagaaggaggaggucaaggaggaaaagaagaagguggaggagaaaaaggaagcaggagagaaugagaaaagaguggaaagagaaggaaauggggaagaggggggcaaagaagagaugggaagaagagagacgggagaaagacaggaggaaaagggaaggggggaagaagagagagaauggaaggaagaagggagagguagaagcagaugagaguggaggaagagcgagaggagggaggagaggaaagacaaacggcaagagggggagaacgaggaggaagaugaaaggaggggcacacaggaguggaacggggagaugcaggagggaaaagagaggagagggaggaagagaaggaggggaaggagaggggagacuaaggugaggaggaggggggaauggggaggugggaaggagaaauauggagacugaggugauggagugggaggagggggaaaggaggaagaggagcaggugaaaggaugugggguggaaggauuucugugucugaggaccccuucuguccucgcagguuaauccccagaggcuccauggaguucccuggccuggggucccuggggaccucagagccccucccccaguuuguggauccugcucugguguccuccacaccagaaucagggguuuucuuccccucugggccugagggcuuggaugcagcagcuuccuccacugccccgagcacagccaccgcugcagcugcggcacuggccuacuacagggacgcugaggccuacagacacuccccagguaacuccauugaguggcugucuuggcauuggcugagugcuguugggguugccauggagauccuuggcuaggucagaauaccacugugaggauaucucagaaauggcuggaagcuucucaaauggaugugccgaccacuuucccuaguuaagugcagaccugggaauuccaaugcuccucaaccugccauauuggggcggccacacugagaggcaauacuggaaguauguggugguugcccuaguugucgagugauccguggagcuccaaaucccaacagucauccucaaaaacccacuuggaaauggucagagguuauugcagaggccacacugaccagugggggucaggauccaggaagcauccaauggccagcagcuguucugguagccuguggaaaagcugggaacuuggccaccauguugggggugcugggaaccacugcacccugacgugcgcugacccuagacugauuuugccucuucuuuccuccaucccuaccugcccccaacagucuuucagguguacccauugcucaacuguauggaggggaucccagggggcucaccauaugccggcugggccuacggcaagacggggcucuacccugccucaacugugugucccacccgcgaggacucuccuccccaggccguggaagaucuggauggaaaaggcagcaccagcuuccuggagacuuugaagacagagcggcugagcccagaccuccugacccugggaccugcacugccuucaucacucccuguccccaauagugcuuaugggggcccugacuuuuccaguaccuucuuuucucccaccgggagcccccucaauucagcagccuauuccucucccaagcuucguggaacucucccccugccucccuguggugagaaauucaaaaaaggacagggaaguugaggugggagggguggcccaaaguaaagcugagcugagccuagcucccucuucuccucuccaccccaccagaggccagggagugugugaacugcggagcaacagccacuccacuguggcggagggacaggacaggccacuaccuaugcaacgccugcggccucuaucacaagaugaaugggcagaacaggccccucauccggcccaagaagcgccugguaagaccacagaccugcuucaccuuauacacaggaaccccuguccucacccuguacaagaagccacaucuucccauuauauaggaacgcuguucucaugauuacaggaagcuacugcaggccacccuguaugggaaccccugucccaauaucacauggaaacccuugccuucauccuacacaggaaaaucuccucaucccauauggaaauccuugcccucacccugcaugagaacuccugcccuuuccuuguacaggaacccagaucuauagaagcuccuauccucaaccuacccuuauaagcuucaaacagaaaccuuuguccucacccugcacaccaguguuuucguccuuggcuucacacuggaaucaccccaggucccuucucccagaugugcugauggaauuggacugggaugcugcuugggcaucaggauauuuuagcuccccaagugauuccgauacgcagccaaagcugagaaccaccaauguagucccccauagaauacagaacaaaagaaacuuauaccagauaggaaccccuguacuggccccauacagaauccucaggcaucacccuguaaacaaagcccugccuucaaccugacccucacuucuuggguccuccugacauccccugugagccccuuacccccacuuccacauccccagggcacugaucucacauccugucguccccuagauugucaguaaacgggcagguacucagugcaccaacugccagacgaccaccacgacacuguggcggagaaaugccaguggggaucccgugugcaaugccugcggccucuacuacaagcuacaccaggugacgcccugccccuuggagccaccccucugcuuucccugucuucaugccacacugccccccacucuguuccuguucuaccucucucuucccccacaacccucuuuccucuuuccccuuucccuccuuccucccccuucccccaucucuucuacuuucccccuuccuccaucucuucuacuuucccccuucucuguuauuacccucccuccuuccuucuccauucccuccuccuccgcccuccuccuuccucuccucucccccaccuccaggcaucagcuaauguccaacccccugcccuagaccuugggcagcuccuaucagccuuggaggcuuuccuaagcucagggccucacagccucaggauuccuuggacaaucucagcacccaaaaauuaucuuacccugaaagaagugggguagagagggugucccugguugacacagagaggcaaaggucuggaguuggggacacccgcagccuccuuuuuggcaggugaaccggccacugaccaugcggaaggaugguauucagacucgaaaccgcaaggcaucuggaaaagggaaaaagaaacggggcuccagucugggaggcacaggagcagccgaaggaccagcugguggcuuuauggugguggcugggggcagcgguagcgggaauuguggggagguggcuucaggccugacacugggccccccagguacugcccaucucuaccaaggccugggcccuguggugcugucagggccuguuagccaccucaugccuuucccuggaccccuacugggcucacccacgggcuccuuccccacaggccccaugccccccaccaccagcacuacugugguggcuccgcucagcucaugagggcacagagcauggccuccagaggaggggugguguccuucuccucuuguagccagaauucuggacaacccaagucucugggccccaggcacccccuggcuugaaccuucaaagcuuuuguaaaauaaaaccaccaaaguccugaa

SEQ ID NO: 192804 - RNA, 11911 nt, Homo sapiens
ggauugucgggaggacccugggcaaagacgccuacccugccaugcugcgccaucugcccuccaggcugccagucaagauguggggcaggacuuuggagaaacaggugaacaagauggccccuggggaucuggggcaaggguguuggcacugaaacuggucuaguaaccuguuucccuucucugcgggcucccauuuccuguccuccucucucccuuucucuuucagagacaagcagagggcagcagaggcccauggaaaggcccggcucuaagccauggagggcccugugcucaggugugcagggcugggccggggcugagggcuggcuccucccccaguuuagccagggacagguggagagauacaaagguggcucacgcagggugcccccaaagcugucaugauuaaggccauguggagagaggcuaggaaacacagcgcugaccuugagcuuuaggagaggaauucagaggccccuggcaaccugaaggggaccuugaagaggacccuguaggaagacagaacacuucccuguagaggaggccaaaggaggaaggacaugguguuccgggcacucugacuauagggauuuuauaugcuguggugagaaauaaaauggauuauauuuuuguagaguguguaaaacggggcuuggcacacaguaagccuugugugauuacuaugucuuuuuuuuuuuuuuuuuuugagaccgagguuugcucuugucgcccaggguggagugcaguggugcaaucucaggucacugcaaccucugccucccagguucaagcgauucuccugccucagccucccgaguaggggauuacaggugcacgucaccaugcccagcuaauuuuuguauuuuuaauagagacaggauuucaccauguaggccaggcuggucucaaacuccugaccucauguaauccacccaccuuggccucccaaagugcuaggauuacagacgugagccacugcacccaguccuuugugugaugacuaugucuugaucaucauuuuauaaagcaggcuuuguaacuucaccuccaagagucugcaggauccagacccugccuugcccucccacuuaucucucacucacucuuggguucugagcuacgcuggccuuccuguuauugaagacagccaucccugcucguccuugaauuugcaaggauggagcuccgagucugcaaagcaggaucuggggagugaaucuaagcuggcagggaagaauagaauaaugggaggaauagguggaguuuauuucuaacagacuaucaaaaugaugcagauguggccaaagcagugcuuagaggaaaucuauaguucuaaaugcacagaucagaaaaguagaaaaguugaaaaucaaugaccugagcuucccuaucaagaaacugggaaaagaauggcaaguggaaccuaagaaaguagaaggaaggaaauuauaacagcagaaacuggugaaauagaaagcaaagauacaauaaagccaacaauguuaaaaguugauucuuugaacagauuaauaaaauacuagcaaugucuauuuucucucgagaaauuaagaaaauauauggauugccaauaucaggaauauaaacaggguauugugacagauucuacagauguuagaagguuaauaagggcugggugcaguggcucaugccuguaaccccaacacucugggaggcugaggagggaggauugcuugagcccaggaauucaagaccagccugggaaacauagugagcccucaccucuacaaaaaaaaagaaaaaagaaaacaaaaaauaguugggcaugguggcacacaccuguaaucccagcuacuagggaggcugaaguaggaggauugcuugaguccaggagguugaggcugcagugagcugugaucaugccaccaugcuccaggcugggcaacaaagcaagacccugucucaaaaagggaauuaaaaaagaaaguuaauaaaauuuauuucaacauaugacuuuauuuucaauggagccaaaaugucggucauuuucucuuucugcaguuccuauguccauguggaucuuuuguauccaccgggagagcaaaacucagcaacuuugcuaaugccuccuccacucaggaaaauagaaugguacaggauuuuuuuuagcuggagcucagugaaaucaauuguuuaaaaugggcugguuucaauggaacuaaacgcaguggaauagaaaauaauaaaauagcaaaggguagaacagaauagaauggaauccaauggaaucgaaucgaacagaauagaaacuagucagacuuugugccaagcacugucccuaguuguugcaguagauauuuauuuauugaacaaauaugauugaacuaguuguuugggaaagaguggggaacaaaacagacagaagucccugcucuuaugaagcuuacauucuagucagggagacaggcauuaccaucugcaaaggcccauaaaugaaagguacaagggugguccuuaugaggaacaggcuaaaggacaguguagauuggaguucaagagcaauggaugaggcuguagagauagggugucauuguaacuggagucuagauuuuaacaagaugaccacacaucaucaucaucaucaaucguuuuauagcacuugauauguauuaggcauuguucuaugcccuuaaaaacaguacuuuuuuaaaacucucacaauaauccuacauguauaaaaucaugcucauuuuauagaaggggaaaccaaggcacagauaaauuagauaaauuauuuaaacgucaaucugguuccagaaucuucuuuuuuuuuuuuuuuuuuagauacagucuugcucugucacccaggaguccgguugagugaucauagcucauugcaaccuccgccucccaggcucaagugauccucccaccccaggcccccaaguaaccagaacuacacgugagcgccccacaaccuaauuuucauauuuuuuuguagauacagggucucacuguguugccuaggcugaucucaaacuccuagguucaagggaucugucugccucagccuuccaaagugcugagauuacaggugccaccacuagaaucuauucuuuuaagcauuauacuccauugccuauagugccagaccacaggugcuuuauaauccuguagcauagauacuauaaauauucaaauuacuaaauaauucaagucaagagaaagaucugaugggaagugugcugagggcgggaaaguggaagguuggggagugguccucccucugggugucaagguggaucuguaaacacgcacgcccagaaaccuucauuucuucugagaugcccccuucuugucuuguucucugugacugaagcugcagaaugggaaaggagggggcuggguaaaauuggccaauucacaggacugggccuccucugugucuugucacuucuuggaaaagagaugaauucuauuuagggaaaaacaggggagggcauugucuuggucuccacuccccuaaucuucacuucuggaagaggagaaagggaacaagaaggcugggugcaguggcucaccccuguaaucccagcacucugggaggccgagguaggcagaucacuugaggucaggaguuugaguuuaagaccagccugaccaacauagugaaaccccgucucuacuaaaaauacaaaaauuagcugggcguggugacacacaccuguaguaccagcuacucagggggcugaagcaggagaaucgcuugaagcugggaggcggagguugcagugaggugagauugugccacugcacuccagccugggcaacagagugagacucugucucaaaaaaaaaaaaaaaaaaaaaaaaaagaaaaggaaacaaggaaacaguggaaaguggucaugguagacaugugggcucucaugaauccacacaugggcaguaagacucuaccaguaaguauucucucaggccuuuccccuugaaggggggugaggaggaaguaguguaauuggggagguagggggaggugaggagaagaaaacacaggcguugacaaguggcaauguggucucuucugacuuuuuuuucuuuuuuuagucauggagggacagcagucagaccccucccccaugucuuauccguagacuugaccacaucgugaugacggugaagagcaucaaagacaccaccauguuuuauuccaagauccugggcauggaggucaugacuuuuaagguaagcacuuccccaaaugccaaaauucaggugggcuaaaauuuguugauaacacuuuaacauauaacuuaacucuaaaaggaaaaccacaggaaaucugagagaaaauauaaagagaucaauagaggagauuccaaacugaauauuuggacuuccagagagagaauggagaaaaaagagaggaggaaauuaucauagaaacaaugcaagauaacuuugcagucucuacauggaaaagguuaaccaaguauccagcauguugacacuuaacauggauccuucuaaaauuauagaacaucaaacugaaaaaguagauccuaagagcuuucauagagauuaaaaaguagauuaucuacaaaggaaaaaaaaacaaauaucagauuuuccaagagaccagagaccaaaagauaaaaggacaccuucaagauucugaggggaaaauuuuccaccuagaauucuauguccaaccaaacuauuaaccaaagguaaauguaggggccaggugcgguggcucaugccuguaaucccagcacuuugggaggccgaggugggcggaucacuucaggucaggaguuugagaccagccuggccaacauggcaaaaccccaucucuacuaaaaguacaaaaauuagcugugcaugguggugcacgccuguaaucccagcuacuugggaggcugaggcaugagaauugcuugagccugggaggcagagguugcagugagcugagauugcacuacagcacucuagucugagugacagagcaagacuguaucaaaaaaaaucaaacaaaaauguaaauguagaauaaaagcauucuuagucauacgaagucuuacaaaauuucccacuugcuuugaaaauuaccugaggcuaugcuauaucaaaaugggggaguggccgggcacaguggcucacaccuguaaucccagcacuuugggaggcagagguugcagugagccgagaucgcaucacugcacuccagccugggugacagagcaagauuccaucucaaaaaaaaaaaaaaaaaaaaaaaaaaaaaaaaccaacauuggaugacuaugaaucugggaauauggaagacauggaagucaggccacaauggaucccaagaggaagaucccagaaagguacuuagagaaccaucaguccaguuuggaacagguguaagaaagaccccaggaaagacagauccaaggggaaaaaaaagagguuuccagagauugaacuacccuugagaauuuggaauaacuucaaaaaagguaaaugcagagaaagcaaaaaaugccuuacuaagaugugcuucaguaagugaauggauguaucaacuguggcacauccagacaaugaaauauuauucagugauaaaaacaaauggauuaucugccaggugcaguggcucaugccuauaaucccaacacuuugggaggccgaggcggguggaucaccugaggucaggaguuugaggccagccuggccaacauggugaaaccccgucucuacuaaaaguacaaaaauuagcugugcaugguggugcacgccuguaaucccugauuacguggaucaccugaggucaggaguuugaggccagccuauaaucccacacaggcaugguggcgggcgccuguaaucccagcuacucgggaggcugaggcaggagaaucacaugaacccaggaggcggagguugcagugagccaagauugcaccauugcacuccagccugggcgacagagcaagacuccaucucaaauagauaaauuaauuaaauaaaauaaauggacuaucaauccaugaaaagacauggaggaaacuuaaaugcauauuacuaaguaaaagaagugggggaggcugugcauaugugggggcaagguguauauaucccuauaccuccuguucaauuuugcuguggaccuaaaaccgcucuaaaacaauuaaguacacaugaacaccccucccacacacacauauaacuuaaauagaaagggcuugaggaaucgcaaacaggagaagaaaaauuuuuuuagacagugucucacucuguugccuaggcuggaguauacuggugcgaucacaguucaccacagccucaaccucccagacucaggugcuucucuugccucacccuccugaguaguugagacuguaggcacgugccaccacaccuggccaauuuuuucuauuuggcuaaaaauguuaaaucuaacauggaaccuuaugcagaaauguaguauuaugcaacaucagacuggauguguacacagcaacacggacgggucuugaaaagaacgugcugagugaaaaaugaagaaacaaucaggucuacagcaugcuacccauuacaauacacacacauaaaacaguaacacacuuuuuacagcaauuuaugaaaaccaaaggauacacaucaaacgcacuauaaugguugccuaagguggagaugggaauggauaaugaacagaaaaagauaaauaaaacaagagauaguccuugcgugggccaauggugauaacgagguguaugaugccucaaccucuguacuuggacacaauggagugaaauuucagaacauuaggauuaagaaaaauccuaaagcugcaguaguggaagauggauguaucaccaaccaaagaauaaaacgcagaugaacaucagacuucuuaacagcaacaccacauuuggggaagacaaugaagcaacauauuuaaaaggcuaugggaaaauaagcugcaaccuacaacugcacacugagccaaacuauccucaaguccaaaagugaaauaaaguuggccagacgugguggcucacgccuguaaucccaacacuuugggaggcugagauggguggaucacuugaggucaggaguucgagaccagccuggacaacaugcugaaaccccaucucuacuaaaacuacaaaaauuagccaagcaugguggcucgcgccuguagucccagcuacucgggaggcugaggcaggagaauugcuugaacucaggaggcggagguugcagugagcugagaucucgccacugcacuccagccugggugacagagcgagacucugucucaaaaaaaaaaaaaaagugaaauaaagucauuuucugauugaauggaugugguaucauucauagugauauaaaagagauagaaaaagaaaaaaagaaauggcacauguugagagguccaggagagggaggauucaugaagaacauggcagggcugugaguuaaucuguaguugaucuacaaaaauaaacuugcagccaagcgugguggcucacgccugcaaucccaacacuuugagaggaugaggcaggaggaucgcuugagcucaggaguuggaguccagccugggcaacauacugagacuacugucucuacaaaaaaaaaaaaaaaaguuuuauaauuagccaggcgugguggugcgcaccuauaauggaaucccagcuacucaggaggcugagacaggaggauuguuugaggccaggaggucaaggcugcagugagccgugauugcaccacugcauuccagccugggugauagaaugagacucugucucuuaaaaaaauaaauaaauaaacaaaauaaacaugcaaauggguuaguuaaaaauuguuaaggagcuaaaagagaaacuaaaaacgauaaucaaauuguauuggaagagauaguaaugugaaugagcuaaauuuucauuugucauagcagggaguugcuaaaucaagaaauaguggugcagccgggcacacuggcucacaucuguaaucccagcacuuugggaggccgaggcggggaacacuugagccaggaguucaagaccagccugggcaacacggggagacccggucucuacaaaaaauaaaaaaaaauuagccaggcgugguggggugugccuguggucccugcuacucagaggcugagguugcaggaucacuugagucugggagguugaggcugcagugagccgugaucacugcacugaaggcugggcgacagagcaagacucugucucaaaaaaaaaaaaaaaagacgccaggcacagugacucacaccuguaaucucagcacuuugggaggcugaggugggcagaucaccuuaggucaggaguuugagaccagccuggccaacauagcaaaaccccaucucuacuaaaaauauaaaaauuagcugggcaugguggcgugugccuguagucccagcuacuccagaggcugaggcacgagaaucaccugaaccagggauguggagguugcgguaagccaaaauggugccacugcacuccagccugggcaacagagcaagacucugucucaaauaauaauaaauaaauaaauaaauaaacaaacaaacaguggugcaucaguuagggacuuuggaggcauguaggagaaaacucaacuaacuguggguuaaacaagacaagaguuuucuuuucguuucacugaacaaccaguccagagguaguuagucaggucaugggcaguggcugggaagcaagaggaagugaaugagcaauaagggccagcgcaguaggguugggagguucccagaagccccauccacaccucugcccccaucucauugccugguccagcuaacguggccuccggacgugcugggaaauguagguuuuuaaaguuggguacacgguugaccccacugaaauuucuguuguguuuauaagaaauaaaggggaaauguauacuggguaggcaaauugcuaucucugccuugagugguauaaacacuauuuggagauauggaaauaauuucaaggagaaauaaacucguacacuugccucuagggaaugagccuuggguggggcaaagggcuguuguguaguagccccauucuaguuuuuauuuuuuuuaaaccuuguugggauagguggaaaggcuucaucucacacucaucuuggagguuuaauucuaggcuguuuucucugccccuccccaccaaguaggaagaccggaaagcacuguguuuuggagaccagaaauuuaaccuccacgaggugggaaaggaauuugaacccaaagccgcucacccaguuccuggcucccuggacauaugucugaucacagaggugccuuuggaggaaaugauccagcaccucaaggugagugggacuucucuucuuuuugcaaaagcugcugcaaacgcagugaaaacagaagaaugacccagagagguaacaaguuuuaccacaaccagauaaugucugcacacaguuauguacuauuuugacugacaauucuuucauguaaauaaauguguuuaaaaaggaaacugugcauucccauuguaaaacaaacaaacaaacaaacaaaccuacauuuaugcacugaaauacuuuuuuuuuuuuuuuuugagacagagucuugcucuguuacccaggcuguaguauaguggcuugaucucggcucacugcaaccuccaccuccuggguucaagcgauucuccugccucagccucccaaguugcugguacuacaggugcgugccaccacaccuggcuaauuuuuguaguuuuaguagagacaggguuucaccacguuggccaggcuggucucaaacuccugaccucaagugcuccgcccaccucggccucccaaagugcuggccauuacaggcaugagccacgugcccagcccuaaauacauuuauauaaaaagaaaacguucauccaaguacaugaaaaacccauuauaucuuggcauaaaggaaaaguaacuguaaaaaccaacagcuaugaaagcauaacaaugucauuagauucuagccacuuccguucccuguacucccuggcccugacauuacaaagggagauauggcaggugguuaaagagauacuaagaacuuguuagcauccaccuucuauguguaaaaagaaggacugaaagaagauuggagagggaauaauuucugauuuguuguuauuuaauccagugucucuguaauacuuaaaaugaugucaucuagaagaggcauugguugggcacggucacucacgccuguaaucccagcacuuugggaggcugagguggcaggaucauuugggccaggaguuccagaccagccugggcaacauagugagaucccaucucuuaaaaaaaauaaacagaguagccaggcaugguagugcaugcccguaauccuagcuauucaagagggugaagugggaggaucacuugagcccaggagguggaggcuacagugagcuaugaucacgccacugcacuccagccugggugauacagcaagacccugucucuaaaaaauuaaaauaaggcuggggcacaguggcucaugccuguaaucccagugcuuuaggaggccaaggagggaggaucacuugaacccaggaauuugagaccagccuggguaacauggcgagacccugugucuacauaaaauacaaaaaaaaauuagccagacguggcggugugugccuguagucucagcuacuugggaggcuaagaggugggaggaucguuugagcccagguugaggcuguagugagcugugaucgcaccacuccauucuagucagugugacagagcaaggccccaucucuacaauaaauaaauaaaagggguuuuaguuucccuuuugcagaacacggauugaggucuuauauauauucugugcaaauaaccuagacuccuucuuugggaagugucagugaaaaagacugguuuggaaguaaaaugggugaagcauagggguuaagaguauggucguugacccagacugccuagguucgaauucugguucugccauuuacuagauaauacuagguacuauuauccuucccauuuuacagaugaggagaucgagguacaggguaguuagguacugugcccaaggccaucuagcugauaaguggcuggaacggagugauggaggggaggaugguaggagaugaggucagaaagauacagcgguguucuaaggucuucuaggccacuauaaggaauuaaauuuuacaggccaggcgcagugguucaugccuauaauuccagcacuuuaggaggcugaggcgggcggaucacuugaggucaggaguucgagaccagccugggcagcacagcaagaccucgucucuaugaaaaauagcugggcaugguggcaugcgccuguaaucccagcuacucaggaggcugaggugggagaauugcuugagccuaggaggcagcggagguugcagugagcugagaucucaccacugcacuccagccugggugacggagcgagacucugucacaaaaaaaaaaaaaaggcauuaaauuuuggucucacacacacauuuugacgaacgacuuuugucuuuucuucccacuucaggcuugugaugucccuauugaggaggggccaguccccagaacaggggcaaaagggccuaucauguccaucuacuuccgagaccccgacagaaaucugauugagguguccaacuacaucuccucgugauggaggcuggaccuccuccauucugucccccuugaugucgcccucuccuuuccuuccugcaaacccccacccaggcccagagaucuccaaagacugaggacuuaggcacuucacacauccugcugaggggggacccaagacagguuugggaccaaaccuacaugucuguaugucaucaaaguuggccuaauaaaugcauaaccucucaaugaa

SEQ ID NO: 192805 - RNA, 22923 nt, Homo sapiens
gaggguauuagcuguuuacugacaaaagagacauuucaggaccucagaaggccagacacucccauagguuggauggcccuuuggggagucugagcccauuuccacaaaaugcauucguuagacccacacacagugcuugagcccccuagacacagaauagucuuguccuguucuucaagugacugggcuaucaucugaggaauagucagcuuccccccaauacugggggugacgggagacuuuuaagggucauccccagguuuguauggcauucuuggggcaaacagcagaagggaugacugcccugaugccuccucaucucuggcagcauugccuagugcaacagcucuggccagaacccagccuggucuacagccauaccauccugaacaugccagaucuugucugaccucugaagcuaagcagggucaagccugguuaguacuugggagaagcugguguggcuagaccgugaccugaggaccccaguuauuucacccauccuuuguggaugacagcaccuggccugugagagaaucccacccucugagcaugucagugggaaaaaggaccuuuuuuugaucauuauccuccaaauaacgaagugaauucuauuagggccugcguuuuaucagugcuuguuguuuguccauauuagugagauggagaagguaaauaagugguuucuacugcugaaaugguuaagacaggugcugugagcuggaaucccaguuuagggccgcuaggcaugggcuaggccagucuuucaaacuggcuccaaagcaagugacaagaauaggagcccuagauccuuuuguaauucaacaaugugaugauugggcuuucacacuugugugagaugcaccucgcucaaaccuuguuaacaucugcacgguaccugucugaaguggaaaacaaaaaggaggccgaggccccugcccagggcugccagcauuggugcauaaaccucacagagaggccaagauccuagaaauggugacauguggaaugccagggguggcugcuccaacguuucuaaguagcccauacuucccaaucucaguaaagaaucuuguccuuuuuugagccaggaacucucuuaucucucauccagggggcuguccugaaaacauauauucacagccauaauacagacccuuacaggccgauggauguaccaaaaaaacagacucaggccuuccucaagcagugcuccaccugggcucaccuuugggaacugauugucagcauccacucuccccaucacaagggggaagcuggagccucucuccaccaagugaaguauuuccccuccaucagguaaagggccccugaggacuccaucuacagcaaaacccagggaggaggcagagaaacacacaaaccacagugaccuucaugugugcaaaguauaguuguuaaaaacaaaacaacagaaacagaauaaauaggcguggccucugcggggcagugccaaagcagagcuccacauacuuaggccuggggaggaagggcucuaugcuccaacaagucuagggcuggcaggcagggagggagguggggucucauguguuggcccucauggcaaagaauggagaucugguggggccgauggagggcuugagaaagccugaucaagaugcggcuguggccucagcccccuccucugagucccacaccucugacugcagguaaucagcaaagagagcccuagcccggcgcaggacgcgccccaggugguguuuucgcacaaggcggucaaagugcauggccagcucauuauaauccagcccauugcgcaugauguggucgcggugcuccagcaggauggccaggcagaggaacagcaugaauggguucccccggccaaacuccuggggugggggcaggcccauuggugguacagguggcagggacuuuccagggucuuucggggagccuaccucuugcaucaagggggauccuacagccauaucaccagugggagaggccuccuggguggaugguggagaugaggaagauggggaaucagggugggaaaaggaggagagcagugggucuggggaguucaauaaaggcucagagagggacuuggagcugauaagggcagcuggguggggcagcuggaccagagggucccuccuggagcccauguuaucccugaguugcuggaggccauccaagcuggccugucucaggagacgccccccaccaccaggccccugacuggcuguggccagguggucaacagcaucuucaaagguacuaccuccuccaccagcaggccucagcaugugccucugucgcacgggccacccccuguggccaccaaaaccagcgucugccacuuggcugggggguccaaccagcucuaccucauguucaggaggaucagggggcagcgaacuccaagugaccucaagcaugcggagggcaucgucgaaggcgaacucacgcuugaguuccagcagcagccagcgguaacagaagaagaggucaucagcgccugccucuugcagguauugauaaaagucagggucagcgugucgcagcaacagcuucaagugugcaaacuugguggccauggcgcggccgucaggguggaaguuggcggccaggcguuucaugaugccacaaaagcaaacaaaggcauggcccucaugguccaugacagcgaggaugggugaggcaaggucacucaugcccuggcaguaggacaccuguggguggguaacggcauagguggugagcaggucgugcagcgcccguagaugugggccauccucaggccccgcauaguaggggugggcccggucagugcgcaguacauccuugaggaccgugcugcggaugaauuccagguccucaggguucgcucgcugggcccacucgcucuugagcugcucauacucgcggcucuugcguuucauguaguccauccgcucucggccugucaguccaucuggauacacguucagcagguaccgccacaccaccugcccaggggugaaagggaugaggcuggaguucuccagauaaaccauaccccaaugucuaucaguugccacccacccaccccccuugggccucugucuuccuucuaagucugcuaggccuccgacugcucgccccuccuuaaagagaacuucgugcccuguaacaucuccacccuugcccacagcaguguggcugacugcaugugucucaggagcuguuaaugagugcagcagugauggacccaacagaugacugaggaugcucaccuuucgcagcgagggcuccacaccgccaugauagauccgcaggcgcaacuccucgggucgggagagcuggcccucgugguucagguacgugugaaacucagcaucgcucagggguggcuugaagggcuugacaucuuccccauacgaccagcucagcacuuguuggaccuuagacaagguacggcccaccuaugaggagggagggaggccaccaucagcuguguggacuaggggcagaugccaaccagcaugcucagaaccagggugccaggaaggcucugcccuccaaccacagcugggucccuagggucccugaaaacaccugagugaggauggacuguguaaagggcagggcggcagucgucagugaugaccguuucucagccagcaacacgucggagccaaugacaucuuuggggcugauuaugucccagucuucuagcaaugggccugggcaaacagaacaaagugcuauaagaauggggaugauaacccagaccucagggccggcuuccucuccuucuacugaagccgggcuaccugcaggggaacaaacaacucccagucccucuuccuguaucauccaaaucauguaaaaaacaaaaucaaaccaugaacaauucuuuuguaguagaugucucaggaacuggcugggcagccucuaauauuuuaaugauauaaaguaauauuuauugagcaguuacuaugugccaagcacuaggacaagcgcucaacagcaauauaagaaauaauaauacuagcuaaugcuuccacagugcuguaugccaggaacuauucugaauucuuugccaauacugacucaugcaauagucacuucaguccuaucgguugaguacuacuacuaccaugacucucuuugaggaaacaggcacagucaugauaagguacuugcccaaggccccuuagcuagugagugaaagaguggaaauuugaaggccaggcccaagcucaagagcccaaacuccuacucucauauuuuugccaguccuccucccacaaacagugcacgcuaauauuaccauucucauuuuacagacgaugacaaaaagguuuggaacaaauaguaagugaccaagauucuacagccaggaaauaguagggcugggaucugaacuucauucacccuaguccagagcccagacauacuuuagaaauaaaauauuugugcaaaaguggaacagguaugccguauaugcuuuuuuuuuuuuuuuuuuggagacggagucucacucuguaaccgaggguggaaugcaguggugugaacguagcucacugcaaacucugccuccugguuucaagugauucuccugccucagccucccgaguagcugggauuacaggugccugccaccaugcccagcuaauuuuuguauuuuuaguagagacggaguuucaccauguuggucaggcuggucuugaacuccugaccucacgugauccacucgccuuggccuacccaaagugcugggauuauaggcgugagccacugcacccagccucuuuuuucuuuuuuuuuugagauggagucucacucugucgcccaggcuggagugcaguggugcaaucuuggcucacuacaaacuccaccuuuuggguucaagcaguucuccugccuaagccucccaaguagcugggauuacaggugccugccaccagguccagcuaauuuuuuuuuuuuuuuugaggcggaguuucacucuuguugcccaggcuggaguacaaugacgggaucucggcucacugcaacauccaccuccuggguucaagugauucuccugccucagccucccgaguagcugggaguacaagcauguaccaccaugccuggugaauuuuauauuuuuaguagagacggggugucuccauguuggucaggcuggucucgaacucccgaccucaggugauccaccugccucggccucccaagguacugggauuacaggcaugagccaccacaccuggccuaauuuuuguauuuuuaguagagaugagguuucgcuauguugcccaggccggucucgaacuccugaccucaggugaucagcccgccuuggccucccaaagugcuaggauuacaggcaucuuuuuuuucuuuuuuugagacagucuugcucugucccccaaggcuggagugcaguggugcgaucauagcucacugcagccucaaacuccugggcucaaacgauccucuugccucaaccuccugaguagcuggggcuuacaggcgugugccaccaugcguggaugauuuuuuuuuuuuuugguagagaugggaucuuacuauauugccuauggucuugaacuccugggcucaagagauccuccugccuuggccucccaaaguguugggauuacaggugugagccacugcaccugaccguuucucuuucuuuuucauuuugccccgcauucuuucuucccaccucacauaagauguggugguugaagcagcaguggccaucugagaguagguucgagaggaucuucagagauccucuccuacagcccugauacgagagggcuacuaagccaacaauggcaauguccaguggcuggcuuuuuuuuuuuuuuuuuuuuuugagacggagucuuguucugucacccacacuggcgugcaauggugugauccucgcucacugcaaccucugccucccagguucaaccaauucuccugccacagccucccgaguagcugggauuacaggugccugccaccacgccuggcuaauuuuuuguauuuuuaguagagaugggguuugccaggcuggucuccaacuccugaccucaggugauccacccgccuuauguggggaaaagaaagagagaucagauuguuacugugucuaugcagaaaaggaagauguaagaaacuccauuuugaucuguacuaagaaaaauuguucugguuugagaugcuguuaaucuguauguaacuuuagccccaaccaugugcucacagaaacgugcuguauugaaucaagguuuaauggauuuagggcuaugcaggaugugccuuguuaacaauauguuugcaggcaguaugcuugguaaaagucaucgccauucuccauucucuauuaaccagggacaaaaugcacuguggaaagccacagggaacucugcccaagaaagccuggguauuguccaaaguuuccccucacugagacagccugauauauggccucgugggaaaggaaagaccuuacaucccccagcccgacacgcauaaagggucuaugcugaggaggaguagugaaagagggaguccucuuugcaguugagauaagaggaaggcuucugucuccugcuugucccugggaauggaaugucucgguguaaagccgaccauucguucuauucugagauaggagaaaauugccccguggcuggaggcgagauaugcuggcagcaauacugcucuguuacucuuugcuacacugagauauuuguguaaagugaaacauaaaucuagccuacaugcacauccaggcacaguaccuuuccuugaacuuauucaugauacagauuccuuugcucacauguuucccuacugaccuucuccccaccaacacucuguugcccugccacacuccccuugccaagauaguaaaaauagugaucaauaaauacugagggaacucagagaccggcgcuggugcagguccucgcaugcugagugugccgguacccugggcccacuguucuuucucuauacuuugucucugugucuuauuucuuuucucaaucucucgucuccaccuaacgagaaauacccacaaguguggaggggcaggcccccuucaccuuggccucccaaagugcugggauuacaggcgugagccacugcauccggcccaaguggcuaacuuucaaacucuuuugugugaaaccaaucaacuucuaucuguuuaagccacugucauuugcaagcaaaugccaucccuaaacagcauucccauggagcccaauuuucccauagagcugagggggggaacaaacccuaggccauguuugcaugucacugcuuuucccuggaugucucaugggguacugcaaaccuaagggguccaaagagaggagcccaagauccacucuagacauggccuccuccucuacuccucaucucaacaaacagcaucucuaucuguucaguuguuuaauagaccagaaaccugagagacauccuugucccccucccacucucuuaacucccagguccaaaccaccgccaaguccuacggcuacugcauguaaagcauuccuccauccuaccuguucucucaucuccaucuucucacccugucugagccaccauaucucucaccugaaacugccuccuaaccaguccucacuuccucuguauuccucuccaaucucucccaacagcugccagaauggucuuucuaaaacauuaaucagagcauuaaaacacuuaacagguaaaaugaagaaggucacauuaugaaaaaucaguaauggucugaaagucugaacagaagaaccacugcaaggcauggagcuaagguucaaugauuugagugaaaaaguagagagaccuggaugccaaguccaggagaccaaauauggaaauaauaggaaaugcagggggagaaaagggaucagguggagaugucagaauuaaacaaguaugaaagaaaauuucccugagaugaaggaauggcucaccaagucuuagauaggauuaauuaacuaacaacacacaacaggccccccaccaacccuauccuuuuuuuuuuuuuuuuuuugagauggagucuugcucugucacccagacuggagcacaaugguaugaucucggcucacugcaaccuccgccuccuggguucaagccauucuccugccucagccucccaaguagcugggauuccaggggcauaccaccacgcccggcuaauuuuugcuaauuuuuguauuuuuaguaaagacaggguuuugccacauuggccaggcuggucuugaacuccugaguucaagugauccgccugccucagcuucccaaagugcugggauuacaggcgugagccacugcgcccagcccgaaaugcccaaauucuaagaauaaagaaaaacucuuagacugggcgcaauggcucaugccuguaaucccagcaauuuuuuuuuuuugaggcagagucuugcucuguugcccaggcuggagcgcaguggcgugaucuuggcucacugcaaccuccgccucccggguucaagcgauucuccugucucagccucccaaguagcuaggacuacaggugugcgccacaacaccuggcaaauuuuuguauuuuuaguagagacgggguuucaccauguuggccaggcuggucucgaacuccugaguucaagugauccgccuaccucggucucccaaagugcugggauuacaggcaugagccaccaugcccagccuaaucccagcacuuugggaggccaaggcgggcggauugcuugagcccgagaguucaaaaccagccugggcugaacaugauaaaacccugucucuacccaaaaauauaaaaauuagcugggcaugguggcgcacaccuguagucccugccacucgggaggcugaggugggugggaggaucgcuugaaccugggaagcagagguugcagugagcugagaucacgucacugcacucccgccugggaaauagagauccugccucaaaaaaaaaaaaaaaaaaaaaagaaaaagaaaaacucuugcagcuuccagagacaaaaaacggcugcuuacaauggaaagaaggucagacaagcaacagacuucugcuucacaacccuggaggcaauaagacaguagcucacagcaccuauggagcacuaagaagaaagaccugagauccaagggccccacacccagccaagacaguacagaucuauucagccaaauaaaaacauuuuuggccauuagaguacaucuaacccaugcacuuuuggaggagaacaaagaaguucucugagcaaaugacuccugcaugacuagaagggcuuaagauagggagagacaaaggggaagguaaaugguaauauuuauauauuauauauuauauuauauauauuacauauuuaauauuuauaguuaaaaugacaacgauaacaugauuggggguuuguaauauuauauguuacauuaggauuccugaaacauaagugacuuaguguguuaguaagaaaacagaaugauaacccggaauuuaaaaagaaaaaaaauuggcugggugugguggcucaugccuguaaucccagcacuuugggaagccgaggcaggcaaaucacuugaggucaggaguucaagaccagccuggccaacauggugaaaccccaucucuaccaaauauaaaaaaacuagccgggugugguggugcgcuucuguuaccccagcuacucaagaggcugaggcaggagaauugcuugaaccugggaagaggagguugcgguaagcugagauugugccauagcacuccagccugggcaacagagcaagacuccaucucaaaaaaaaaaaaaaguugucuaagcaaaagcuagaaguuaaggguuagggaccagaaaacgaauaagaauuacaaguguuccaaagcuccauuuuaaaggccagaaaaagugggagagauuaaaggagaaaaaguggccuaaagauuucacuguuggggcggggugcagugacucacgacuauaaucccagcacuuugggaggccgaggcaggcagaucaugaggucaggagaucgagaccauccuggcuaacacggugaaaccccgucucuacuaaaaauacaaaaaauuagccaggugugauggugagcgccuguaaucccagcuacucgggaggcugagggagaauugcuugaacccaggaugcagagguugcagcgagccaagauugugccacugcacuccagucugggcgacagagcgaaacuccaucucaaaaaaaaaaaaaaaaaaauuagccgggcaugauggugugugccuguaaucccagcuacucgggaggcugagggaggagaauugcuugaacccaggaugcagagguugcagcgagcugagaucgugccacugcacuccagucugggcgacagagcgagacuacgugucaaaaagaaaaaaaaaagauuucacugucaguugccuuaaaaagcauaaauucugcuaugacguuuuuacgagagguaugagagacauaccuaaaacuaggugacacaaaaagguuaaaaauuaaagaauccuaaagguauaucugguaaacacaaacagaaaaaaauaguagccaugagaaugucagaaaaagcaucacucaaggccaaaagcauuuaacacaaagagacauuuuauacugauuaaaaaaaccacccccucaaucccacuaauaaaacaggcagaggccaggcgcgguggcucacgucuguaaucccagcacuuugggaggcugaggugggcggaucacaagguugagaccagccuggccaacauggugaaaccccaucucuacuaaaaaauacaaaaaaaaauuagccaggugugguggcaggugccuguaaucccagcugcuugggaggcugagguaaggagaaucgcuugaaccugggaggcagggguuacagugagcugagaucgcgccacugcacuccagccugggcaacaaugugagacucccucucaaaaaaaggaaaaaaaaggccgggcgcaguggcucacaccuguaaucccagcacuuugagaagcaaggcgggcggaucacaaggucaagagaucgagaccguccuggccaacauggugaaaccccgucucuacuaaaaauacaaaaauuagcugggcgugguggcgcgugccuguaaucucagcuacucaagaggcugaggcaggagaaucgcuugaaccugggaggcagagguugcagugagccggaauugugccacugcacuccagccuggcaacagagugucucaaaaaaacaaacaaacaaacaaacaaaaaacaggcaaagaaugucuacaaacacaaacucaccuaguagcaaaaccugaucugaacugacaggagacuauauauagucuuuauauaacccacguagugugaauaugcacacauuucccugaagaaacauccaaguguuucauugugggcugcuuggcugcuggcccagacccugcuugugguauuacauaauauucaugauacgcgcauuuccuuaucauaaaauugucaaacuucccaaacccuaaauuaauauauaaacucagugcaaugccagucagaaauugaauggggguuuuuccuggaaccggauaaaauuaucuuaagguuucuauagaagaauucacauuuaagaauagcuaagacaggcugggcgcgguggcucaugccuguaaucucagcacuuugggaggccgagguggguggaucacgaggucaggagaucgagaucauccuagcuaacacggugaaacccugccucuacuaaaaauacaaaacauuagccgggcgugguggcgagcgccuguggucccagcuacuugggagacugaggcaggagaauggcgugaacccaggagguggagcuugcagugagccaagauugugccacugcacuccagccugggcgacagagcaagacuccaucuccaaaaaaaaaaaaaaaguuaagacaaagaacagugggaggauggcaaaagcuuaucgccuguagucccagcuacuagggaggcugaggcaggagaauggcgugaacccgggaggcggagcuugcagugaguugagauugcgccacugcacuccagccugggcgacagagcgagacuccaucucaaaaaaaaaaaaaaauuugaccacaaaaccacugucauaaaaauaacaugguguuagcacagcaguagacaaauagagcccauugguagaaugcaauagaaagcccagaaauaaauccaagcuuguauauauggaaacugaauaugugacaaacguggcauuucgaaucacugcagaaaaggugauuauuuaauaaaugaugcuggcaggccgggcgcaguggcucaugccuguaaucucagcacuuugggaggcugaaguggguggaucaccugaggucauaaguucgacaccaaccuggccaacauggcaaaaccucaucucuacuaaaaauacaaaaauuagcuaggcaugguggcgggcaccuguaaucccagcuauuugggaggcugagucaggagaauugcuugaacccaggagacggcggcugcagugagcugagauugugcaacugcacuccugccugggcgauaagaguaaaacuucgucucaaaaaaaaaaauuaaauuaaaaaaaaugaugcuggcauaauugacuaucuugauuuuuuuaaagcuaggucugcuuaucacaaugcugacagagaaaagauuuauauguaaaaaagaaaacaauaagcauaguagaagaaaauauagaauauuuguauaagcuuauggauggggaacauguuccaaaguaauaggagaaacucagccaggcacaguggcucaugccuguaaucccaccacuuugggaggcccaggcagguggaucacuugagaucaggaauucgauaccagccugaccaacauggugaaacuccaucucuacuaaaaauacaaaaguagccagguguaguggcacaugccuguaaucccagcuacuugggaggcugaggcaggagaaucacuugaacccaggaggcggagguugcagugagccgagaucgcgccaucgcacuccagccugggcaaugagagugaaacucugucccuccaccugcaauaaaaaggagaaacucagaaaucauaaagaaaaagauagauaucuguguaggcgugcaaucaaauguuuaauuuugauaggacaaaacagauccaucccguaagcaaagccaaaaaacaaaagaucaacugggaaaaauauuugcaguaccuaugauagaaaggagguugggggcugggcacgguggcucccgccuguaauccaaacacuuugagaggccgagguggguggaucacuugaggucagaaguucgagaccagccuggccaacauggcaaaaccaugucucuacaaaaaauacaaaaauuagcugggcaugguggugcacaccuguagucccagcuacuugaaagccugaggcaggaggagagcuugaggucaaggcugcagugggccauauuugcgucacugcauuccagccuuggugacaaagagagucucaaaaagaaaaaagauucauaucggaaaaguacaaauuggucaaaggucuaggcuuuguaaucucccaacuguagaggugacagaaacuggcuuuuucccagaaagagggacugggccauccaaacagucccaacaugucuguugcuuucacagccaugaaaaugaucaugagaaugccauuaauaugucuaaugauagcuccauauauuggacacuuacauauuaauguguagaauaccuuauguuaaacacauaccguuuauguguacagacacgcaaauaugaauauacucacauauguggauaaauguguguguagggaguguaaauaaguaaaggacaugcaaaguuacacaucaaaccgauucccucggggcaaaaaggguaggguaggggauugagauuaggcauagcguucccaggagacuucagcauuauuuaaaaugcuuuuauuuuuaauaagaauguauuuacuggguaaugaaagauuaguuucucuuaaaaauaugacuccaaucaaauucccgucaggauuuuaauggaauaauaagcugauuuauuaaauaaaaagaacaguaagugaacaagaauauucaagaaaauuuuuuaaaaaggaaaacaugaaaacauaucauaaaacuauaaugauuaaggcugggugcgguggcucuugcuuguaaucccagcacuuugggaggcugaggcgggcagacugcuugaguccaggaguucaagaccagccugggcaacacggcgaaacccugucucuacaaaaaauacaaaaauuagcugggcaugggggcaugugccuauaggcccagcuacucaggaggcugacgugggacaauugcuugagccugggagguggaggcugcagugagcugagauugggccacugcacuccagcaaggaugacagagugagacccugucucaaaaaaaaaacaaaaaaaaaacccucaaaaccaaacaaacaaacagaaaacaaacuacuacaaugauuaaaacaacauagaauuggcuuauaauuuaauaaauagaucaacguaagagaaucaggaauucagaaacagaccgauguugugcaggaauuugguaaauaagacagagggcuuuuuuuuuuuuuuuuuugagauggagucuaguucugucacucaggcuggagugcgguggcacgagcucggaucauugcaaccuccgccucccaggcucaagcaauucuccugccucagucucccgaguagcugggauuacaggcgccuaccaccacgcccggcuaauuucuguauuuuuaguagagacaggguuucgccauguuuggccaggcuggucucgaacuccugaccucaggugauccacccgccucggccucccaaagugcugggauuacaggcgugagccacggcgccuggccuaaaaagauaaccuuuuaaagauguauuccugccagacuacugggugucuuucugucugucucucugcuuuacuggcauucgucccaguucucaugcacuugggguuuucuccacauguuucguagccaugcagauuugauuuuuuuccugaaauagugcuacugugucucuuuaacaggugaggaaaacaaggcccagggaauuaagugacugacauaagcacauauggcuacucaguggcagagguuccugugugucuggcuaccuggcuuuuccuauuuggcuuccugcccaucucugucacuaucuuucccucugacucuuguuucucucucuccucugucucucuuuugcaaagcugccaauuuuaacaaguccaaaauguuguagaguuaaaugguuaagaacaaggacucuggagccaguucagccacugccugaguucaaaucuugcucuucaacuuacugucuguauaacugggacgaguccugucaccucucugagccucaguuuccucaucuauaauauggggaaaaugauugucccuacucuauaggauuauuuugacaauucagugaaaaaauauuaugugcacagaauggcccuaaguguucacuacacauuagcuaguuauauguuauuaugacaucaauaaagugcucgacucaucccaaaugggcacaugaguuuccugaggcugggaaccacaucuuccacuccacaacuauuuaaaacaauuuugaaccuacaauaaaguuaaaagaauacacugaacacccauacauacuucaucuagauccucuauuaacauuuuuuugggccacauuugcuuuaucucacucucucuguauauaaacacauuauuuuugccaacuuauuugcagacaucaugacauuuuaccccuucauacuuaacugugucuuucccaagaacaaggauauuuuccuucaauagauaugauaccacuaccacacugcuaugguuugaauguguccuuccaaauucauguguugcaauuuaauuaccaaugugaucauauuaagaggugggggccuuuaagaggugauuaaguccugaggguagagcucucacagaugggauuagggcucuuuuuuuauuuuuuauuuuauuuauuuuuugagauggagucuugcucuguugcccaggcuggagugcaguggugcgaucuuggcucacugcaagcuccgccucccggguucaugccauucuccugccucagccucccgaguagcugggacuacaggcacccgccaccacgcccggcuauuuuuuuguauuuuuaguaaagacaggguuucaccguguuagccaggguggucucgaucuccugaccuugugaucugcccgccucggccuccuaaacugcugggauuacaggcgugagccaccgugcucagccucuuuuuuuuuuuuuuuuugagaugaagucucgcucugucacccaggcuggagugcaguggcaagaucuuggcucacugcaaccucugcuuuucggguucaagcgauucucaugccucagccucccgaguagcugggauuauaggcaugugccacuacacccggcuaauuuuuguauuuuuuuuaguagagacaggguuucaccauguuggccaggauggucucgaacuccugacuucaggugauccgccugccucagccucccaaagugcugggacuacaggcaugagccaccgugcccagcggauuugggcucuuauaaagagguugaggguguggguucacucucuucugcucuucugucaugugaggaugcagcaagaaagcccucacuagacacacaaccugccagcaccuugaucuuggacuucccagucuccaaaacugugagaaauaaauuucucuucuuuacaaauuccucagucugugguauucuguuauaguagcacaaaacgacuaagacacacacccaggaaauuuaauacugauacaauuaucuaauguauggucuguaaucaaauuuugagaccacguccuaauuuaucugugugcucgcagggaccagaauaggcaagaguggaagaacaaagaugagaagagaaaaaguggcugagaggucaagggaacaaaugaaugagugagcaagaauacaaacaaaugaauaugggugcagaaugacugaaugaauaaacacaacuagcauuauuauaauacgcauuguuauauuuagguauuauaacugaaauacauaaugcuaaagcuauaccguuauacuauauuauaaaucugcauuauaucuaauuauuacauacauuacucgguuauauguuauaauaguauaauacaauauaauuaucauuauuagagauaacacuuucugagccuucauuaugcagucaugcacuguuccaggcauuuuauaugaauuuccccucacaaugguucuaagauacaaggccucacaaugguucuaagauacaauuaucucuuuacaagugaagaaauuguggccuaguggcugagccaggaucuauagcuaggauaccuugcuacccaucccaccaugagggaguguacugugagggguagcaucacccuaugggguaaagggguuccagagcagugcuccugggggcacugaguacucacuguccuccgagggccgaauaucuacacgcaauugcagguaagguuuggaggcaguggcaaaggcugugcugaggucccagucagauagaagugagagguaaacuuccuguccuagccggucccggcccagguagcugaugccaaaguucuucuuccuggacaggggauacgagggagcucucagggccccuggugcccuggaggccucagggacaguuuccaaaacaaggaggguaauauagaaggcguugaaaacaacuuccuacuaugugcaagguacugugccaaggauuaugggcagccugagaucaggucauuuauacccacuuuguuacacaaacacauacaagcagguacacaccugcuuguaucuggaggucacauuggaaacugguaaaauguuggccgggugcaguggcucacgccuauaaucuccgcacuuugggaggccgagguggguggaucaccugaggucaggaguuugagacuagccuggucaacauggugaaaccccuucuguacuaaaaauacaaaaaaaauuagcugggugugguggcaggugccuguaaucccagcuacucaggaggcugaggcaggagaaucgcuugaaccugggagguggagguugcagugagccaagauuguggcauugcacuccaaccugggugacagagcaagacuccaucucaaaaaaaaaaaaaaaaguugguccccucugggguagaugugggacagaagugggaagaaagcagccuucuuacuacauaaaaaaaaagcaaucuguguuuguuauuuuucacaacaaaaauguuuauguaagaaagucuaauaacaacuaagaauuuuucagcuauacuugugcaacuauguaaagaaguuuguugcgugaugcucaucauaaccauggaaacauccuaaauacccaacaauuguguacuguuugaauuucuuaccauguguauguauuccuccaaaaucacaacaaaaugacuaucacaucugcccccaagagacaccacuuuucagcuaucagauuggcaaauuuugcaguuuuacaguaaccaauguuugcgagggugugagggaaacaggcauuuaugugcugcugaugagaucauaaauucguuuuuuuuuuuuuuugagacggagucucacucugucgcccagucuggagugcaauggugcgaucucggcucgcugcaagcuccgccucccgggcccaugccauucuccugccucagccucccaaguagcugggacuacaggcgcccaccaccacgccuggagaauuuuuuguauuuuuaguagagacggaguuucaccguguuagccaggauggucuugaucuccugaccucgugauccaccugccucagccucccaaagugcugggauuacaggcaugagccacagcgcccggcugagaucauaaauugauaaaaccugucuggagagcauuuuggaaacacccauuaauaguucaaaaagcaggccaggugcgguggcucaugccuguaaucccagcacuuugggaggcugaggcggguggaucacgaggucaggagaucgagacgauccuggccaacacggugaaaccccaucucuacuaaaaauacaaaaauuagccgggcaugguggcgcacgccuguaguaccagcuacucaggaggccgaggcaggagaauugcuugaacucaggagguggagguugcaaugagacgagaucacaccacugcacuccagccuggacgacagaaugagacugucucaaaaaaaaaauuuuuuuuaaagcaaauacccuuuuaccuggcaauaccacugcuaggaauuuauccuaugacuagauguuuccaaauacaguagucccucuuuaucuacaggggauacauuccaagacccccccgaguggaugccugaaacugcagauaguaccaagcccuauauauacuauguuuuuuuucauauacauacauaccuaugauaagguuuaauugauaaauuaggcacaguaagagauuaacaauaauagaacaauuaugacaauacagaugcuucuugacuuaugacaggguuauguaccaauaaacucaucguaaguuggaaauacuguaaguugacaaugcauuuggcugggcgcaguggcucaccuguaaucccagcacuuugagaggcugaggcgggcggauugcuugagcucaggaguuugagacugcccugggcaacauggcgaaacccugucucuacuaaagauacaaaaaauuggccgggugcggaggcucacgugccuguaauccuaacacuuugggaggccgaggugggcggaucacuugagaucaggaguuugagaccagccugaccaaccucaugaaaauuagcugagugugguggugcacaccuguaaucccagcuacucuggaggcugaggcaugagaaucacuugaacccgggaggcaaaggcugcaaugagccaacaucggaccacugcacuccaaccuaagugacagagugagacucugucuccaaaaaaaaaaaaaagagaagaucaaaaaacuaucugggacugggugcgggggcuuacaccuguaauccuagcacuuugggaggccgagguggacagguaacuugaggucagguguucgagacuagccugaccaacauggugaaaccuugucucuaauaaaaauacaaaaauuagcaggcgugguggugcgugccuguaaucccagcuacuugggaggcugaggcaggagaaucacuugaacccgggaagcggagguugcagugagcugagacugcgccacugcacugcagcccgggggacaagagcaaaacuccgucucaaaaaaaaaaaaaaaaaaaauuauccgggcauaguggugcaugccuguagucccagcuacuugggaggcugugacaggagaaucacuugaaccugggagaugucacugcacugcagccugggugacaguuagacuccaucucaaaaaaaaaaaaaaaaagaaauaaaaaggaaaaugcauuuaacacauuuauccuaccaaacaucacagguuagccuagccuaccuuaaacgugcucagaacgcucacauuagccuacaguugggaaaaucaucuaacacagagucuguuuuacaacaguguugaauauuucauguaauuuauugaacacuguacugaaagugaaaagcagaaucgcugggcacuugcaguacaguuucuaccaaaugcguaucgcuuuugcaccauuguaaaguugaaaaauccuaaguccaguuauuguaaguuggggacugucuguaaacuguaauaaaaguaauaugaauguggucucucucucucucucaaaauaucuuauuguauguaauauuugcagacugagguugaccauggguaacugaaacugcagaaagcaaaaccacagacaaaaguagacuacugugcuccaagacaugcauacguggcuguucacugugggauuauuuguaguaguaaaauaaacaaaaacccuaccaaacaaaggccagauagccacuguagaggucgguggcccacuggccaguccccagcaucuucccacucacccacucaaaucaaaggcucggaugaggaugugcugcaacacgucgagcgaggugaucuggggaucuacagcaaaagagcggaacucuggcggcaagaagcucucacauuucuggggagagaagacaugggguaggccaccaggggccccaucaccaugcugaagagugaggugcagagugguagaaggcaaagucagagaggugccaggggccagaucaaggcagguguucuggaccacaggguccagugaggaggaggcuacugcaagaguucaggcccccaauccuucuucuauaucccuucaacuaugguugccagaaucaccguguccagucuggcuccuguuaaaucaguccucuauggugcuguaaccaaucuaacacaucuaccuacaacacuccccugcuucaaucucuucaauggcaacccuagagucccagcaagcgggccuauggggccccagccagccucucaccagguuuuuugaacuuuacacucuaguaguaccaaacuguuagaaguuaccuugaaaccauccugacuccaggccauugauugugcugauccccugucuggaacaucccucccacuuucuucacgugguucacgcccagcucaggcaucaucuuuuuucugaaugucaaacuucuaccuuagagcucuauuacacugaagugauguguggacccucuuaucacugccagugccacugguuggucggagccaccaucauuguuuacuggaacuauggcaacagcguucuuccucagcauacacaccaaaggcccuuggcgaucugucucugucuuagcgcucugauucaccuccuaccacucuuccccucauucucuccacuccagcaaucaggaaccuacgggaacaugccaggcucauucccauccucuagucuuugcccuugcuauuccuucugccuagaauacucuucccuucuaauaugcacauggcugacuccuuuuauucgggucucugcuccuucaauaccuccucuggggauuucccuguacaaccuuggcuaacgugacucccuauuucauaaccuuuuucauuauuuuaguguccgaagcaucucauuucuuuaguugucuccacccacgagccugucagcucaucaaagugggaacuugcacauaagugcacucucaacacauggguugacugacuccagagccagcaccuucucauuccucagagccccacccucaacuacugcggccccuccuccagccccauagccccuccccuuugucuauaagcuccacccauucaucccauagacccccgccucgucccucuauuuucagucccacgccccaagguacgucgcuaacgcucucaggcucucaggcccucccuaccccucgccaucaucacuuggcccucaagcuucgccgcucagguuauguccgaaaucucaggucccgcccuccauccuaugacagccaccgccucccccuccccugggaugccucggcggcugggccgacucaccgccagccucaccuugacucggacccgcaccaccucucgcuccuccuccucagcggccgccgccgccugagcucccacaccgggcgggggcgcuccggagccagacaaguccgaggccccggaggcuguugccaucccgccgccgcccgucucagggugacggcugaccguugccccccaccccggcgcacacucuacuguacugacgcccgccgccccaccucgugccggggcgcaggcgcagag

SEQ ID NO: 192806 - RNA, 22923 nt, Homo sapiens
cucugcgccugcgccccggcacgagguggggcggcgggcgucaguacaguagagugugcgccgggguggggggcaacggucagccgucacccugagacgggcggcggcgggauggcaacagccuccggggccucggacuugucuggcuccggagcgcccccgcccggugugggagcucaggcggcggcggccgcugaggaggaggagcgagagguggugcggguccgagucaaggugaggcuggcggugagucggcccagccgccgaggcaucccaggggagggggaggcgguggcugucauaggauggagggcgggaccugagauuucggacauaaccugagcggcgaagcuugagggccaagugaugauggcgagggguagggagggccugagagccugagagcguuagcgacguaccuuggggcgugggacugaaaauagagggacgaggcgggggucuaugggaugaauggguggagcuuauagacaaaggggaggggcuauggggcuggaggaggggccgcaguaguugaggguggggcucugaggaaugagaaggugcuggcucuggagucagucaacccauguguugagagugcacuuaugugcaaguucccacuuugaugagcugacaggcucguggguggagacaacuaaagaaaugagaugcuucggacacuaaaauaaugaaaaagguuaugaaauagggagucacguuagccaagguuguacagggaaauccccagaggagguauugaaggagcagagacccgaauaaaaggagucagccaugugcauauuagaagggaagaguauucuaggcagaaggaauagcaagggcaaagacuagaggaugggaaugagccuggcauguucccguagguuccugauugcuggaguggagagaaugaggggaagagugguaggaggugaaucagagcgcuaagacagagacagaucgccaagggccuuugguguguaugcugaggaagaacgcuguugccauaguuccaguaaacaaugaugguggcuccgaccaaccaguggcacuggcagugauaagaggguccacacaucacuucaguguaauagagcucuaagguagaaguuugacauucagaaaaaagaugaugccugagcugggcgugaaccacgugaagaaagugggagggauguuccagacaggggaucagcacaaucaauggccuggagucaggaugguuucaagguaacuucuaacaguuugguacuacuagaguguaaaguucaaaaaaccuggugagaggcuggcuggggccccauaggcccgcuugcugggacucuaggguugccauugaagagauugaagcaggggaguguuguagguagauguguuagauugguuacagcaccauagaggacugauuuaacaggagccagacuggacacggugauucuggcaaccauaguugaagggauauagaagaaggauugggggccugaacucuugcaguagccuccuccucacuggacccugugguccagaacaccugccuugaucuggccccuggcaccucucugacuuugccuucuaccacucugcaccucacucuucagcauggugauggggccccugguggccuaccccaugucuucucuccccagaaaugugagagcuucuugccgccagaguuccgcucuuuugcuguagauccccagaucaccucgcucgacguguugcagcacauccucauccgagccuuugauuugagugggugagugggaagaugcuggggacuggccagugggccaccgaccucuacaguggcuaucuggccuuuguuugguaggguuuuuguuuauuuuacuacuacaaauaaucccacagugaacagccacguaugcaugucuuggagcacaguagucuacuuuugucugugguuuugcuuucugcaguuucaguuacccauggucaaccucagucugcaaauauuacauacaauaagauauuuugagagagagagagagaccacauucauauuacuuuuauuacaguuuacagacaguccccaacuuacaauaacuggacuuaggauuuuucaacuuuacaauggugcaaaagcgauacgcauuugguagaaacuguacugcaagugcccagcgauucugcuuuucacuuucaguacaguguucaauaaauuacaugaaauauucaacacuguuguaaaacagacucuguguuagaugauuuucccaacuguaggcuaaugugagcguucugagcacguuuaagguaggcuaggcuaaccugugauguuugguaggauaaauguguuaaaugcauuuuccuuuuuauuucuuuuuuuuuuuuuuuuugagauggagucuaacugucacccaggcugcagugcagugacaucucccagguucaagugauucuccugucacagccucccaaguagcugggacuacaggcaugcaccacuaugcccggauaauuuuuuuuuuuuuuuuuuuugagacggaguuuugcucuugucccccgggcugcagugcaguggcgcagucucagcucacugcaaccuccgcuucccggguucaagugauucuccugccucagccucccaaguagcugggauuacaggcacgcaccaccacgccugcuaauuuuuguauuuuuauuagagacaagguuucaccauguuggucaggcuagucucgaacaccugaccucaaguuaccuguccaccucggccucccaaagugcuaggauuacagguguaagcccccgcacccagucccagauaguuuuuugaucuucucuuuuuuuuuuuuuuggagacagagucucacucugucacuuagguuggagugcagugguccgauguuggcucauugcagccuuugccucccggguucaagugauucucaugccucagccuccagaguagcugggauuacaggugugcaccaccacacucagcuaauuuucaugagguuggucaggcuggucucaaacuccugaucucaagugauccgcccaccucggccucccaaaguguuaggauuacaggcacgugagccuccgcacccggccaauuuuuuguaucuuuaguagagacaggguuucgccauguugcccagggcagucucaaacuccugagcucaagcaauccgcccgccucagccucucaaagugcugggauuacaggugagccacugcgcccagccaaaugcauugucaacuuacaguauuuccaacuuacgaugaguuuauugguacauaacccugucauaagucaagaagcaucuguauugucauaauuguucuauuauuguuaaucucuuacugugccuaauuuaucaauuaaaccuuaucauagguauguauguauaugaaaaaaaacauaguauauauagggcuugguacuaucugcaguuucaggcauccacucgggggggucuuggaauguauccccuguagauaaagagggacuacuguauuuggaaacaucuagucauaggauaaauuccuagcagugguauugccagguaaaaggguauuugcuuuaaaaaaaauuuuuuuuuugagacagucucauucugucguccaggcuggagugcaguggugugaucucgucucauugcaaccuccaccuccugaguucaagcaauucuccugccucggccuccugaguagcugguacuacaggcgugcgccaccaugcccggcuaauuuuuguauuuuuaguagagaugggguuucaccguguuggccaggaucgucucgaucuccugaccucgugauccacccgccucagccucccaaagugcugggauuacaggcaugagccaccgcaccuggccugcuuuuugaacuauuaauggguguuuccaaaaugcucuccagacagguuuuaucaauuuaugaucucagccgggcgcuguggcucaugccuguaaucccagcacuuugggaggcugaggcagguggaucacgaggucaggagaucaagaccauccuggcuaacacggugaaacuccgucucuacuaaaaauacaaaaaauucuccaggcgugguggugggcgccuguagucccagcuacuugggaggcugaggcaggagaauggcaugggcccgggaggcggagcuugcagcgagccgagaucgcaccauugcacuccagacugggcgacagagugagacuccgucucaaaaaaaaaaaaaaacgaauuuaugaucucaucagcagcacauaaaugccuguuucccucacacccucgcaaacauugguuacuguaaaacugcaaaauuugccaaucugauagcugaaaaguggugucucuugggggcagaugugauagucauuuuguugugauuuuggaggaauacauacacaugguaagaaauucaaacaguacacaauuguuggguauuuaggauguuuccaugguuaugaugagcaucacgcaacaaacuucuuuacauaguugcacaaguauagcugaaaaauucuuaguuguuauuagacuuucuuacauaaacauuuuuguugugaaaaauaacaaacacagauugcuuuuuuuuuauguaguaagaaggcugcuuucuucccacuucugucccacaucuaccccagaggggaccaacuuuuuuuuuuuuuuuugagauggagucuugcucugucacccagguuggagugcaaugccacaaucuuggcucacugcaaccuccaccucccagguucaagcgauucuccugccucagccuccugaguagcugggauuacaggcaccugccaccacacccagcuaauuuuuuuuguauuuuuaguacagaagggguuucaccauguugaccaggcuagucucaaacuccugaccucaggugauccacccaccucggccucccaaagugcggagauuauaggcgugagccacugcacccggccaacauuuuaccaguuuccaaugugaccuccagauacaagcagguguguaccugcuuguauguguuuguguaacaaaguggguauaaaugaccugaucucaggcugcccauaauccuuggcacaguaccuugcacauaguaggaaguuguuuucaacgccuucuauauuacccuccuuguuuuggaaacugucccugaggccuccagggcaccaggggcccugagagcucccucguauccccuguccaggaagaagaacuuuggcaucagcuaccugggccgggaccggcuaggacaggaaguuuaccucucacuucuaucugacugggaccucagcacagccuuugccacugccuccaaaccuuaccugcaauugcguguagauauucggcccucggaggacagugaguacucagugcccccaggagcacugcucuggaaccccuuuaccccauagggugaugcuaccccucacaguacacucccucauggugggauggguagcaagguauccuagcuauagauccuggcucagccacuaggccacaauuucuucacuuguaaagagauaauuguaucuuagaaccauugugaggccuuguaucuuagaaccauugugaggggaaauucauauaaaaugccuggaacagugcaugacugcauaaugaaggcucagaaaguguuaucucuaauaaugauaauuauauuguauuauacuauuauaacauauaaccgaguaauguauguaauaauuagauauaaugcagauuuauaauauaguauaacgguauagcuuuagcauuauguauuucaguuauaauaccuaaauauaacaaugcguauuauaauaaugcuaguuguguuuauucauucagucauucugcacccauauucauuuguuuguauucuugcucacucauucauuuguucccuugaccucucagccacuuuuucucuucucaucuuuguucuuccacucuugccuauucuggucccugcgagcacacagauaaauuaggacguggucucaaaauuugauuacagaccauacauuagauaauuguaucaguauuaaauuuccugggugugugucuuagucguuuugugcuacuauaacagaauaccacagacugaggaauuuguaaagaagagaaauuuauuucucacaguuuuggagacugggaaguccaagaucaaggugcuggcagguugugugucuagugagggcuuucuugcugcauccucacaugacagaagagcagaagagagugaacccacacccucaaccucuuuauaagagcccaaauccgcugggcacgguggcucaugccuguagucccagcacuuugggaggcugaggcaggcggaucaccugaagucaggaguucgagaccauccuggccaacauggugaaacccugucucuacuaaaaaaaauacaaaaauuagccggguguaguggcacaugccuauaaucccagcuacucgggaggcugaggcaugagaaucgcuugaacccgaaaagcagagguugcagugagccaagaucuugccacugcacuccagccugggugacagagcgagacuucaucucaaaaaaaaaaaaaaaaagaggcugagcacgguggcucacgccuguaaucccagcaguuuaggaggccgaggcgggcagaucacaaggucaggagaucgagaccacccuggcuaacacggugaaacccugucuuuacuaaaaauacaaaaaaauagccgggcgugguggcgggugccuguagucccagcuacucgggaggcugaggcaggagaauggcaugaacccgggaggcggagcuugcagugagccaagaucgcaccacugcacuccagccugggcaacagagcaagacuccaucucaaaaaauaaauaaaauaaaaaauaaaaaaagagcccuaaucccaucugugagagcucuacccucaggacuuaaucaccucuuaaaggcccccaccucuuaauaugaucacauugguaauuaaauugcaacacaugaauuuggaaggacacauucaaaccauagcagugugguagugguaucauaucuauugaaggaaaauauccuuguucuugggaaagacacaguuaaguaugaagggguaaaaugucaugaugucugcaaauaaguuggcaaaaauaauguguuuauauacagagagagugagauaaagcaaauguggcccaaaaaaauguuaauagaggaucuagaugaaguauguauggguguucaguguauucuuuuaacuuuauuguagguucaaaauuguuuuaaauaguuguggaguggaagaugugguucccagccucaggaaacucaugugcccauuugggaugagucgagcacuuuauugaugucauaauaacauauaacuagcuaauguguagugaacacuuagggccauucugugcacauaauauuuuuucacugaauugucaaaauaauccuauagaguagggacaaucauuuuccccauauuauagaugaggaaacugaggcucagagaggugacaggacucgucccaguuauacagacaguaaguugaagagcaagauuugaacucaggcaguggcugaacuggcuccagaguccuuguucuuaaccauuuaacucuacaacauuuuggacuuguuaaaauuggcagcuuugcaaaagagagacagaggagagagagaaacaagagucagagggaaagauagugacagagaugggcaggaagccaaauaggaaaagccagguagccagacacacaggaaccucugccacugaguagccauaugugcuuaugucagucacuuaauucccugggccuuguuuuccucaccuguuaaagagacacaguagcacuauuucaggaaaaaaaucaaaucugcauggcuacgaaacauguggagaaaaccccaagugcaugagaacugggacgaaugccaguaaagcagagagacagacagaaagacacccaguagucuggcaggaauacaucuuuaaaagguuaucuuuuuaggccaggcgccguggcucacgccuguaaucccagcacuuugggaggccgaggcggguggaucaccugaggucaggaguucgagaccagccuggccaaacauggcgaaacccugucucuacuaaaaauacagaaauuagccgggcguggugguaggcgccuguaaucccagcuacucgggagacugaggcaggagaauugcuugagccugggaggcggagguugcaaugauccgagcucgugccaccgcacuccagccugagugacagaacuagacuccaucucaaaaaaaaaaaaaaaaaagcccucugucuuauuuaccaaauuccugcacaacaucggucuguuucugaauuccugauucucuuacguugaucuauuuauuaaauuauaagccaauucuauguuguuuuaaucauuguaguaguuuguuuucuguuuguuuguuugguuuugaggguuuuuuuuuuguuuuuuuuuugagacagggucucacucugucauccuugcuggagugcaguggcccaaucucagcucacugcagccuccaccucccaggcucaagcaauugucccacgucagccuccugaguagcugggccuauaggcacaugcccccaugcccagcuaauuuuuguauuuuuuguagagacaggguuucgccguguugcccaggcuggucuugaacuccuggacucaagcagucugcccgccucagccucccaaagugcugggauuacaagcaagagccaccgcacccagccuuaaucauuauaguuuuaugauauguuuucauguuuuccuuuuuaaaaaauuuucuugaauauucuuguucacuuacuguucuuuuuauuuaauaaaucagcuuauuauuccauuaaaauccugacgggaauuugauuggagucauauuuuuaagagaaacuaaucuuucauuacccaguaaauacauucuuauuaaaaauaaaagcauuuuaaauaaugcugaagucuccugggaacgcuaugccuaaucucaauccccuacccuacccuuuuugccccgagggaaucgguuugauguguaacuuugcauguccuuuacuuauuuacacucccuacacacacauuuauccacauaugugaguauauucauauuugcgugucuguacacauaaacgguauguguuuaacauaagguauucuacacauuaauauguaaguguccaauauauggagcuaucauuagacauauuaauggcauucucaugaucauuuucauggcugugaaagcaacagacauguugggacuguuuggauggcccagucccucuuucugggaaaaagccaguuucugucaccucuacaguugggagauuacaaagccuagaccuuugaccaauuuguacuuuuccgauaugaaucuuuuuucuuuuugagacucucuuugucaccaaggcuggaaugcagugacgcaaauauggcccacugcagccuugaccucaagcucuccuccugccucaggcuuucaaguagcugggacuacaggugugcaccaccaugcccagcuaauuuuuguauuuuuuguagagacaugguuuugccauguuggccaggcuggucucgaacuucugaccucaagugauccacccaccucggccucucaaaguguuuggauuacaggcgggagccaccgugcccagcccccaaccuccuuucuaucauagguacugcaaauauuuuucccaguugaucuuuuguuuuuuggcuuugcuuacgggauggaucuguuuuguccuaucaaaauuaaacauuugauugcacgccuacacagauaucuaucuuuuucuuuaugauuucugaguuucuccuuuuuauugcagguggagggacagaguuucacucucauugcccaggcuggagugcgauggcgcgaucucggcucacugcaaccuccgccuccuggguucaagugauucuccugccucagccucccaaguagcugggauuacaggcaugugccacuacaccuggcuacuuuuguauuuuuaguagagauggaguuucaccauguuggucaggcugguaucgaauuccugaucucaagugauccaccugccugggccucccaaaguggugggauuacaggcaugagccacugugccuggcugaguuucuccuauuacuuuggaacauguuccccauccauaagcuuauacaaauauucuauauuuucuucuacuaugcuuauuguuuucuuuuuuacauauaaaucuuuucucugucagcauugugauaagcagaccuagcuuuaaaaaaaucaagauagucaauuaugccagcaucauuuuuuuuaauuuaauuuuuuuuuuugagacgaaguuuuacucuuaucgcccaggcaggagugcaguugcacaaucucagcucacugcagccgccgucuccuggguucaagcaauucuccugacucagccucccaaauagcugggauuacaggugcccgccaccaugccuagcuaauuuuuguauuuuuaguagagaugagguuuugccauguuggccagguuggugucgaacuuaugaccucaggugauccacccacuucagccucccaaagugcugagauuacaggcaugagccacugcgcccggccugccagcaucauuuauuaaauaaucaccuuuucugcagugauucgaaaugccacguuugucacauauucaguuuccauauauacaagcuuggauuuauuucugggcuuucuauugcauucuaccaaugggcucuauuugucuacugcugugcuaacaccauguuauuuuuaugacagugguuuuguggucaaauuuuuuuuuuuuuuugagauggagucucgcucugucgcccaggcuggagugcaguggcgcaaucucaacucacugcaagcuccgccucccggguucacgccauucuccugccucagccucccuaguagcugggacuacaggcgauaagcuuuugccauccucccacuguucuuugucuuaacuuuuuuuuuuuuuuuggagauggagucuugcucugucgcccaggcuggagugcaguggcacaaucuuggcucacugcaagcuccaccuccuggguucacgccauucuccugccucagucucccaaguagcugggaccacaggcgcucgccaccacgcccggcuaauguuuuguauuuuuaguagaggcaggguuucaccguguuagcuaggaugaucucgaucuccugaccucgugauccacccaccucggccucccaaagugcugagauuacaggcaugagccaccgcgcccagccugucuuagcuauucuuaaaugugaauucuucuauagaaaccuuaagauaauuuuauccgguuccaggaaaaacccccauucaauuucugacuggcauugcacugaguuuauauauuaauuuaggguuugggaaguuugacaauuuuaugauaaggaaaugcgcguaucaugaauauuauguaauaccacaagcagggucugggccagcagccaagcagcccacaaugaaacacuuggauguuucuucagggaaaugugugcauauucacacuacguggguuauauaaagacuauauauagucuccugucaguucagaucagguuuugcuacuaggugaguuuguguuuguagacauucuuugccuguuuuuuguuuguuuguuuguuuguuuuuuugagacacucuguugccaggcuggagugcaguggcacaauuccggcucacugcaaccucugccucccagguucaagcgauucuccugccucagccucuugaguagcugagauuacaggcacgcgccaccacgcccagcuaauuuuuguauuuuuaguagagacgggguuucaccauguuggccaggacggucucgaucucuugaccuugugauccgcccgccuugcuucucaaagugcugggauuacaggugugagccacugcgcccggccuuuuuuuuccuuuuuuugagagggagucucacauuguugcccaggcuggagugcaguggcgcgaucucagcucacuguaaccccugccucccagguucaagcgauucuccuuaccucagccucccaagcagcugggauuacaggcaccugccaccacaccuggcuaauuuuuuuuuguauuuuuuaguagagaugggguuucaccauguuggccaggcuggucucaaccuugugauccgcccaccucagccucccaaagugcugggauuacagacgugagccaccgcgccuggccucugccuguuuuauuagugggauugagggggugguuuuuuuaaucaguauaaaaugucucuuuguguuaaaugcuuuuggccuugagugaugcuuuuucugacauucucauggcuacuauuuuuuucuguuuguguuuaccagauauaccuuuaggauucuuuaauuuuuaaccuuuuugugucaccuaguuuuagguaugucucucauaccucucguaaaaacgucauagcagaauuuaugcuuuuuaaggcaacugacagugaaaucuuuuuuuuuucuuuuugacacguagucucgcucugucgcccagacuggagugcaguggcacgaucucagcucgcugcaaccucugcauccuggguucaagcaauucuccucccucagccucccgaguagcugggauuacaggcacacaccaucaugcccggcuaauuuuuuuuuuuuuuuuuuugagauggaguuucgcucugucgcccagacuggagugcaguggcacaaucuuggcucgcugcaaccucugcauccuggguucaagcaauucucccucagccucccgaguagcugggauuacaggcgcucaccaucacaccuggcuaauuuuuuguauuuuuaguagagacgggguuucaccguguuagccaggauggucucgaucuccugaccucaugaucugccugccucggccucccaaagugcugggauuauagucgugagucacugcaccccgccccaacagugaaaucuuuaggccacuuuuucuccuuuaaucucucccacuuuuucuggccuuuaaaauggagcuuuggaacacuuguaauucuuauucguuuucuggucccuaacccuuaacuucuagcuuuugcuuagacaacuuuuuuuuuuuuuugagauggagucuugcucuguugcccaggcuggagugcuauggcacaaucucagcuuaccgcaaccuccucuucccagguucaagcaauucuccugccucagccucuugaguagcugggguaacagaagcgcaccaccacacccggcuaguuuuuuuauauuugguagagaugggguuucaccauguuggccaggcuggucuugaacuccugaccucaagugauuugccugccucggcuucccaaagugcugggauuacaggcaugagccaccacacccagccaauuuuuuuucuuuuuaaauuccggguuaucauucuguuuucuuacuaacacacuaagucacuuauguuucaggaauccuaauguaacauauaauauuacaaacccccaaucauguuaucguugucauuuuaacuauaaauauuaaauauguaauauauauaauauaauauauaauauauaaauauuaccauuuaccuuccccuuugucucucccuaucuuaagcccuucuagucaugcaggagucauuugcucagagaacuucuuuguucuccuccaaaagugcauggguuagauguacucuaauggccaaaaauguuuuuauuuggcugaauagaucuguacugucuuggcuggguguggggcccuuggaucucaggucuuucuucuuagugcuccauaggugcugugagcuacugucuuauugccuccaggguugugaagcagaagucuguugcuugucugaccuucuuuccauuguaagcagccguuuuuugucucuggaagcugcaagaguuuuucuuuuucuuuuuuuuuuuuuuuuuuuuuugaggcaggaucucuauuucccaggcgggagugcagugacgugaucucagcucacugcaaccucugcuucccagguucaagcgauccucccacccaccucagccucccgaguggcagggacuacaggugugcgccaccaugcccagcuaauuuuuauauuuuuggguagagacaggguuuuaucauguucagcccaggcugguuuugaacucucgggcucaagcaauccgcccgccuuggccucccaaagugcugggauuaggcugggcaugguggcucaugccuguaaucccagcacuuugggagaccgagguaggcggaucacuugaacucaggaguucgagaccagccuggccaacauggugaaaccccgucucuacuaaaaauacaaaaauuugccagguguuguggcgcacaccuguaguccuagcuacuugggaggcugagacaggagaaucgcuugaacccgggaggcggagguugcagugagccaagaucacgccacugcgcuccagccugggcaacagagcaagacucugccucaaaaaaaaaaaauugcugggauuacaggcaugagccauugcgcccagucuaagaguuuuucuuuauucuuagaauuugggcauuucgggcugggcgcaguggcucacgccuguaaucccagcacuuugggaagcugaggcaggcggaucacuugaacucaggaguucaagaccagccuggccaauguggcaaaacccugucuuuacuaaaaauacaaaaauuagcaaaaauuagccgggcguggugguaugccccuggaaucccagcuacuugggaggcugaggcaggagaauggcuugaacccaggaggcggagguugcagugagccgagaucauaccauugugcuccagucugggugacagagcaagacuccaucucaaaaaaaaaaaaaaaaaaaggauaggguugguggggggccuguuguguguuguuaguuaauuaauccuaucuaagacuuggugagccauuccuucaucucagggaaauuuucuuucauacuuguuuaauucugacaucuccaccugaucccuuuucucccccugcauuuccuauuauuuccauauuuggucuccuggacuuggcauccaggucucucuacuuuuucacucaaaucauugaaccuuagcuccaugccuugcagugguucuucuguucagacuuucagaccauuacugauuuuucauaaugugaccuucuucauuuuaccuguuaaguguuuuaaugcucugauuaauguuuuagaaagaccauucuggcagcuguugggagagauuggagaggaauacagaggaagugaggacugguuaggaggcaguuucaggugagagauaugguggcucagacagggugagaagauggagaugagagaacagguaggauggaggaaugcuuuacaugcaguagccguaggacuuggcggugguuuggaccugggaguuaagagagugggagggggacaaggaugucucucagguuucuggucuauuaaacaacugaacagauagagaugcuguuuguugagaugaggaguagaggaggaggccaugucuagaguggaucuugggcuccucucuuuggaccccuuagguuugcaguaccccaugagacauccagggaaaagcagugacaugcaaacauggccuaggguuuguucccccccucagcucuaugggaaaauugggcuccaugggaaugcuguuuagggauggcauuugcuugcaaaugacaguggcuuaaacagauagaaguugauugguuucacacaaaagaguuugaaaguuagccacuugggccggaugcaguggcucacgccuguaaucccagcacuuugggaggccaaggugaagggggccugccccuccacacuuguggguauuucucguuagguggagacgagagauugagaaaagaaauaagacacagagacaaaguauagagaaagaacagugggcccaggguaccggcacacucagcaugcgaggaccugcaccagcgccggucucugaguucccucaguauuuauugaucacuauuuuuacuaucuuggcaaggggaguguggcagggcaacagaguguugguggggagaaggucaguagggaaacaugugagcaaaggaaucuguaucaugaauaaguucaaggaaagguacugugccuggaugugcauguaggcuagauuuauguuucacuuuacacaaauaucucaguguagcaaagaguaacagagcaguauugcugccagcauaucucgccuccagccacggggcaauuuucuccuaucucagaauagaacgaauggucggcuuuacaccgagacauuccauucccagggacaagcaggagacagaagccuuccucuuaucucaacugcaaagaggacucccucuuucacuacuccuccucagcauagacccuuuaugcgugucgggcugggggauguaaggucuuuccuuucccacgaggccauauaucaggcugucucagugaggggaaacuuuggacaauacccaggcuuucuugggcagaguucccuguggcuuuccacagugcauuuugucccugguuaauagagaauggagaauggcgaugacuuuuaccaagcauacugccugcaaacauauuguuaacaaggcacauccugcauagcccuaaauccauuaaaccuugauucaauacagcacguuucugugagcacaugguuggggcuaaaguuacauacagauuaacagcaucucaaaccagaacaauuuuucuuaguacagaucaaaauggaguuucuuacaucuuccuuuucugcauagacacaguaacaaucugaucucucuuucuuuuccccacauaaggcggguggaucaccugaggucaggaguuggagaccagccuggcaaaccccaucucuacuaaaaauacaaaaaauuagccaggcgugguggcaggcaccuguaaucccagcuacucgggaggcuguggcaggagaauugguugaaccugggaggcagagguugcagugagcgaggaucacaccauugcacgccagugugggugacagaacaagacuccgucucaaaaaaaaaaaaaaaaaaaaaagccagccacuggacauugccauuguuggcuuaguagcccucucguaucagggcuguaggagaggaucucugaagauccucucgaaccuacucucagauggccacugcugcuucaaccaccacaucuuaugugaggugggaagaaagaaugcggggcaaaaugaaaaagaaagagaaacggucaggugcaguggcucacaccuguaaucccaacacuuugggaggccaaggcaggaggaucucuugagcccaggaguucaagaccauaggcaauauaguaagaucccaucucuaccaaaaaaaaaaaaaaucauccacgcaugguggcacacgccuguaagccccagcuacucaggagguugaggcaagaggaucguuugagcccaggaguuugaggcugcagugagcuaugaucgcaccacugcacuccagccuugggggacagagcaagacugucucaaaaaaagaaaaaaaagaugccuguaauccuagcacuuugggaggccaaggcgggcugaucaccugaggucaggaguucgagaccggccugggcaacauagcgaaaccucaucucuacuaaaaauacaaaaauuaggccaggugugguggcucaugccuguaaucccaguaccuugggaggccgaggcagguggaucaccugaggucgggaguucgagaccagccugaccaacauggagacaccccgucucuacuaaaaauauaaaauucaccaggcauggugguacaugcuuguacucccagcuacucgggaggcugaggcaggagaaucacuugaacccaggagguggauguugcagugagccgagaucccgucauuguacuccagccugggcaacaagagugaaacuccgccucaaaaaaaaaaaaaaaauuagcuggaccugguggcaggcaccuguaaucccagcuacuugggaggcuuaggcaggagaacugcuugaacccaaaagguggaguuuguagugagccaagauugcaccacugcacuccagccugggcgacagagugagacuccaucucaaaaaaaaaagaaaaaagaggcugggugcaguggcucacgccuauaaucccagcacuuuggguaggccaaggcgaguggaucacgugaggucaggaguucaagaccagccugaccaacauggugaaacuccgucucuacuaaaaauacaaaaauuagcugggcaugguggcaggcaccuguaaucccagcuacucgggaggcugaggcaggagaaucacuugaaaccaggaggcagaguuugcagugagcuacguucacaccacugcauuccacccucgguuacagagugagacuccgucuccaaaaaaaaaaaaaaaaaagcauauacggcauaccuguuccacuuuugcacaaauauuuuauuucuaaaguaugucugggcucuggacuagggugaaugaaguucagaucccagcccuacuauuuccuggcuguagaaucuuggucacuuacuauuuguuccaaaccuuuuugucaucgucuguaaaaugagaaugguaauauuagcgugcacuguuugugggaggaggacuggcaaaaauaugagaguaggaguuugggcucuugagcuugggccuggccuucaaauuuccacucuuucacucacuagcuaaggggccuugggcaaguaccuuaucaugacugugccuguuuccucaaagagagucaugguaguaguaguacucaaccgauaggacugaagugacuauugcaugagucaguauuggcaaagaauucagaauaguuccuggcauacagcacuguggaagcauuagcuaguauuauuauuucuuauauugcuguugagcgcuuguccuagugcuuggcacauaguaacugcucaauaaauauuacuuuauaucauuaaaauauuagaggcugcccagccaguuccugagacaucuacuacaaaagaauuguucaugguuugauuuuguuuuuuacaugauuuggaugauacaggaagagggacugggaguuguuuguuccccugcagguagcccggcuucaguagaaggagaggaagccggcccugaggucuggguuaucauccccauucuuauagcacuuuguucuguuugcccaggcccauugcuagaagacugggacauaaucagccccaaagaugucauuggcuccgacguguugcuggcugagaaacggucaucacugacgacugccgcccugcccuuuacacaguccauccucacucagguguuuucagggacccuagggacccagcugugguuggagggcagagccuuccuggcacccugguucugagcaugcugguuggcaucugccccuaguccacacagcugaugguggccucccucccuccucauaggugggccguaccuugucuaagguccaacaagugcugagcuggucguauggggaagaugucaagcccuucaagccaccccugagcgaugcugaguuucacacguaccugaaccacgagggccagcucucccgacccgaggaguugcgccugcggaucuaucauggcgguguggagcccucgcugcgaaaggugagcauccucagucaucuguuggguccaucacugcugcacucauuaacagcuccugagacacaugcagucagccacacugcugugggcaaggguggagauguuacagggcacgaaguucucuuuaaggaggggcgagcagucggaggccuagcagacuuagaaggaagacagaggcccaagggggguggguggguggcaacugauagacauugggguaugguuuaucuggagaacuccagccucaucccuuucaccccugggcaggugguguggcgguaccugcugaacguguauccagauggacugacaggccgagagcggauggacuacaugaaacgcaagagccgcgaguaugagcagcucaagagcgagugggcccagcgagcgaacccugaggaccuggaauucauccgcagcacgguccucaaggauguacugcgcacugaccgggcccaccccuacuaugcggggccugaggauggcccacaucuacgggcgcugcacgaccugcucaccaccuaugccguuacccacccacagguguccuacugccagggcaugagugaccuugccucacccauccucgcugucauggaccaugagggccaugccuuuguuugcuuuuguggcaucaugaaacgccuggccgccaacuuccacccugacggccgcgccauggccaccaaguuugcacacuugaagcuguugcugcgacacgcugacccugacuuuuaucaauaccugcaagaggcaggcgcugaugaccucuucuucuguuaccgcuggcugcugcuggaacucaagcgugaguucgccuucgacgaugcccuccgcaugcuugaggucacuuggaguucgcugcccccugauccuccugaacaugagguagagcugguuggaccccccagccaaguggcagacgcugguuuugguggccacaggggguggcccgugcgacagaggcacaugcugaggccugcugguggaggagguaguaccuuugaagaugcuguugaccaccuggccacagccagucaggggccuggugguggggggcgucuccugagacaggccagcuuggauggccuccagcaacucagggauaacaugggcuccaggagggacccucugguccagcugccccacccagcugcccuuaucagcuccaagucccucucugagccuuuauugaacuccccagacccacugcucuccuccuuuucccacccugauuccccaucuuccucaucuccaccauccacccaggaggccucucccacuggugauauggcuguaggaucccccuugaugcaagagguaggcuccccgaaagacccuggaaagucccugccaccuguaccaccaaugggccugcccccaccccaggaguuuggccgggggaacccauucaugcuguuccucugccuggccauccugcuggagcaccgcgaccacaucaugcgcaaugggcuggauuauaaugagcuggccaugcacuuugaccgccuugugcgaaaacaccaccuggggcgcguccugcgccgggcuagggcucucuuugcugauuaccugcagucagaggugugggacucagaggagggggcugaggccacagccgcaucuugaucaggcuuucucaagcccuccaucggccccaccagaucuccauucuuugccaugagggccaacacaugagaccccaccucccucccugccugccagcccuagacuuguuggagcauagagcccuuccuccccaggccuaaguauguggagcucugcuuuggcacugccccgcagaggccacgccuauuuauucuguuucuguuguuuuguuuuuaacaacuauacuuugcacacaugaaggucacugugguuuguguguuucucugccuccucccuggguuuugcuguagauggaguccucaggggcccuuuaccugauggaggggaaauacuucacuugguggagagaggcuccagcuucccccuugugauggggagaguggaugcugacaaucaguucccaaaggugagcccagguggagcacugcuugaggaaggccugagucuguuuuuuugguacauccaucggccuguaagggucuguauuauggcugugaauauauguuuucaggacagcccccuggaugagagauaagagaguuccuggcucaaaaaaggacaagauucuuuacugagauugggaaguaugggcuacuuagaaacguuggagcagccaccccuggcauuccacaugucaccauuucuaggaucuuggccucucugugagguuuaugcaccaaugcuggcagcccugggcaggggccucggccuccuuuuuguuuuccacuucagacagguaccgugcagauguuaacaagguuugagcgaggugcaucucacacaagugugaaagcccaaucaucacauuguugaauuacaaaaggaucuagggcuccuauucuugucacuugcuuuggagccaguuugaaagacuggccuagcccaugccuagcggcccuaaacugggauuccagcucacagcaccugucuuaaccauuucagcaguagaaaccacuuauuuaccuucuccaucucacuaauauggacaaacaacaagcacugauaaaacgcaggcccuaauagaauucacuucguuauuuggaggauaaugaucaaaaaaagguccuuuuucccacugacaugcucagagggugggauucucucacaggccaggugcugucauccacaaaggaugggugaaauaacugggguccucaggucacggucuagccacaccagcuucucccaaguacuaaccaggcuugacccugcuuagcuucagaggucagacaagaucuggcauguucaggaugguauggcuguagaccaggcuggguucuggccagagcuguugcacuaggcaaugcugccagagaugaggaggcaucagggcagucaucccuucugcuguuugccccaagaaugccauacaaaccuggggaugacccuuaaaagucucccgucacccccaguauuggggggaagcugacuauuccucagaugauagcccagucacuugaagaacaggacaagacuauucugugucuagggggcucaagcacugugugugggucuaacgaaugcauuuuguggaaaugggcucagacuccccaaagggccauccaaccuaugggagugucuggccuucugagguccugaaaugucucuuuugucaguaaacagcuaauacccuc

SEQ ID NO: 192807 - RNA, 6941 nt, Homo sapiens
uuagagucaagaucuuuuauuuccugauuuuaaaaaucgucaccaucauagaccuccuggcuucucuuguaucuguguucuaauggcucccagcagugccuucacacagccccuuuauuccccuucuugugccugcccaugagccugagugugacagaucaauuagcuuugucccuccaaacugugggagcaggacuagacucuucuggcaggcagagagcuccuccucggccaguguucgagccugguccaccacuccucaguucuucuugcucuuggcuuuuguggccuuggcauccagcgugcucugggcaugagugaggugcuucacagcaucaagcacaaggacuccaggcagcaccagccacagggcauucaugaagacaaaguaaaaccagaaguagagaggguggcccagcucuccgugcuggaauccgucgcggugcucugucaggaaguagagcacauccccauagaucuggccuguggguggcaggaggggaaggagaagccccagugaggaaggggacacuuucgccaauucucuauuccaaagcacuuuccaagucaucauucaaggucucagagcuaaguauucugaaaucacagagcugaaaaucugagaaaucagaaaagugagauuccagacaccagagagcugagaauuucagaacucaggagagcucacaccuucagauuuaaggaaguucaaaauccucaaauccaagacagcuuaggauucugggacuaaagauaacucauaucgcuagaacuaaagaaagcuaacaauuuaauaacacaagaugacugaggccgggcacaguggcucacaccuguaaucccaguacuucgggaggccaagccaggaggacuguuugagcucaggagcuugagaccagccugggcaacauggcgaaaccccaucucuacuaaaaauacaaaaguuagccaggcacgguggcacaugccuguagucccagcuacucaggagacugaggcaggaagaucgcuugagucugggagguggagguugcagugagccgagaucacaccauagcacucuggccugggugacagagccagacccuguuuuaaaaaaaauaugacagaaucuuacaugaagggaucucagagcccugauccuggagguuccaggggcuucuugccacccugggccaccucauguaaccuucacaggagacuuugugauggagaaggaggaggaggaagaaaaaugaacccuccccaccugagagugcaggcucagagaagggcaugaccuuuccagagccucaggggguuugucauucagucugacuuaccccuggaagggcaccguugagagaucccacccacagggauacaucugugucuguggaucccccaucaaccccucuagugcccagugccccucuagugcccuuuccuuacccacagagaccacaagcuguagaaugaagcggaggggaugcuggcggagaaaggcgaucaccacccacaggcugagugguccccacaggcaagcugugaugguuuccaugcacacugugaaguugucaccccugcaggagaaagcaugaggggacacugguaucggugugcucuuccuacagguuagcccauuagugcuccccaacucaccaccccccgaaaaccaaugccagucuccauugacagaggcaaacacuuacaggauguaucggcugucucccuuggcauacucuuucccugaagaaaagaagagagagauaugaagaauaaaggcagugaaaggaacacacacuugugagagcugggggucccugcaagaagacagacuucauaaccuucccaugcgucugcuuccucauccgugaaaugggguaacuguuuggauucuagugguuuauuucucuaaaacaagguaauauguguaaagccugacacaaaacaguguggcugugauugguacucaagaagugugugugguauaaaaggaagcagguguagaugauggagugagugaaguagccaaugagagagagagaauguaggugaacagaugagugaauacaagagugagcagagaaucagaaagaaaaagaccgccgggcacgauggcucaugccuguaaucccaacacuuugggaggcugaggugggaugauggcuugcauaaaggaguucaagaccagucugaacaauauagugagacccccaacucuauaaaacauacaaaaauuagcuggacgugguggcacgugccuacagucccaggcugcagugggaggaugucuugagcccaggagguugaggcugcagugagcuaugauagcaccacagugcucagccuggacaacaggguaagacccugucucaaaaaaaaaaaaaaaaaagaaagaaagaaaaagaucauccaauauaaaauaggcagaagacuugaauagguucuucacaaagaggauuucuaaauggccaauaaguauaugaaagauguucaaacuuccauuagucacuaaggaaaagcaaauuaaaaccauaaugagauaucacucacaucuacuggaaugacuaaaauuuaagaaacaucugaccagccgggcacaauggcucaugccuguaauguuuuuuuuuuuuuuuuuuuuuuuugagacggagccuugcucuuaucgcucaggcuggagugugcaguggcgcaaucucagcucaccacaaccuccgccucccaggucccagagauucuccugccucagccuccugaguagcugggauuacaggcaccugccaccacgcccagcuaauuuuuagacuuuuaguagagacgggguuucacuauguuggccagacuggucucaaacuccugaccucaggugaucugcccgccuucgccucacaaagugcugggauuacaggcaugagccacucugcccggccuuguuuauaauggcagaagauugagggaaaaugcccaucaauacuacacaagucaagcaacuguacaauguccaugcuuugaaagcucuuuaugaaaucaugaggagugaccucauuaaaaaaagcagcugggugcgguggcucaugcuuguaauccuagcacuuugggaggcugaggugggcagaucacuugaagccaggaguuggagaacagccugggcaacaaagcaagacgccaucucuuaaaaaaaaaaguuguuaaaaaaaaaauaacuuggugggguggcacaugccuauaaucccagcuacuagggaggcugaggcaggaggauugcuugauugcccaggaguucaagguugcagugagcuauaaucaugccacugcacucuagccugggugacagagcgagaccccgucucaaaaaagaaaauggcuucuuugguuuucuuguaaggaaagaaagaaaaagagaaaagauuagaaguauauauagcauauuaccauuuguguaaaaagggaaaagugcaaauaaugauaauaauagugaacaguuacauggcaaccacuguuugccaaacacuguucuaaguaucuuacauauaguugguuauuacuauuauccuccuuuuacaauugagcaaauugagacuuacguguguaaauaaacugaaaagaaacauaaacaacuaucaacagugccuaacagcguuuggggaaacuuaguggauagaaagcagauuuucacugcaaaucucuuuaaaugguuuuuugacccacgugaauauacaugcaacaaaaaaguuaaauaaggcugggcacgguggugcgcaccugucaucccagaauuuugggaggcugagguggaaggauugcuugagcccaggaguuaaagaacagccugagcaacauagcaagaccuugucucuacaaaaaagugaaaauauuagccaggcauaaaggugugcaccuauaguauagucccagcuacuggggaggcugaggcaagacgaucgcuugaacccaggaguuggagguugcagugagcaaucaucauaccacugcacuccagccugggcaacagagcaagaccuugucucaaaaauaaguuaucuaccaguuuuagagaagggcaaaaaacaaaaagaauaauaauaacaauacauaauaauuuuuuuuuugagacaaagucucacucuguugcccaggcuggagugcaauggcauggucuuggcucacugcaaccuccgccucccagguucaagcaauucuccugccucagccucccuaguagcugggauuacaggcgugugccaccacacccggcuaauuuuuguauuuuuaguagagaugggguuucaucaucuuggccuggcuggucuucaacucccgaccucgugaucugccugccucggccucccaaagugcugggauuacaggcuugagccaccgcgccuggcuaauuuuuguauuuuuaguagagaugggguuuugccauguugaccaggcuggucucaaauuccugaccucaagugauccaccugccucggccucccaaagugcugggauuacaagcgugagccacugugcccggccuauaauaaauuuuuuaaaagauuaaauaaaaauuuaaaauaaaucaauggaagaagaauagguggauagguaaacaugcaagccgaucccugcccagcaaaucccaucccacagcauaugaaagaaaucaggacucacagaguugagauaagaaggcuuggucuccaagcaggucuucguaguagagaacgaaccagcccucgaucaccaggugaaugaacccacacacugcaaaccagcacagggacagucgccgccaaguccccaaugggacaaccgcagcacgaccugacaacagccauguggucacgacuaagaccccugugacagagaagaggccagccaguauaugccagguggggcggucauuagguacaaaguuguccagucuuaggugcugaggccaguaugggugcaaggggcccgcguugguagucaugucuuugugggcugauggcugcguguguauaggcaggaaguuaaaaaaaaaaaaaaaaaaggaacagaaaaaccuggacaaauagaaaguacagaaugagauaauaaaaucaaauucaaauaguuuauuaucaugagaaauguaaauggaccgaauuuaccaguuaacagacaggauuguaacacuucuaauuacauuccguuuuuuuuuuuuuuuuucagacggagucuugcucugucacccaggcuggaguggaguggugcgaccucggcucacugcaaccucugccuuccggguucaaacgauucuccugccucagccucccgaguagcugggacuacaggugccugccaccacgcccagcuaauuuuuuguauuuuuaguagagacgggguuucaccguguuagccaggauggucuugaucuccugaccucacgauccgcccgccucagccucccaaagugcugggauuacaggcgugagccacugcgcccggccuacauucuguuuuaagaccaugacuaaaggccaggcaccguggcagguaauuccagugcuuugggaggcugaugcaggagcagcaccugaggccaggaauucaaguccggccugggcaacacagcgaaacugucucuaaaaaaauaagaaaaucagucagguguggugacaaaggccuguagucccagcuaguagguaggcugaggcaggaggaucgcuuugagcccaggacuucaaggcugaagugagcagugaccacaucacugcccuccagucugagacucugccucuaaaaaagaaggccgggcgcgguggcucacgccuguaaucccagcacuuugggaggccaagacgaguggaccacuugagcucaggaguucaagaccagcccggccaacauggcaaaaccccgucucuacuaaaaauacaaaaauuagccaggugugguggcgugcgccuguaguuacagcuacucaggaggcugaggcaggagaaucgcuugaaccugggaggcagaggcugcagugagccggggucaugccacugcacuccagccugggcaacagagcgagacucugucucaaaauaaaauaaaaaagaaaagaaaaagaacaugacugaaacacaaggccacagaaaggcugaaagcuuguuccagcccuuuagaagccauauuaugaugugguagaaacagucccggucucagcccucgggggucaaagucuggugggaggcacaugggaacaacaccugaucccagcccucccuggucacagucuggcgagggagauacaggaccaggccuggugucuuccuucaagggucacaaacugcucacgaccaccaaacccaguccugugcuccggggucacgguuugguaagagacacaggaaccaggcgugguccaguugcacaggucagcgucuuaaaccguucaacaaaaagcuauucccucccccacguaguccugaaaacugcaacugggggacagaggaaagaaaacgaaucagaacuacaacccucggugccagcguuuggaaagccagagccuccccgcgagagcgugcaacgccgucaaccugcagggaagagacggauauugaaaggccggugucuggcgugcagcgcuagaacggaacacaaagccggucaauccgaaccagaacccuccagucccgcugcccaaugagaagacggaucuucuguccucuggacaaccgugcgguagcugggggucucgcgcaggcgcaaaagggcgguggggggggcggguggcaaagggucucgcgcuggcacgccgagggcuggccgcguagccggggagagcugggggagggagcaggggccggguggagggcacucaccaaggcgcgcgacggcagcggccucccacgcuggcuccgggcucucuuuaggcugggucucgcgcucugucacaucccuaguucgggcucauccccuaguggguucucuugccuuacggagcgagccaaugg

SEQ ID NO: 192808 - RNA, 6941 nt, Homo sapiens
ccauuggcucgcuccguaaggcaagagaacccacuaggggaugagcccgaacuagggaugugacagagcgcgagacccagccuaaagagagcccggagccagcgugggaggccgcugccgucgcgcgccuuggugagugcccuccacccggccccugcucccucccccagcucuccccggcuacgcggccagcccucggcgugccagcgcgagacccuuugccacccgccccccccaccgcccuuuugcgccugcgcgagacccccagcuaccgcacgguuguccagaggacagaagauccgucuucucauugggcagcgggacuggaggguucugguucggauugaccggcuuuguguuccguucuagcgcugcacgccagacaccggccuuucaauauccgucucuucccugcagguugacggcguugcacgcucucgcggggaggcucuggcuuuccaaacgcuggcaccgaggguuguaguucugauucguuuucuuuccucugucccccaguugcaguuuucaggacuacgugggggagggaauagcuuuuuguugaacgguuuaagacgcugaccugugcaacuggaccacgccugguuccugugucucuuaccaaaccgugaccccggagcacaggacuggguuugguggucgugagcaguuugugacccuugaaggaagacaccaggccugguccuguaucucccucgccagacugugaccagggagggcugggaucagguguuguucccaugugccucccaccagacuuugacccccgagggcugagaccgggacuguuucuaccacaucauaauauggcuucuaaagggcuggaacaagcuuucagccuuucuguggccuuguguuucagucauguucuuuuucuuuucuuuuuuauuuuauuuugagacagagucucgcucuguugcccaggcuggagugcaguggcaugaccccggcucacugcagccucugccucccagguucaagcgauucuccugccucagccuccugaguagcuguaacuacaggcgcacgccaccacaccuggcuaauuuuuguauuuuuaguagagacgggguuuugccauguuggccgggcuggucuugaacuccugagcucaagugguccacucgucuuggccucccaaagugcugggauuacaggcgugagccaccgcgcccggccuucuuuuuuagaggcagagucucagacuggagggcagugauguggucacugcucacuucagccuugaaguccugggcucaaagcgauccuccugccucagccuaccuacuagcugggacuacaggccuuugucaccacaccugacugauuuucuuauuuuuuuagagacaguuucgcuguguugcccaggccggacuugaauuccuggccucaggugcugcuccugcaucagccucccaaagcacuggaauuaccugccacggugccuggccuuuagucauggucuuaaaacagaauguaggccgggcgcaguggcucacgccuguaaucccagcacuuugggaggcugaggcgggcggaucgugaggucaggagaucaagaccauccuggcuaacacggugaaaccccgucucuacuaaaaauacaaaaaauuagcugggcgugguggcaggcaccuguagucccagcuacucgggaggcugaggcaggagaaucguuugaacccggaaggcagagguugcagugagccgaggucgcaccacuccacuccagccugggugacagagcaagacuccgucugaaaaaaaaaaaaaaaaacggaauguaauuagaaguguuacaauccugucuguuaacugguaaauucgguccauuuacauuucucaugauaauaaacuauuugaauuugauuuuauuaucucauucuguacuuucuauuuguccagguuuuucuguuccuuuuuuuuuuuuuuuuuuaacuuccugccuauacacacgcagccaucagcccacaaagacaugacuaccaacgcgggccccuugcacccauacuggccucagcaccuaagacuggacaacuuuguaccuaaugaccgccccaccuggcauauacuggcuggccucuucucugucacaggggucuuagucgugaccacauggcuguugucaggucgugcugcgguugucccauuggggacuuggcggcgacugucccugugcugguuugcaguguguggguucauucaccuggugaucgagggcugguucguucucuacuacgaagaccugcuuggagaccaagccuucuuaucucaacucugugaguccugauuucuuucauaugcugugggaugggauuugcugggcagggaucggcuugcauguuuaccuauccaccuauucuucuuccauugauuuauuuuaaauuuuuauuuaaucuuuuaaaaaauuuauuauaggccgggcacaguggcucacgcuuguaaucccagcacuuugggaggccgaggcagguggaucacuugaggucaggaauuugagaccagccuggucaacauggcaaaaccccaucucuacuaaaaauacaaaaauuagccaggcgcgguggcucaagccuguaaucccagcacuuugggaggccgaggcaggcagaucacgaggucgggaguugaagaccagccaggccaagaugaugaaaccccaucucuacuaaaaauacaaaaauuagccgggugugguggcacacgccuguaaucccagcuacuagggaggcugaggcaggagaauugcuugaaccugggaggcggagguugcagugagccaagaccaugccauugcacuccagccugggcaacagagugagacuuugucucaaaaaaaaaauuauuauguauuguuauuauuauucuuuuuguuuuuugcccuucucuaaaacugguagauaacuuauuuuugagacaaggucuugcucuguugcccaggcuggagugcagugguaugaugauugcucacugcaaccuccaacuccuggguucaagcgaucgucuugccucagccuccccaguagcugggacuauacuauaggugcacaccuuuaugccuggcuaauauuuucacuuuuuuguagagacaaggucuugcuauguugcucaggcuguucuuuaacuccugggcucaagcaauccuuccaccucagccucccaaaauucugggaugacaggugcgcaccaccgugcccagccuuauuuaacuuuuuuguugcauguauauucacgugggucaaaaaaccauuuaaagagauuugcagugaaaaucugcuuucuauccacuaaguuuccccaaacgcuguuaggcacuguugauaguuguuuauguuucuuuucaguuuauuuacacacguaagucucaauuugcucaauuguaaaaggaggauaauaguaauaaccaacuauauguaagauacuuagaacaguguuuggcaaacagugguugccauguaacuguucacuauuauuaucauuauuugcacuuuucccuuuuuacacaaaugguaauaugcuauauauacuucuaaucuuuucucuuuuucuuucuuuccuuacaagaaaaccaaagaagccauuuucuuuuuugagacggggucucgcucugucacccaggcuagagugcaguggcaugauuauagcucacugcaaccuugaacuccugggcaaucaagcaauccuccugccucagccucccuaguagcugggauuauaggcaugugccaccccaccaaguuauuuuuuuuuuaacaacuuuuuuuuuuaagagauggcgucuugcuuuguugcccaggcuguucuccaacuccuggcuucaagugaucugcccaccucagccucccaaagugcuaggauuacaagcaugagccaccgcacccagcugcuuuuuuuaaugaggucacuccucaugauuucauaaagagcuuucaaagcauggacauuguacaguugcuugacuuguguaguauugaugggcauuuucccucaaucuucugccauuauaaacaaggccgggcagaguggcucaugccuguaaucccagcacuuugugaggcgaaggcgggcagaucaccugaggucaggaguuugagaccagucuggccaacauagugaaaccccgucucuacuaaaagucuaaaaauuagcugggcgugguggcaggugccuguaaucccagcuacucaggaggcugaggcaggagaaucucugggaccugggaggcggagguuguggugagcugagauugcgccacugcacacuccagccugagcgauaagagcaaggcuccgucucaaaaaaaaaaaaaaaaaaaaaaaacauuacaggcaugagccauugugcccggcuggucagauguuucuuaaauuuuagucauuccaguagaugugagugauaucucauuaugguuuuaauuugcuuuuccuuagugacuaauggaaguuugaacaucuuucauauacuuauuggccauuuagaaauccucuuugugaagaaccuauucaagucuucugccuauuuuauauuggaugaucuuuuucuuucuuucuuuuuuuuuuuuuuuuuugagacagggucuuacccuguuguccaggcugagcacuguggugcuaucauagcucacugcagccucaaccuccugggcucaagacauccucccacugcagccugggacuguaggcacgugccaccacguccagcuaauuuuuguauguuuuauagaguugggggucucacuauauuguucagacuggucuugaacuccuuuaugcaagccaucaucccaccucagccucccaaaguguugggauuacaggcaugagccaucgugcccggcggucuuuuucuuucugauucucugcucacucuuguauucacucaucuguucaccuacauucucucucucucauuggcuacuucacucacuccaucaucuacaccugcuuccuuuuauaccacacacacuucuugaguaccaaucacagccacacuguuuugugucaggcuuuacacauauuaccuuguuuuagagaaauaaaccacuagaauccaaacaguuaccccauuucacggaugaggaagcagacgcaugggaagguuaugaagucugucuucuugcagggacccccagcucucacaaguguguguuccuuucacugccuuuauucuucauaucucucucuucuuuucuucagggaaagaguaugccaagggagacagccgauacauccuguaaguguuugccucugucaauggagacuggcauugguuuucgggggguggugaguuggggagcacuaaugggcuaaccuguaggaagagcacaccgauaccaguguccccucaugcuuucuccugcaggggugacaacuucacagugugcauggaaaccaucacagcuugccuguggggaccacucagccuguggguggugaucgccuuucuccgccagcauccccuccgcuucauucuacagcuuguggucucuguggguaaggaaagggcacuagaggggcacugggcacuagagggguugaugggggauccacagacacagauguaucccugugggugggaucucucaacggugcccuuccagggguaagucagacugaaugacaaacccccugaggcucuggaaaggucaugcccuucucugagccugcacucucagguggggaggguucauuuuucuuccuccuccuccuucuccaucacaaagucuccugugaagguuacaugagguggcccaggguggcaagaagccccuggaaccuccaggaucagggcucugagaucccuucauguaagauucugucauauuuuuuuuaaaacagggucuggcucugucacccaggccagagugcuauggugugaucucggcucacugcaaccuccaccucccagacucaagcgaucuuccugccucagucuccugaguagcugggacuacaggcaugugccaccgugccuggcuaacuuuuguauuuuuaguagagaugggguuucgccauguugcccaggcuggucucaagcuccugagcucaaacaguccuccuggcuuggccucccgaaguacugggauuacaggugugagccacugugcccggccucagucaucuuguguuauuaaauuguuagcuuucuuuaguucuagcgauaugaguuaucuuuagucccagaauccuaagcugucuuggauuugaggauuuugaacuuccuuaaaucugaaggugugagcucuccugaguucugaaauucucagcucucuggugucuggaaucucacuuuucugauuucucagauuuucagcucugugauuucagaauacuuagcucugagaccuugaaugaugacuuggaaagugcuuuggaauagagaauuggcgaaaguguccccuuccucacuggggcuucuccuuccccuccugccacccacaggccagaucuauggggaugugcucuacuuccugacagagcaccgcgacggauuccagcacggagagcugggccacccucucuacuucugguuuuacuuugucuucaugaaugcccuguggcuggugcugccuggaguccuugugcuugaugcugugaagcaccucacucaugcccagagcacgcuggaugccaaggccacaaaagccaagagcaagaagaacugaggagugguggaccaggcucgaacacuggccgaggaggagcucucugccugccagaagagucuaguccugcucccacaguuuggagggacaaagcuaauugaucugucacacucaggcucaugggcaggcacaagaaggggaauaaaggggcugugugaaggcacugcugggagccauuagaacacagauacaagagaagccaggaggucuaugauggugacgauuuuuaaaaucaggaaauaaaagaucuugacucuaa

SEQ ID NO: 192809 - RNA, 10204 nt, Homo sapiens
ggauacgucgacaauagaugacggggcucacguuguacguucacaucaggucccggcccgccggaaccugggcgauccacgaugccgaguuugccacgcugcgacagcccauaggcuugcccccccgggcauucggguggacuacgaacacaaacugaagcccuaggacuugucgcccguuugcgcucucgccgaggcacaggcugcucgcggaccacccugcuccgaaaacuaaggugggcccuggggcgcggaggacaggaaugcgggcggaggcuauugaggcacgccugcacugucccgccugcggggaaaggagggagguccgcccugggcgccguagcuguguaugguucgggcggcuggcaccggguggguucuagacccaagguuugucugcagaaggggaccaguagacgggguggauucgagguggggacaugggacgcagcggucggagccgccuggagggguacccgguggucccgauggagcuaucaucuuugagguauugaugaggagggacggggaguguggucagaaggcuguuuugggagguuggguggagcgugagggugggguguuacuggggaaucaaugggggcuaauaagaauauuuuagucgaacuguuguucauugauugauuaaugaggggauggcagaguaagcaacuagaauauaacgagugauggaugggaaaaugaucccccagguauugauggagguaugauauucaacggguuaauggaaagugauggggcaucguaauggcaaggaugauggugagguuguggggggaauaauagauggauggaggucaugaucaaggggccuuggugaaagaaaagauaaugagaggcugaugguguuguagucagagucaguaguugggcuaugguggcaugaccgucgaggaauuaggggacagagugaguaaagagagggcaauaguaaacuaggguuggggggguuaacuucuguugauacauaguaggugaauaguaaacuguuggagugugaucauccagugauggauccauggagagcaggguggacagugaggggagaauggggaacugaugugugaucaguuaacguguuuguuaaugaaagaguuacagggcaggaggcuagugcugugaucuaugaagggucuauuggagaaaacugaguuaaugggggcugauaaaucaguaauugaaugcuuaauggggagcuaauagaccaugauucuccaggcauuguuagagguucauaaggauguaguaauaaaggggccuaaucaucuaagggauuaauggcgaauggggugaaacgagagagauauagggagugggagguacaaugaaguaguauuaggauaaagguggaaaacaagggauuaaugggggcuaauaggacuauaugaaucuaggggcaauggggacaacuggggauacagucagugagauuuuaaugggcaugacaugagcagagaaggguugauaguggcaguugcaggguuuaauguguggagugugggugacagugaugggagguggacagguucacaagugggccaucuaugggaugaauguuggguuuauggggucuuuugugggaacugugggguaagugaugggggcgaggagggucugugugauaagcaguggagccugagaguucagugauuggguccuucaggcccuauaaggucaguggggucagugccagggcuucagucagcccaucuucugugugagcugucaugugggucagaugagcccaguuuaguuugugugguucucuccgcccuacagagguaggugguagcccauucaucugguuacugauacuggccggcaucaguggacugucggcagguccuugagcaacuggugugugaaaugggacggacgucaaaggacaagcgggaugucuacuaccgccuggccaaggagaauggcuggcgugcucgcagcgccuucaaacugcuacaacuggauaaggaauuccaacucuuccaaggucccugacuggugggcaggucacugggcggugaggugggcacaggagguaaacaaguaggcugggucugcagagcucccugugguaggugggcugacucagagggucucuggggcagggagacaggcaggaagauaggcagaauaccggagaggaguugggcaccugggcaauggagauaugugggugcuccccaggggagaggggugaauuuugcaagggucuccagguuggagaagugggugcagcugaucaggaugcuuucacuauguaugcccaggcgugacacgggcaguugaccugugugcagccccaggcagcuggagccaggugcugagccagaagaucggguaagugugggggucccagaugggagacccaggagggccggcugggugggaggggcccgggagcgaaacuaggcugaugugggccauguuguccacaggggccaaggguccggccacgugguggcuguggaccugcaggcuauggcuccacuaccaggugugguacagauccagggggacaucacccagguaagagcauggcugaggguguugggguauauccugggugaaggcccuuaccuggggucuaugcagaguggaagagaaacagagaggugauagaaacagagagagaaagagagugagagaguaaccauggagaaacagucagcaggucaucauugcacagacacagcagaaaaugaugaugcuggguccccagagguggagcccagucuuagagaggcaaagccugggaauuuggcugacccaggggcugugggccaggaccaugggcaggcgggaucugagggcagcaguggagggccguggggccacucauccucccucucuccauagcuguccacugccaaggagaucauccagcacuuuaagggcugcccugcggaccuaguggugugugacggggcuccugaugguaaauagcaacagaaagugggaggccaggcggggcccccuguguguguccuucucuguaucucccaccuugguugacuuauucaccucuucaguuacucccugccucucccuuccgcacucagcuuucucccacaucuggcaacuucucccuaccucugcugccuguucucucucugccucucucuuccucccacuugcaccccacccuuugaguuucaugucuguugucuaccuuucccugcucucaucucucugcaacuguccaauuccguugcacuguucauucauuuucagccagccagccauucaacacacauuuacugagcaccuauuguguugggaaaacauucaugaauaaaauuccauuaaucuuuaaccucauggagcugauguucuagugggagcaaaugggaaagaaaauaaaugauucagcucuguaccauuaaaaggggauggggccaggcaugguggcuuccaccuguaaucccagugcuuugggaggaugaggugagaggaacacuugaggcaggaguuugagaccagccuugcaacauagcaagacccugucuuaaaauauuagcuggcauggugaugcaugcccauagucccaguuacucaggaggcugaggugggaggaucacuugagcccaagaggucgagguuacaguacacuuugaucgcaccacugcacuccagccugggcaacagagugagacccucucucuaaaaaaacggggugaggaggccgggcacaguggcucacgccuguaaucccagcacuuugggaggcugagguggucagaucaccugaggucaggaguucgagaccagccugaccaauaugaugaaaccccaucucuacuaaaaauacaaaaauuagccaggugugguggcaugugccuguaaucccagcuacuugggaggcuaagacagaagaaucgcuugaacccgggaggcggagguugcagugagcugagaucgcaccauugcacuccagccugagcaacaagagcgaaacuccgucucaaaaaaaaaagguggggugggggauggguaccauagggaaaucauugagcaggaggaaagcaggaguaccuguuggaauuuuaaaucaaguggauggggaaggccucacugacuuaacagcagagacuaaaggaggugggggaguaagcuauggauaugucuggaggaagagcaauccaggaaaaauugcagcccgugcaaagguccugaggcaggagggugcuugcuauguaugaguaaugacaagcagaucacugugguuggaacagagugagggggggagagugguaaaagguaacaucagagagguaacaggggacagauccuauagggccucgugggccauggugaggcuguuggcauuuucaccgagaugagagcuuggagaaaaccaugagaggguugugaggagaagaggacugugcugggcuugggcuacuaugagcugugugagggccaagggcagaagcaggggcuccgggguggaguaguccaggcaagugauaaugggugagggcagugguggagaggagaagaucaagucagaucuuuugaaaguagauguguuaauggcuucgaugugggugugaggagaggaugcggggggagcaucagaggugacuaagguuuuggauuugaacaauuagaaagcucagaugagauggggaggauggugggaggagcagguuuggggagguaggucaggaguuugguuguggauguauuggagauguagaaucugauuugugaaucuggaguucagaggaacagucugggcuggagguggaaaugauaaugaugcuugugugugagguuguuuuagaauugaaaugaguuccuaaggguuaggagcucagaauaugcauccaguuggcagacaguaauuugcaucuggaaccuuagcaguaagacagccuggaaaauguauuuagugucugaucugugugguacaagaagaugcacagagccagaugggaccccccuaacgcuguuccucuugccacaguaaccggucuccaugauguugaugaguauaugcaggcccagcuccuccuagcugugaguaacccuggccaccccugacccacuuuggcccccuccuggcugucuccaccucagccucagccgucuguccugcccacaggcucugaacauugcuacacauguccugaagccagggggcugcuuuguggccaagguaagucucaaggaacuugguggaguagagggaggucgcugagggccacccucacccgcugucuuugccuucucacccugcagauauuccgaggccgggaugugacgcuccucuacagccagcugcaggucuucuucuccagcgugcugugugccaagcccaggagcagccggaacucuagcaucggucagugggguggaggggccaggcaggcagagggggaucucugggacgccgacugcacgaggaggaagcggcagucaugccucacuccaccuuccccuggcagaggccuucgcugucugucagggcuaugacccucccgagggcuucaucccggaccugagcaaaccccugcuggaccauucuuacggugagagcuggagcaugggccacccugggggacucugccacaccuuaugcaaucuaggucccaugagggcccacagucucacccccugggggaggcucuguccccucaugggaauuuuuuucccaaggggauccuuagccccauucucugauggaaaucccaccccuuuauggguauuuugucccgggaggagcuucagcccaggcaguccucuagugguaacucuugggccuggugaaaauuccaucccaggaggauccugagcccugccccaguggagacuccaccugccuaaggacauucucuccuaggaagaucucagucaugucccagguggaaaccuccucggugugaaacuuuugccccuuaagccucuagcaggaagagacagagccugccccugggaugacauuugagugagggagacgucauccaggcagcauauaauccaauaucagguggacauaaaugcagugaaaaauagcagggcaccgauguuuuagaaggggugauuauggagggccuccccgaggaggugaucugaaccaaaugaaggauuucugguggggugggaagagaguagcugguggauauguggggaggguuuggcagccauaccgccgccugugucaugacuggccccaggcauccugaccuuguccucaguugucucccccuguuccuaagacccagauuucaaccagcuggauggucccacccgcaucauugugccuuuugugaccuguggggaccugagcuccuaugauucggaccgcaguuacccacuggacgugagugcccaaccaacaguaggugggugggagggaggcuguccuagguuaccagguccucaccaucucccuaccccucugucccugcagcuagagggcggcucagaguacaaguacacuccacccacacagccccccaucucgccaccauaccaggaggccugcacguugaagaggaaggggcagcuggccaaggagauccgcccccaggacugccccaucagcagaguggacacguuuccccagccccuggccgccccucagugccacacccugcuggccccugaggucuggaaaugugacucucagccugccuugaccccuuccccgugugccuuuuucugacccaaaucucaugguuucuggggccaaaauucccuuuccugccucccaauagcuauaaaaaauugguaaagccaagcauaaugaauggaaaaguuucgccaaauaugugagucacuuuucuuuuucuuggguagauggaagacaaugaaaugaguuguucaccuuaacccauuacgguaaguuugccuuguuaucuaagaguuugaguaagggcaaccuuuaugaaaaaccucaguaaaauuucaccuuugaaauuuuuaugucaacugauaagauuuuaaucaacaaacccuuuucuaaacaucuguuguuguaugccaggaacugcuuuaagcauuuuacauuugaggcauucaguaaacauuuauugagcacauacuguaugucagguguuguucuagguuuggagauagagcagggagcaaaacagaaauaucuuggcucucacaguacuuccaguuuggaaaagaggcaacaaucaaaacagucuguaagugcaagaguuuacauacacauauauacuauauagcuugcauuucucaauuuacauaucuugcaauauauauaauauauaagaguaauaugggauauaaaaaauagaaaaaaguaaagcagggugaagagaaucaggaauucuaggcauggcaguuuucaucuuuugguguuuuuguuuugagacaaggucucacucugucgcccaggcuggaguucaguggugugauuucccgggcucaaaaaauccucccaccucagccucucaaguagcugggacuacaggcauguaccaccaugccuagcaaauuuuuguauuuuuaggggagauggaguuuugccauguugcccaggcuggucucgaucuacugggcucgagcgaucugccauccucggccucccaaaguaccaggauuacaggcaugagccacugcgcccagccaguuugcacuuuuuaaaaggguugucauagaaggccucagacauuccucagagguaauguuugagcaaagaccugaaggcacugccggagggaagccauguguuuaucugagggaagagcauucuggguaaaggaaauaggcaugucccaaagguggaacugcacgugguaugggaggaaaguuuauccauagccaaauguucuaaaaccacgauguuagaggauggcccuuucugacaauggcauagcagguuauucagacuaagucagccaucacaaaaagccaccuuuuuuuuuuucuugagacagagucuuacucuguuacccaggcuggagugcaguggcaugaucucagcucacggcaaccuccaucuaccaaguucaagcgauucuccugccucagccucccaaauagcugggauuacagugcccgccacuaugcauggcuaauuuuuguauuuuuaguagagaugggguuuugccauguugaccagacuggucucaaacucgugaccucaggugauccaccugccucggccucccaaaguguugggauuacaggugugagccaccacaccuggccuuuuuuguuuuguuuuuuguuuuguuuugagaacagagucucgcucugucgcccaggcuggguggagugcaguggcacuaucucagcucacuccaaccuccgccucccggguucaagagauucuccugccucagccuccugaguagcugggauuacagacgugugcucccaccucacccggcuaauuuuuguauuuuuaguagagacgggguuucaccauguuggccaggcuggucucaaacuccugaccucacaaaaucugccugccucaggccucccaaagugcugggauuacaggccugagccaccacaccuggccacaagaagccaccuuaagaaaaaauugaaacagcaaaucauugugugaaagagauuuacaguuuuuaauauuuaaaggguccuguaaaucaauaaggaaaaacaugagaguggccaguaagcacaugaaaagcugcucaucaggaaaauacaagugaaaacucaaaauaucaacaacacuaaguauuugaaaggauaugcagcaauugaaagccucguacaugcuacugggaagguaaaauggugcagccacuguggaaacuuaggcauuaccuacuaaagcugcaugugugccaguuccacuccuaagaaaugaguccuagaggccgggugccguggcucaacgccuguaaucccagcacuuugggaggccgagguggguggaucaccugaggucaggaguucaagaccagccugaccaacauggcaaaaccccaucucuacuaaaaauacaaaaauuaaccgggcaugguggcgggcaccuguaaucccagcuacucaggaggcugaggcaggagaaucacuugaaccugggagguggagguugcagugagcugagaucgugccacugcacuccagccugggugacagagucagacuccaucucaaaaaaaaggaaaugaguccuagaguguugcuagcagcacuaucuauaguauaugcccauuaaaucgugguacauucaccguggagaacuguacaacaaugacagugaacauccugcaauuacaccaaauaacaccuuguaguuauucauuaaacugaacauauauagguuuuaugcauuuucuauaugucaugguucaccauaaaaggaggaaaugucacaaaaauguuagcagcagaguuagcuaggugugguggcacauuccugccuguaaucccagcuacuugggaggcugaggugggaggaucacuugagcuugggagguuaagguugucgugagcuaugauggagcuccacugcacuccagccugggugacagagcaagacccugucucuaaaaaaacaaaacaaaacaaaaaaacuuucuuugacuuuugguuagcuggcaaacugauacaacucagaaacugcucaaugucaggaaaaccggaacuuguugaugaacuuguuuucaaaauaucaucucaucaacgaggccuggacaaacaagcccugaggagggaucugcaacaacccugaagacaacaaggaaagaaaccaugaaagucugucuguacugcagugggaauucuugagugaggucuuaccucuucuuuaaaccucuucaggaguguccugauuauguccagaauuuucccuaaaggcagggauucuuaaccuggauagaagccagggguaaccaugaacuugauggaagaaaauguuacaucuuuauuuucagcaaugaaacugaaauuuagccuuacucccaaguuauaaaugcuggcaacaaaucacaguaguaaaagcaguaccugggauuuucccaccaauacaaaccaguuacagcaacuguaauguaacauaaaaagggcaucuugaaguauuguucauauuugucaccucuuggaaugauagcagauccuguaaguugauguauuaauuaaaaagcccauauauuacugcaucucaauuuuguuucaauuuaauauauaguaauaauuguaauucaauguaauuggcuuccauugu

SEQ ID NO: 192810 - RNA, 10544 nt, Homo sapiens
aacguuugcaaagguuuauuaacuggcagugacugauagaggggaaucggaugaggggaguacaugcugaacaggaaacagagugaggggggcuugaccaggacacauggggaaaagcaguugggagaugccuauacugguacuuggugugugugugugugugugugugugugugugugugugugcgcgcgcgcgcgcaugugugucuguguggcauguguguguguuuguguaaaugcagaggaaaaaaucugaaauuaaacacucagaacugcccucaguggucacaucugggaagagaggaggguaguguuguucuaugcagagaauaccugacgauacuuguuuucugagguaggugcauggauacacaaacugaaauaugcauuaaguaugucuugcucaucagugaaaacgcuaauaucuaacagaauggcacacuguaacaaaauacaacagaaacacuaacaucgaacucuuggcacacuaagaaaaaugacgcucaacuuuucacuguugugaacacuugcuuucacuugcuauacaccugaugacgagggauccgcagccaugcccauguucgugaaaggucaccacguucugcuucucaucaugggcaugugucauauccccgaggcugaggcaagaagcgagaaggaaaguaaguggcagugaguucccaccacaugacaacucaaucucaacuccuccugaccugcagacccugcccacuccgauucugcccuaccucaggaccuguacacgccuuccaugguuccuugaagugaaccaucugcucauaccacagugacuuccucgccuggguuaucaauuccuaggcuagaggaagguguggcccgcauaucagugcugaccugggguuugggaacccacagcauccuggguagggaggaucccuggauauagagggcagggaguagaaagagcaugguuaggcaggcgcagaggcucacgccuguagucacaacacuuugggaggcggaggcagauggaucacgaggucaggagauugagaccauucuggcugacauggcgaaacccugucucuacuaaaaauacaagaaaaaaaauuacccggucgugguggcgggugcuuguagccccagcuacuggggaggcugaggcaggagaauggcgugaacacgggaggcggagcuugcagugagccgagaucaugccacugcacuccagccugggggaacaaaaggagacucccccacccacaaaaaaaaacaugggaaauuucaucauucagccucaaugcuguacccuagaaaauuaugagaagggaaugauuuggggaacaacugauaagaugggauaccaguaccauaacagaauagcacaucugcaaggaugugggagaugagccaaagguucacuuacggaguuacucgucaucuuccugagggucgcugaucucuucauaaaucaccaguugcuuucucucacgcacucuguggguccaggcauguuucccccuuuuggguccuaugauggagaagaguuggaagaugaggguuggguagauuggagaggguuggguugauuggagaguguuaggcucuguuuucuccaaaaaaggagaugccuccccaccaccaagugcccaugggucuucuuuauccaguuuuucacauucucuggcuuagagaggcugagaccuuagacccacaccaauacaggccaaaugcaaauuaaaguuuuagcuucuggcuccuuccguugucagguuuagauucccaaccucuucacuuacgggaacauucacccuuaccuccuuucauucagcacguauuuauuaaggccacacaggcguaccuuguuuuauugcaccucauuuucauacugcuucacagauguugcaauuuuuuuuuuggaaauucucaccaauuuuacacuuuuccauuauuauuauaucuguuauggugauuugugaucagugagcuuugauauuauuacugcaauuguuuuuauuguuuuuuagucuuuuaaaauaauuucuguuuuuuauuuuuguggguacacaguagguguauauacuuaugggauacaugagacguuuugauacaggcaugcaaaugcguaaaaaucacaucauggaaaauaagggaucuauccccucaaacauuuauccuugguuacaaucaauccauuuacacucuuuuaguuuucauacugcacaauuaaguuauuauugacuauaaucacccuguuguauguaauuauucuggggguaacaggaacugcacucauagaaguugacaaacuuaaucgacaaauauuguguguguucugacugcuccaccgaugagcucuucccugccucucuuccuuuucuugggcaucuguauuuccugagacauaucaacaccgaaauuaggaagauuaacaacccuacaauggccgcuaaguguugaaaugaaaggaagagucgcaugucucucacuuuaaaucagaagcuagaaauggcuaagcuuagugaggaagcaugcugaaagccaagacaggcugaaagcuaagccucuugcaccaaacagccaagcugugaaugcaaaggaaaaguucuugaaggaaguaauaguauauaaugcaaaggaaaaguucuugaagaaaauaauaauacuaauacuccagugaacacaagaauaagaaagcaaaacugccuuacugcuuaaaugagaaaguggucaggauagaagacgaaaccagccacaacauucccuuaagccaaagucuaauucagggcaagacccaaacucucuucaaguccaugaauucugagagaggugaagaagcugcaggagaaacgugugaagcuagcagagguugguucaugagguuuaaggaaagaagccgucuccauaacauaaaagugcaaggugaagcagcaaacccugauggagaagcugcagcaaguuauccggaagaucuagcuaagaucacugaugaagguggcuacacuaaacaacagauuuucaauguagauaaaauagccuucuauuggaaggagaugccaucuaggacuuucauagcuagagagcauugacuucaacuuugaaagaaguucuacuguggguaaaaugcuauccaaaagcaucacauacuacagagaaagcauucaugaacggaagagcuaaucgauguggcaaauuucauuguugucuucuuuuaugaaacugccacagccacuccacccuucagcaaccaccaccuugaucagccagcagccaucaacacccaggcaggauccuccaccagcaaaaagagugugacucacugaagucgcagaagauuauuagcauuuuauacaaugaauuauuuuaaaauuaagauauauacauuuugagacacaaugcuagugcaaacuuaguagacuucaguauauuguaaacauaauguuuuuaugcacugccaaaccaagaaaaaaaugugugugacucacuuuaucgcaguggucuggaacugaacaugcaauaucucugaaguacaccuauaucggguaacaggcauugagcugaguaagauaugaucccagguaaucacagauggaauugcuucagcaccuuucaugucaucaggccuucuagacuuaauuuaaugccuccaaacaauuuaugaacugagauucuuuauuuccaacuuauaaacuaggaaacuggagcuaagaaaauuuggaagacuugccccaagucacgugguuuuuuuauaugaaugacaacuccagucugugucucuggaagucauguguaacaucucaucuggagcugggcgagcuccucagcccagccuggacccaggcuugucugggguccaugccacacacccaguccacacaccugaacuuagcgagaaaagccagagugguuguucccaaauucuuuucucuuaccagaugucuuguuaaccuucucagagguauuuaguuuuccugaggggcgcagcuguuucccauuguucugugggccagaugcuucuggcacucccuucgaaucauuuccuuccucugcuggcuucucgggcgugaucuuuauaaugugaaggucacagauaaacaguaucagugacauuucuuuagugcuuuagagcuuacaaagaaucuucacaugcauuaccuuaaucaauguucucaacaaugcuaggagaguuacacuugccuaaauuaggagaaaccugggaggggagguuagaugggaaaggaauggccuaacugaauaugguuuccagggauagaauucuucuuaucuucacacuguuuuaagacugacauucuugcaaacagcaaauaucuccauguaauugagaguuugguauacagaagauuuggagcauagcauucuaagaauucacaaggucuacaaagggaagaguuuccguaaaauacaagggaucccauauaagcucguagacagcugcugggagaguaaauguaaagacauacagaggggacaaaacacugcugaacaagaugguguggggagauguauacagggaagggagagggaaagaaaugguuugcugaaauuaauccaggcagcaaagaaagcaguaccagaucuggcauaccagccuaccgaggcaccaacauugaauguggaauucagugaggugguacccauaacaauucugguugcauugggauguaucacugaccaacacucuuaagcuacuuuuuuuuuuuuuuggauggagucucguucuuuugccaggcuggagugcaguggcaggaucucggcucacugcaacauccaacucccauguuuaagcgauucuccuuccuuagccuccagaguaucugggacuacaggcaggcacuaccacgccccgcuaaguuuuguauuuuuaguagagacgagguuucaccauggugggcaggaugaucucgaucgcuugaccucaugaucugcccgccucagccucccaaagugcugggauuacagucgugagccaccacgcccaguccuuaggcuacuuuuuauucagcuuccucacuuaugaaauagugaacaauacauguaaaauaggcuaagggaaggccucucugagcuuguaaacacuguuuaaauguaguaauaauaacaauuaauaccuuucaugauccuucuuugaauucggucuccacacuggcaacccaacucccagaucccuuuacccucuaaaccagaguugaaucugcacuuguagggucacuaauucaggggccuccgagggauccccugggcugggacugggacuucccggaugccccaggugcagacaaggcccucaaggagcucacaguagggaggggccaacagucaaagcgauuccuaagccaugcaaguggccccaguaacagaucagagaccagaugguccuuccuguugugagagugggucucucaauggaagcaccaggaggcccuacgggggugaagcccuagugagcaacaucugaacuucauaacaaaugcaaaugugaaugagcuuuaaauggcuuggagcucuggauuagacuaccacugccacugcgccucaggaaaauucuuuaacaucucuauacccggauagccucauuuuauuauuaugcugcugauaacuaugaucuaaaacaugaacuaugauucuuuacuuccauuucaugaaccaggaauccggagcucagaggacuuagaagauuugugccaagucgccugccuuuuauaugggugacaacugaagugugugacucauuauuauuuggagauaauagaaacaaugucuucuuaaggauuaaauaaauucauccaugugaacugcuuaaaauaguauuuggcaucacuaugaaaacaaaagaaguauuaaggaucacaacuguuaguauuagcaagccgucggugcuacaucagguguugugauagacauagggagaagaaggcagugagggcauuguugauauucucccacucuuacaggguucacauucgugaagggacaaagguucucugguccuuuagauuugagagacacucaccuucgggaagauucccuggagccugccgaaagucaucugaggauguucaacugaaagagaauacaucagaauuuuucuuuguugguaaagauuuccaaacucuagagagacuucaguugcaugagggcauucugcagcagagguuaugaguccacugauuguugaggaguuauuugagauuugcuucugaauuauguuuagucaugguuggugcauuuaucuguggcaucaauucagaauuuuccaucucaugguuuaucacauggggacuaaaccccaucacagucucaucuuuuuccauuacauaucuuuuacuuauucucaaauaauuaaauugauugguugggaaucugaacuguauccacucaagauguacaacaacugaaaaucauuuuacacuucaaaugggugaaucuuaugguaugugaauuaagcuguuaaaugugugaugaaccauggaugauuuaguccaguggcucugaaauauuuucaguacaaagacaguccuuuaacgucaaaaacuuggcagauacucaagcacuggcuuuucagaucucuuauagugauugugggagauuguagagucuggccuguuuaguuggcgaguaauaggucuauuggagacaguuuggacuuucugaccuugucuuauaauuguguugucagagcagaagagcaaguaaacacauauguccccuuuauaucccugaaauguacaaagaucucuaccgaagaaccugucuuuuuuucaccccauguuaucucuccucacugacaagugggaaagcucucuguguguuggaugagggaucacucuuucaaacucacucccgagcucaucacagagaaucaggguucuuugggaauuagaggacuauuugguuuugauaaaauacagggaaacagcagugcuuauuacauaauguguucaucaccuucacuccuaagauaguuauucaaacccacaugcuguuaaugaaacaaacucuggaaguuuuuggcggaucuacaguuguaacauuuucuuuuuuuuuuuucacuuguaacauuuucuuaacuguccuuugauucauuaacagugcuuaggaagaacaacaugucguuuaaaaaagaaauauuucaaacacacagaaaaguauggggaauaauauugaguccagucggaucucaacauuaccccacagcuauuuuagaucugauuuauuuauucagaauauuagaaauacuacaaacaggcugggcgugguaacucacaguuguaaucccagcacuuugggaggcugcggcggguggaucaccugaggucaggaaguuugagaccagccuggccaacauggugaaaccccaucucuaccaaaaauuaaaaaauuagcugggcguuugggugggcgccuguaaccccagcuacucuggaggcugagacaggagaaucacuugaacccaggaggugaaaguuggagugagcugagauugccuuacugcacuccacccuggccgagaagagugaaacuccaucucaaaaacaaaaacacacaaaacacacuaucaacaagucacagcugaagcugucugugccgcacucagcaaucccugcccgcccucccucccuccuccacuuacagccagucaccuuaauuugauggcuuuuuauucacauucauguuuguauacauuuaccacuuacuuauuaucuauaaaaauacauauucuuguuuugcauguuuuaaaauuuuauaugaauggccucuguaguuaacuuucugcaugcaauuuuuuuuuuuucacucagcccugauguguaugagggaacaaaugccugaggaucuuucccagguagcugagcugaaaagcaguugcgcuugaggagacccuuuccagccccuucccaucuacucacccugauucccacgguuagggucauuaucaaaaucauuccccuggaagucugcgacccguuuauuacgcaugaaaggugggaggguggccuugaaaccuagaaagaagcaaaauguuuauuccuuaagagacaagcuuaggccugguaugguggcucaugucuguaguagcagcucuuugggaggcugaagcuggaggauugcuugaggccaggaguuugaggcugcagugagcuaugauugcacuacugcacucuagccuaggugacagacugagacucuaagucaaaaaaaaaaaagaaagagacaagccgagagaaggaagguagggacgaugggggggugccagaugccacagagacaguugggcucaucagaacagacuccuaagggagagaaacgugcaggauccagguaugagcuccacuguggccagucccugcccucagcccugacaagauacagaagagcagagcacccagaagcugccuugccauuuuucccugcacaaaaggaaaacgugggguacuuucugcagccuaagaaauagccaaagcuggaaaagggaugcucauguauccccagacugucuguaccuagaacuuucuguuaccuaguuuagucauggccucauacuuucucuucauauacacauagaugauuuucuccgaggcuuucaucuuuucccacucuuucucagagaaguauuuggcaauaucaucgaaggccuagaaaaaaaaaaaggauuucugauagugacucagcuaggcaugucugccauucagcuggagccgcuuccugugugcuggaucugggaaguagggaugauaauccguccugguugaugccauggcuaacugacagaacauggggcaccuacccuagcuucuccccugccacacaguagagcuuuaaugcugcuggcuggcucucuucccaccuuccagaacggacugagauucaccaaauguauuccacggucacagacuugucuccagggaugcuaggugaugacagagcgagagugagaggcucccaagguuccagauguccccggagacccugguccuuguccccaguaccucuguccuccccuccucagaaaacugaucaccccacacuguccccugggccacuacuaugcccccugcaggucaccucaccuuuugcaucuucucugguauuugagaaccaacccuaggucuccguacaaaggcaucgucuccguucauggcaccgggagcacucuguccuacaagagaaacagucugagucuuuccagcugcaggaccuuuggucccauggagggagaaaucagugaagucuggccacacucagucaccuggaaucaggaguugcauuucuccauccguggcuuaucugucccugaguaaggccauggggagaagucagaugaaaacagggagccaggggucucugggagaaguauugauuggggaugacauguuuccuaugggcaaagcagccuugagucuuuggaggggguuggcuaauguuguuaguaguuucccugaggccaggcuuacccugaaagauguacagacccuuguugggaaggcagagaugugacuguguaauuuuauucagugggggcguucugacacccucacucaaugaauaaaggaagggaagugagucccagagauaacauggucucucuggugauggaucugaucaggcagagggauggggguucuguucuguugaagagaaaugagcaucgcuacuaugaacggauuuagaagcuauuacugggugauuuguaaauuauuagaaggaagagagcuagaauuucugagacuacaagagcccgggaacacuuagagagaaugugggguguuucaacaugcacaaucagccaggcucgguggcucacuccuguaaucccagcacauugggaggccaaggcgugcagaucgcuugagcccaggaggucaagaccaggcugggaaaaauagcaaaacucucgugucuacaaaaaauacaaaaaguuagcugggggugguguagcaggccuguaccaucccagcacuuugggaggccaaggugggcggaucacuugagcccaggagcuugagaccagccuggucaacauagcgaaacaauuucuacuaaaacaaaacaaaauaaaaacaccuuagcccuuagcagaagugggauggugugcaccuguagucccaaggccuaggcaacaggaucacuugagcccaggaggaaagauuugagugaguuuuuuuuuuuuuuuuuggucagacaaggucuugcucuguugcccaggcuggggugcacuggcgugaucauggucacugcaaccuccgccucauagguucaagugauccaccagcuguggccuccaaaacugcugggauuacaagugugagccaccgcgccccgcccaaauuucuuaaguuacugcagaguucccaggaaaaaucccauacuugaaaaaguuagaaacugacaggaaagauuugagauggcgaccugccucauauacacuccuuauuaaaacuagauaacaaaugcaccacggaggaggggagggguaggaagaauggaaaaagaaaaucagcaaaugcuuacucugauuuuggaagaaucgaaacaaucagagcg

SEQ ID NO: 192811 - RNA, 45445 nt, Homo sapiens
gggucgucagggcgacgaaaaaggggaaggggugcugggccuggcgggcaaacuaaggcugcggaccguugggcgguuccgcggggcguuguccggagagcugcgaggccgggguucccaggguucacgccacacucuaggaagugccugagcuagugagcuggccaacgagcuccgcgggcugggaccaugggcugcuucuucuccaagagacggaaggcugacaaggagucgcggcccgagaacgaggaggagcggccaaagcaguacagcugggaucagcgcgagaagguaaugaaagucguguagccgccgucucagccucccugagccgcuccgccaggucccuuacggcccgggaccgcugagggggccgacccaacugcugccgcacucucuugaacgcggauagcugaagucggggugcacgacuuuuuuggggagcggggacgugaaguacagcgcuagagaggccgcccagagggcuguggagcuccggaaggagccuuaggaguuuguugucgugguagacagacucccccgggagcuuucucugacuccgaacccugccuugcucugacuuccuguuggagaugaucgauucgagagagggaaagagccgagaacgcccugaaucucaaaucaccucguuucacccaccggcagcgucaagcgggguuuuguccagucgucgaguuacguauaugggaccgauucucaucucuuccggggcuuaauguucuguggcuguuuucucuuuugucugcccuccccggcaaaucucuuuggugccucaugauauauuucacugcugaauuuucucaauuaccaaguggacuguuuaauguacagcuuuacucccccuccucuuccaguuauccgaaagaaauaaugaauaucgcaucagucuuggaauguguauuaagacuguaaggugaaaauaagcggcauaaaccaggcaguauuuuacugcugguuuaaaugaaugaaaacgcccuuauuuuuauuuuuguauauagccagaaacgaaaaaccuuugaaaaccuccauuagucuuacacaaaacacacucggucauacauuucauaauaguuccucuuucuacauaguucuccauuugugcuuacuaaacuacuuugauggacuuaucaauuauuucucccaaacaaaaugagagauuuuucaaauggguauuaugaacaguuaacucuuugcuuaaggcaacauaucuuuacccaagauuacuuuauaauaaauguauuaacguuuuggaaucacagaccuuucugcaugauuuccaauccccagcagaauguauucagguaagcucuggucucuaagagucagaguuaggaaauugaaagcuuuuugcagcuuuucucagccccgucuuucugccccuacuucucauacacacccuucuugggucacaugguaccuuuauucucuguuagucauacucgauaguagcauuuuauaauguaggggaagaaaguacuaugcuuucuauuucacaagaagauugcaccugccauuuaaaguuaucugaugggcgguuuuuaaaagauauuguuuuccucagccuuuggcuuucuaacaauguucuuuuagcuugaauugucugccuuagagaaaguugcauauuucauuuuuauuuuaguuuuuucuuuugaacucaggcuaaaucuaaacuaaauaaaaugccuuuuuuauuuauaguagucuuggcugccuaugacucaucguuucacaauaaauuguuuuacaguuaauguuuauuaacauaauauucagguuaguuaggacuucucauguuaauccuucuuuuagauaaguguguguguccugugauuuuuuuucuucuuuugcccauuggcuaaguaaaugcauugagaaauauaacauuggacaccaacaucuaagcuuuuuccccacaaaugaguguguaauaaacuuucaauuguagaaacuguuuugagcuuacagagaaccuuuuuuuuugagaacacuacuaaguucuguaguuguagaguuguaagagauguuauuggauauauaaaauaagcucaugcuucugaguguguguauaauaaaaguuaaaaucuugaucaacucagccaaucaaaaugagaauuucuaaccaaaugagcauucugaaaaaaaccccaguuuuaaaauauuuuggacuguugaagagaauuaccagcuuacauuuugagacaaugcagauaccacauuucccaacauagcuuuuucuuuuuaguuuuuuuuucuuuuggaauuacuaggaauucuuucuaaguugccucauuuugauagcuuguuaaauuuuauacaauuuaaaauauuuuuuucuagggccaggcauggugacucaugccuguaaucccaggacuuugggaggccaaggcugguggcucucuugagcccaggaguuccagaccagccugggcaauauggcgaaaccucauuccuacuaaaaauacaaaaauuaguggggcaugguggugcacaccuguagucccagcuacucaguaggcugaggugggaggaucaccugagccugggacuuagaggcugcaaugagucaugaucgggccacugcccuccagcuugggcaacagagugagacccuguuuccaaaaaaaaaaaauaaauaaauaaaauauuuuuuccuaguuccuugccucccgugagguuaauuugggcuagugugcaaauguucuguauuaguccaaugauacguuuacugagcauggccuugcuugcuccuagaagauuucaguuguaccuuaaaaggaacagauugcaaauacagcccagagaacauaaaugagauaugaugcaugcauauuaauagaaaugauuuauauuaaaaguuuaggcuucuggaaugugguuauggauuauagcauauacaguuuuaaaguuauaucagacaauuaccauucaacuuguaagacuuuuacauguaaaaacaaaauggguugccugaaaaauuuccuugcagcuuagaaaaggguguuuacauuuuuccuuagguuguguaaucagaguaucuuuuuuugauguuuucuuuuugagauggagucuggcucugucaucgcccaggcuggaaugcaguggcgcgaucucggcucacugcaaccucugccuccuggguucaagcgauucuccagccucagccuccugaguagcuggaauuacaggcgugcaccaccacgccuggcuaauuuuuguauauuuuuaguagagacaggguuucaccuuguuggccaggcuaguccugaacuccugaccucaggugauccaccugccucagccucccaaagugcugggauuacaggcgugagccaccgcucccagcccagaguaucuuuauugaagggcaccccuuggguuuugggguuugaguuguguaauugggucagucuuaggggacugaagcugggagaaauugucucauuuagaaggaaugucuggggacuaagcauugucauagcaacugacauacuguagucaacaguguaagaagcucauuuucuauugcuacugacuuugaaaaagaaaaaagauuacaauucuuacacugaugugaugagaaauauuuuuggauuguaagacuuguguuuaaauuauuucaaaagaaauguuuuuauccuuaucuguaugcugccacccauagguaggcaaauuauucaguauguauguacucaaacaccaaguaagucucaaaauuauaagacuuaucccugcccuaaaagaguuuacuggcuuucuggaguuaaaacaggaaacauuuaaguacauaugaggugaggaagagugauacggaaaaguaguuuucaucuuccaguauucaugcccauacuuuuccuccuagauaauagaaaugaggauuaacucuaaacaauuauggcuuaagugugaaaauugugauuugaguaaggacaacacaugugucuguuauauuugucucauauucaauagaaauaauacuaaacaaaaaucuuauaccagaaauucgaguaucuauuguguaacuuuggguaaagcagccaauuugugcacuucagguuccucagcuauauaguaggacaaugcuaaagauuucucuacuguuuaguaagguaaaggccuguccugaagaagagguuuagacaguaauggucaccucugaggaaagaacuuaaaccagagguugggcaugacagaacugguuuuaacauaaggcagaucauaauucccaggauuggucaucaguggaagggguggcuucguugaggaccugaucuccauguuagucaaaauugucagacaguuagggugguaaucugcuagaaagaagugucugcacuaaguaggaggaggcuagauacuguuuuuagccuucuuuuaaguaugaaaaguauucuaguuacccauugcuguguaccaaaccacccuaaaacuuaaugguuuaaaauaauggcagauauuuuguucauaacucuuuaauuugcauaagguuaagcaggguugacucugcucaauguggcaucaaccgugacagcuuucaagauggcuugaccacauagcuggcuggcaaguugaugcuggcuuugggcugggagcucagcuggggccucuccauguauuccuggcuuccuuacagugugauggcaggguuccaagggcaagcauccuaagagagacuggcagaagcugcaugguuuuuuucuaacuagcuuauuaagugaauucuuaagucacuuaauuagacuuaauuuggauguggcaggaguaaugcugaggcagucacaaaugcccacccaguuccaagaggaggugaccucucaaugggaggagugucaaagaauuugccaguagguuuuaaauccucuauauaaaguuguuuaaaggauauaacuaguucuuuguuuauuaauuuuaaaaauagcuuuuuagagauauaauucauaugccauacaauucacccauuuaaaguauauaauucauucuaucuaacuguauauauauuuuugagauggagucucacucuguugcccaggcuggaaugcagugguaugaucuccgcucacugcuccgccuccuggauucaagcgauucucucaccucagccucccaaguagcugggauuauaggcgcgugccaccacacccagcuaguuuuuguauuuuuuaguagagaugagguuucaccauguuggccaggcuggucucgaaacuccuggccgcaggcaaucugccugccucgaccucucaaagugcugggauuacaggcaugagccacagugccuagccgucuaacuguguuuuuguacucauuaaccaaccacucuucauccucuccuccccacuacccaccacagccaacuauuguugauaauaauuuauuguauauuucaaaauagcuagaagagaaaauguggaauguucccaacacaaagacaugauaaguguuugagguaauggauaucccaguuacccauauuugaucauuacauuguuguaugcuuguaugaaaauaucacauguaccccauaaaugcauacuacuauuauuauauauccauaaaaauuuaaaauaaauuuaguuuaaaaauaaaguauauaauucaguauuuuuuaguaaguucacaggcuuaucaccauggucuaauuuuagaacauuuucaucccuggaaaaagaaacccuguacccauuaguagucauuccccauucucgucucuccgagccccuggaaaccacaaacuuauuuucugucucuauaaguguuccuauuuuggacauuucacuucauuggagccacaauauuuagccuuuugugacuggcaucuuucacuuagcauguuuuugaaguuuguccauaucguaacauguaucaagacuuuauucuauuguauggauauaccacauuuuauuuaucuauucaucagcugauggacauuuggguuguuucuacuuuuugucuauuauggauaauggugcuaugaacauuuguauacaaguuuuugucuggacauguuuucauuucuguuguguacacaucuagguuuggaauugcugggucauaugguaacucuauguuuaacuuuuuuuuuuuuuuuuuuuugagacguagucucacucugucgcccaggcuggagugcaguggugugaucucagcucacugcaagcuccgccucccggguucacgccauucuccugucucggccuccccagcagcugagauuacaggcgcccgccgccacgcccggcuaauuuuuuguauuuuuaguagagacgggguuucaccauguuagccaggauggucucgaucuccugacugcgugaucugcccaccuuggccucccaaagugcugggauuacaggcgugagccaccgcgacuggccuauguuuaacuuuuugaggaacugcuaaacaguuuuuuagagugccugcaccauuuauauuuccaccagcaaugugugaguguuguuucuucacccauauaaaauuuugauaaagguaaaaagcauagagagugaaaaguauauggggcuggaauuuuaauuuguauucugcaccuaacuacaccucacugguaaacuaauuuagcuuuuagcccucaguuuccuaagaucccuuccaguucuugaauucuuugagcagcccaugaggggagguaagcauugcuagaaacauucaggcaaaucuggaugaacaaagggaaugugauaggauguaaaaauagauucagauuagauuagaugauauggggaaucuuuucaauccuaaaauuucauaauucuauuuuguuguuauauauuucacaaaaugguaagcuaauauaaauguaguacuucaguuucucgaaucaucaauaguauauaagcucaagauacuggucuugagcuuauacuauauaagcucaagauacaggguaauuuuuguauuuuuaauagagacaggguuuugccauauuggccaggcuggucucgaacuccuggucucaucugauccucccaccucggccucccaaagugcugggauuaaaagcaagagccacugcacccagccucagaaauuuuuauagaaguuuuaagaaugaagcaucaaaaaagaaaagguaucagaaagcugaaauagcaaggucgugguuaagaucauuagauacauaggauaugaguugaauuuuucauagccccuuuuauuaaaacaaucauuuaaaaaauauauuuuugacccugguacucuacaaagcuuaguacauuuuuuuuauuuaaaaaaauuuuuuuauuauacuuuaaguuguaggguacauaugcacaacgugcagguuuguuacauauguaugcaugugccauguuggugugcuguacccauuaacuugucauuuacauuagguauaucuccuaaugcuaucccuccccccucccccaaccccacgacaggccccggugugugauguuccccuuccuguguccaaguguucucauuguucaauucccaccuaugagugagaacaugcaguguuugguuuuuuguccuugcuauaguuugcugagaauuaugguuuccagcuucauccaugucccuacaaaggacaugaacucauucuuuuuuauggcugcauaguauuccaugguguuuaugugccacauuuucuuaauccagucuaucauugauggacauuuggguugguuccaagucuuuccuauugugaauagugccgcaauaaacauacaugugcaugugucuuuauagcagcaugauuuauaauccuuuggguauauacccaguaaugggauggcugggucaaaugguauuucuaguucuagauccuugaggaaucgccacaccgucuuccacaaugguugaacuaguuuacagucucaccaacaguguaaaaguguuccuauuucuccaccuccucuccagcaccuguuguuuccugacuuuuuaaugaucgccauucuaacuggugugagaugguuaucucacugugguuuugauuugcauuucucugauggccagggaugaugaauauuuuuucaugugucuguuggcuugcauaaaugucuucuuuugagaagugucuguucauaaaagcuuaguacauuuuuuacuuguauaaauuccaaauaggcuaaaagccuacugacaguauugacaguagcaaugaugauguaggugucacuuggguuaagucacaggaaaacucaaaccauagugucacagaggcuacccuuuagcuuugcaugcccagaacacaauuuaauagcaaagauaguggaucugucuucugggagguguguauauugacuaagaucauaaguuuuauauuauuauugagagaaacuauuuguccuguucauuuucuuauuauguuucaaagucauugagauuaagaauuuauauuucagcacuauuaguucuauaauuauguggcacuaauguuuucauuugugaaauaaccucucagcuacauagcuaucuagcccugaagcugacuuaacaauguuuaaacuuuaaguauuuguuuuaauugaaguguaauuuauauacaguaaaauuuacccuuguuaaguguacgguucuaugaguuuugacaaauaaauacaguuguggagcuaucaccaaucaagauauaaaaugguuccaucgcccccaaaaguucuuccuuuguauagucaguuugcuccuuuguagucagccccacucccagcuccugauaaguuuucuaucccuauaguuuugucuuuuugagaaugucauauacauggaaucauacaauacguaaccuuuugagucuggcuucuuucacuuaaccauaaugcauuuaagauuuauccauguuguugcauguaucaagaguuuuuuuuuuugagauggggucucacugugucacccaggcuggaaugcaguggcacaaucuuggcgcacugcagccucagccuccggggcucaagugaucucccaucucagccucccaaguaguggagacaacaggcgagugccaccauacucagcuaauuuuuuguaucuuuuugguagagaugggguuucaacacguugcccaggcuggucuugcacuccugagcucaggugauccgcccaccuuggccucccaaagugcuggaauuacaggcaugaaccaccacacccagccgggaguuccuuuuuaauugcugagugguauuccguuguauggauauaucacaguuuguuuauccauucaucaguuaaaggacauuuggguuguuuccaauuuugguaauuaugaauaaagcuaccauaaauauuuguguacagguuuuugagugaacauaaguuuucauuucacuuggguaaauacucaugagugggauugcugaucauauggaaauuguuuauuaaacuuuacaaaaaacugccaggucaguggcucacaccuguaaucacagcacuuugggaggugaaggcagaaggaucgcuugaggccaggaguucaagacccgcuugggcaacauagugagaccccaccucuacaaaauggauaaacauagccaggcagaguggcauaugccuguagucccagcuacuugggaggcugagacaggaggauugcuugagcccaggaguuugaagcugcagugagcucugauugcaccacugcacuccagugugggcaacagagcaagacccugucucuauaaaaaaaaaauuaauuaaaaauuuaaaaaagaaacugccaaacuauuuuucaaaguggcuaugccauuuugccuaccagcaguauaugagagauacaguugcucugcauccucacaucacuugcuugguauugucagguuaauuuguuuuuaagagacagggucugcucagucucccagguuggaguacaguggcaugaucauggcucacugcagccuggacugccugggcuccagcaaucuucccacuucagccucccaaguagcuaggacuacacuacaugugucugccaccacacucggcuaauauuuuuauuuuuuguagagacaaggucuggcuguguugcucaggcuggucugaaacuccuggcuucaagcgaucgucccaccuuggccucccaaagugcuggcauuacagcugugagcuacugcaccucgccuagcuuuaaaaaaaaauguuuagccauucuaauagguguguagugauguuucauuguaguuuaacuugcauuucccaaaugacuuguauuuaccuaaauguugagcauuuuucauguacuuauuugccauccauauaucuuugguaaaauguuuauucaaaucauuugcccauuuuuuuauuggguuauuuguuuucuuauuauugaguuuuucagagcucuuuauauguccuggauacaaguccccuguuauauauauguuuugcaaauacuuuuuucccaguuaauaacuugccuucucuuaagagugucuuuugaagagcaaacauuuucaauuugaguaaaaguccaauuuccacucacuuuuucuuuuguggauuguguuuuugguuucacaucuaggaauuuuuuuucuuuuucugagacggagucuugcugugucgccagguuggaguacaguggcgcgaucucgguucacugcacuauauguauauguauguauguauguauguauauacacauacaccauauauauguguguauauauauacauacauauacaaaacaauugcuuacuagaugcacaaaucaauggaauagagaguucauaaacaggcauaucucucuuuacauauauauaucuauaucgaucacacuauauauauguguguguguauauauacacacauauauguguguguguauauacacacauauguguguguguauauacacacauguguguguguacauacacacauguguguguguauauauauacacacauauauguguauauguguauauauguguguauauauguguauauauguguguguauauauauacacgcauauauaugcguauauacauauauauggacucauauauguguauauacauauauauauauauauauauauauauauggacucacaguguguccuuggacaaguuauauagucucugugugccucaauuuucucaaguauaaaacagagauaauuauaguacacaacccuuaugggguuuuuauggauugagugaaugauuauagagcacuuaguauggugccugguacauauauagugcuucuuauacuccugaaucuuuuuacuucuauucagacuggauuuucauuggaauuaacaaaucccauuauuuuaucucacauuaucauuauggaaauuuaacuguggagaugaauuuuaaugaaaaauuuguauugccgcuuaguaagauaauaagauguucauuuuuguuuucuguuaggaaaauaaugcuuaacuugguuuaauagcuguaggacauuaaauugauaucagacgaauuacaacucuugaaauuuuucuuugauuuuuuuuuuuuuuuuugagacagaauuuggcucuugucuuccacgcugcagugcaguggugcgaucucggcucacugcaacucugccuccuggguucaagcgauucuccugccucagccucccaaguagcuggaauuacaggcgcccaccaccaugcccagcuaaguuuuguauuuuuaguagagacgggguuucaccauguuggccaggcuggucuggaacuccugaccucaggugauccacccgccucggccucccaaugugcugggauuacaggcgugagccaccacgccuggccacuuuccuugauuuuuuaaaguauauccauuaccuuuuaaggauuguaguaagaaauagucuaggccagacacgguggcgcaugccuguaauuccagcacuuugggaggcugagguggguggaucgcuugaguccaggaguucgagaccagccuggacaacauggcgaaaccccaucucuacagaaaauacaaaaauuaguugugcaugguggugugcacuuguagucccagcuacucaggagacugaggcggggaggauugcuugaacgguggaggucgaggcugcagugagcugugagugugccacugcacuccaaccugggcaacagagugagacccugugucagaaaaaaaaaauacagucuaaacuaaacucacuucauaaguggcucuuaggaaaaaauaauuuaaaacaugaccuuuccauguuugugauucuagacacuuuauuucagaacuaguaaccugcaaaauuacgaaggauuucaguuucaguuguuuauuauuacuuuuuuuuuuuuaaagugucagggucuugcuuugucacccaggcuggagugcaguggcaugaucauggcucacugcagccuugaacucccaggcacaagcaguccuccugccucagccuucugaguagcuaggacuacaggcgcacaccaccaugcccagcuaaggguuuuuguguuuuuuuaccccccuuccaccaacucacuucaaauaaucugcuaaguuuuaaaaaacuuuuuuagagcuaggggagugucacugugucacccaggccagucucaaacuccuagucucacuaggccacuggcccacucucaaguagcugggauuacagaugugagccacugugucuagcuccuaaugcuuuuuguuuugaaaaacuuucaggaauuguugagaaaguacagcaacauaaaucuuaaauuucuccuuggaaggccgugcugacaauccaacuaauuuuauacuacagaacuauuuagcuauaaaaucuuuagcuaucagauuaauuucucccuaugagcuaggaaaaguggagcguccagagaaaauacuuaggguaguaaauuacauuuaacuccucagcauuggcagcuguuauggacugaauguuugucaaauucauauguugaagcccuaccccccuacacauggcuguauuuggagaugggaccucuaaggaaguaauuaagguuaagugaggucauaaagguagagugcugaucugauaggauuaguguccuuauaagaagauucaguuagcuugcacuugcucccucccucuccuucacacagaggacaggucuggugaugacauagcaagagguuggcuuuugcagucugagcagacuaaaacaggcugccauaacaaaauaccacagacugguggcuuaaauaacagaaguuuauuucucacagcucuagagccugggaaguccaagaucaaggugcuagcagauucagugucuggugagggcucucuuccuggcuuacagacagcugccuucuugcuguguccucacauggccuuuccucugugauucauccuucugccuuaccuccuacagccauugaauuaccagucugcugauucuguuuccucaguauuucucaaauucaucccaucuucuucuucccuacuaauuacagcucugguuccagcccuuucuguaugacuacaauagucucuccgaucaauccauguugcauguguccuuaucucaucagaguaauuauccugacauguaaauuuugcuuauuuaaaucuuucugugguucccucuugucuguggauaacuucuaagcuuuauauaauacgguuucugccuaccucuguagcuucaucuacuagcauucugauagcauguguaacaccaaacuacuuucaguuuuccuccuacucccugaagaauuuuacuuuguuccgucuguuacuuuugccuggcaugggaagggaggguccuuuauuccuaccccuuuuaccuaaugagcucuagcuuauccauucucauguuuugcagaacuuccgccccacuucucuuccccgccccagaugucccuucucuguccccuccaaaauauucucagcaucucucauuacauggucaaguuguuuuuaguuuagaugaauguuuacuuuuauggaaagagcugguccuauucauuuuagugccuaaaacaaugucuggcucauacuggguauucaaauauugguagagugacugaacauccagaaaguuaaggggauuuuuucaagauccgguugcuuauaggggacaaaauugggacuggaaaaugaguacuucuuuuauugccucauacugcagaccaguguuccuccuaguacagcauguaaaacuggcuaaguacaauaucuauugugcaauuacuaagucaauuuaagcucauuugcuaaucauuaagaugauuaaauuuugcuuuguaaaucaaauuuuuacauauuguauauaugggagccuauggugcaugaaugguuuugcaugaaguuuauauagucacaaacaguuaaaacaguugaaguagauaagaaagucacauggaagaaacaaaaauaggcuuuuagugaccauauuuugauaggucagguaaaauaaaaaaaauuaaugugacauuuuccaggcauacuguuuaaaagauuaugugggccgggcucgguggcucacaccuguaaucccagcacuuugggaggccaaggcaggcagaucauccaaggucaggaguuuaagaccagcccggcuaacauggugaaaccccaucucuacuaaaaauacaacauuagcugggcaugguugcacacgccuguaaucccagcuacucaggaggcugaggcaggagaaucacuugaacccgggagguggagguugcagugagccaagauugcgccauugcacuccagccugggugacaagagugaaacuccaucucaaaaaaagaaaaaggccgggcacgguggcucacgccuguaaucccagcacuuugggaggccgaggcagguggaucacaaagccaggagaucgagaccauccuggcuaacauggugaaaccccaucuguacuaaaaauacaaaaacaggggccaggcgugguggcucacgccuguaaucccagcauuuugggaggcugaggcgggcagaucacgaggucaggagaucaagaccauccuggguaacacagugaaaccccaucucuacuaaaaaauacaaaaaauuagccaggcaugguggcgggugccuguagucccagcaacucgggaggcugagacaggagagagccgaguucaugccacugcacuccagccugggcaacagggcgagacuccaucucagaaaaaaaaauacaaaaacaaaauuagccgggugugguggcaggcaccuguggucccagcuacuugggaggcugaggcggagaauggccugaacccaggagguggagcuugcagugagcugagauugcgccauugcauuccagccugggcgacagagcgagacuccgucucgaaagagagagagagaaaggagggagggaaggaagggaaggaagagaggaagggagggagggaggaaggaaggaaggaaguagcgaaggaagaaaggagcgaaagaaggagugaaggaaggagcgagcuauaguuuggaagaucuaagaauagaaauggccaaauuugaaaaauugcguuguagcuuaauaaaugcuugaaucaaauuugcuugcauuuacauauugugauucuugugccuucagguucuucuguuuucuguagcauauugcagaaaucaguugggguuuagaaacugagaccauacauugauuugaaaaaggauagagaaauauauuucagucuggguacauucccaauuucagaauuuuauuuuauuauuauuauuauuuuugggacagagucucacugugucccccaggcuggagugcaguggugcgaucucggcucacugcaaccuccaccuccgaggcucaagcuauucuugugccucagccucccgaguagcugggauuacagacaugcgccaccacgccuggguaauuuuuguauuuuuaauagagacgggguuucgccauguuggccaggcuggucucgaacuccuggucucaucugauccucccaccucggccucccaaagugcugggauuaaaagcaagagccacugcacccagccucagauuuuuuuagaaauuagaaguuuuaaaaaugaagcaucaaaaaagaaaaaguaucagaaagcugaaauagcaaggucaugguuaagaucauuagauacauaggauaugaguugaauuuuucauagcgcuuuuauuaaaacaaucauuuaaaaauauauuuuugacccugguacucuacaaagcuuaguacauuuuuuacuuuuauaaauuccaaauaggcuaaaagccuacugacaauauugacaguagcaaugaugauguaggugucacuuggguuaagucaugggaaaacucaaaccauagugucacagaggcuacccuuuagcuuugcaugcccagaacacaauuuaauagcaaagagaggggaucugucuucugggagguguguauguugacuaagaucauagguuuuauauuauuauugagagaaacaauuuguccuguucauuuuguuacuguguuucaaagucauugagauuaagaauuuauauuucagcacuaagaacugugccuggcagccaauaguccuuuaguugauacuuguugaauaauguuaauaauacucaaggucuguguuuuguuccugcagguugauccaaaagacuacauguucaguggacugaaggaugaaacaguaggucgcuuaccugggacgguagcaggacaacaguuucucauucaagacugugagaacuguaacaucuauauuuuugaucacucugcuacaguuaccauugaugacuguacuaacugcauaauuuuucugggacccgugaaaggcagcguguuuuuccggaauugcagagauugcaagugcacauuagccugccaacaauuucgugugcgagauuguagaaagcuggaagucuuuuuguguugugccacucaacccaucauugagucuuccucaaauaucaaauuuggauguuuucaaugguacuauccugaauuagcuuuccaguucaaagaugcagggcuaaguaucuucaacaauacauggaguaacauucaugacuuuacaccugugucaggagaacucaacuggagccuucuuccagaagaugcugugguucaggacuauguuccuauaccuacuaccgaagagcucaaagcuguucguguuuccacagaagccaauagaagcauuguuccaauaucccggggucagagacagaagagcagcgaugaaucaugcuuagugguauuauuugcuggugauuacacuauugcaaaugccagaaaacuaauugaugagguaaggagaaagagaagagaaauagucauacaccuagauuuaaaaauguaccacucuggaguacuuccauucuuuucaaauuggcuauuggaaauacaggcaacccucaaguuauaguccuuugccaccacccccucucccaacagacucaucuguaaguagauugcuugggccucaaaauacuuucucaaagaaacuuuuaaaaaauauaauucaauucaguaagcauuaagcauuuguuuguaaguagauugcuugggccucaaaauacuuucccaaagaaacuuuaaaaaaauauaauucaaaucaguaagcauuaagcaccuauuaugugcuaguuacuguuaucauauuucacugaugauaggaugccuauuuguuuuccaugauuuugcuuaucuggaaugcaucuuauaauugauagcaacucagaaaugaugaacuauaguguaugcuggagaugaagauacauagacaaaauucucugcccuuaaagaguuuccauuauacuagaugauuuccagagaagcucacaaaaguaguacugcuuaguaaagcaugacauuuuauaauuauuuaguggggaaauuucuuuagaguucuaauugguuaggggguaagaaaaugcaauuuuuuuuuuuugugacggggucuugcucugucacccagccggagugcaguggugcgaucucggcucaccgcaacuucugccuccuggguucaagcaauucuccugccucagccucccaaguagcuggaacuauaggugggcgccaccacacccagcuaauuuuuuuuguauuguuaguagagacgggguuucaccacguuggccaggauggucucgaucuuuugaccucaugauccaccugccuaagccucccaaagugcugggauuacaggcaugagccacugcacccagccaaaaguacauuuaggaauacaacuuuuggacccuguugugacugugagagcaaccuccacauuacguuccuuauuuuccuuuauugccauagaagggagcuugaugcagaagagugagauggaagcuagguuggcaaagcucauaggcucaugaacagugggucuuggugagcucaugaauagagaaggcuuuuugggguagcagcuucugcuugaaaaauaauuggagauacagagguuaggggcuccagaagcagcaguuccuuaguuggugggugcuccagugggaaggcagcaguaggauguauugauuauccauuaaucagguuccuucaggaggaaucuguuugaauuuaaaaaccaaacuuaaagacauagagaagugaauggaaaacucaucaagucucuuuuuauuuuuuugagacggagucucacuuugucucccaggcuggagugcaguggcgcgaucucagcucacugcaaccucugccucccggguuuaagcgauucuccugccucagccucccgaguagcugggauuacagaugccugccaccaugcccgcuaauuuuuguauuuuuaguagagacaggguuuugccauguugguuaggcuggucucgaacuccugaccucaagcaguccacccgccucggccucccaaagugcugggauuauaggcgagagccaccacgcucggccggaaaacucaucaagucucuuuuugaauggauuuuuuuuuuuuaaguuggaacauaucaaaaggaaugauuuuaggaaaauacuaaaaaugaauaccucucaauagcuauauauuccacaauguagaaaacccauguagaaaugucugaaauccacaaaguauaucugagguauaguuuuuaaaccaacagaagccaaaguuuaauuuuaagacuuuuauauuuucucuuuugcuuaugccuaugugauaaaaacauuccaugaaucugguaagauacagaaaaaugugcuucuggcuuuugagcuaucugaucacauguuaauccaacaucugagagguaaaugcuuucauuaugcaguauggugauuuaaaaaaaaacuacaaacaguuuucaaaauauguaauuauuuagguuaaacuccuuuuucauagguaaugaggaguggacauaaagaauauuuagcauguuuaaagaaaaagccaucaaaacaguguuucuucaugaaucaccaaauguucuuaaccuuuuaaccuuugguaucugguaugugaaauggcaguguugugugcccuugaaaagaauaugaccaggaagaaugauauucuuuagauauccucuggaauacaauauaaacaaucccacagcgauaauaauaacuaacacuuacauaguguuuacuauaugccaggcacuauuguaaggaauuuaaaugaauuaacucaauacucaaaacaacucuaugaaauaggugcuauuauuccccauuuuacagauaugaaaaauagaccauaaagaggguaaguaccuugcaaaaggucauucagcuggaaaaagcagagccaugauuccaauccaggcagucuggcuguguaggccacaccuuaacccuuaaacaugaugcuguuaugcucccucagugguaaaggaaaguugcugaaugccugguggagcaggaaugugacugaaagcauguggacucuagggccuuccagucuagggacuauuuggcuauaguuauccuaucuuauucugaaaguacagaauuaaggaaugaagagaacaaacaaaaauaaaaaauaaaauaccaaguacaugugaagaggguaucaaaacaugcugaaagacaaaagacuuauauauuauauugagagauuacauuuuuuaaaaaaugagaugaguucgcagggaaauauguauagaagcuagugaaucuugagaugaaaaaaauaaaacuugagucuuucucaugucauaacacaaaugucuuaggacagcuuagacugaaacuaugauugcuaacucuauauuuguuaaaccccaggaggauuacagaauuuuguuucacauuguuuuaaugcauuaaauaaugauuuuuuuuuuuucgcaauaggaaguauacaauuugagagagguuaggaaguccaaaaaggcuggguaaagcaaaaagacauuccauagggagccaagagaaguuacuagacuuugguuuucucaccuaaaaaucagauuccagccgggcgcaguggcucacgccuguaaucccagcacuuugggaggccgaggcggguggaucacgaggucaggaguucaagaccagccuggccaagauggugaaaccccgucuguacuaaaaauacaaaaauuagccaggcgugguggugggugcuuguaaucccagcuacucgggaggcuguggcagggaauugccugaacccacgaggcggagguugcagugagcugagaucccaccacugcacuccagccugggcgagagggcaagacuccgucucaaaaacaaacaaacaauaaaaauuguuuuucuuuccucgacuucucuuaccuacaucacagauauguacaggauaaaauagaguaaaauaguuugagaguacuucaucaucugaaauugaaguuggguaguuaccacuauuuucaagucuuuaaaaguagaauuuucaugaaaaggagucucuucaaauaucugcagugaaauauuaaaauauaguuuauuauuuagguaacauuauuuugaaguaaucaucauaaucucaucaguuuguguuuauaaaaucagagaugauaagcacucuagaaaauaagagagguagaauuguuucugauauuuuuauuuuacagucaucuggcagugauguccauguaauucucuacaauuuuuaaauguauguuucuuuuuuuggaggcagcauugaaugaggguucugaaauaggauuugaguuuaauaaaauucgauggaaugguauggaauaauguagccauaggaugaaauacuaucagccauuaaaacugacuuuauguagaaaaugucacaauuaaguaagugaaaauuuguagaauauuagguaaguaacugauuuuuuuaaguagguaagucuggaaaguuauagauacuuaaauguuaacaggcaugcuuauucuuaggcaguugauuaacagcaggguuuucuuuuuuuguaguucuauggauuuaacagugagcauauauuauuucuguaaugggagaaaaagaaaacugggaggguauaccuguauggcaguagcaucuuuuaguugcagcacccugguugauauuucuucauuucuauuuuuuauuuuucaaauguucuguguugagaauauauguuacuuuuaauuauuaaaaaccuaacaagcuuugcuaaaaauuaagugguuggaauaugacuacauuuuuuuuuuuuuaaagacaagguuuugcucuauuguccaggcuggagugcaguggugagaucauagcucaguguagccucuaacuccugggcuuaagggauccucccaccucagccuccugaguagcuaggacuacaggcacacaccaccacaccuggcuaauuuuaaauuuuuuuuuauaaagauggggucuugcuguguugcccaggcuggucucaaacuccuggucucaagcaguccucccaccuuggccucucagagugcuugggaugcaugugugagccaugaugcugggcugacugcauuuuuaaaaacuacuuucauaauuacuuuaaaaauuaauaugcccucauuguggagaauuauagaaauaagaaagaguaaaauaaguuuaaaaucaauacauaauuguaccauaccuugaauaaucuuuuuaggaaucauuuuuaaauuuauuuagucuguaauuagauuaacuagguuugaaucacagcucugucacuuaauuguugaauguccuugggcaaguuccuuaaucacugugcgccuuaguuuucauaucuguacaaugaggguaaugauaccuacuucgugagaggguuaaauauauauauguaaaguacauaaaacugccugccacaugguaagugcuccauaagugugaucuaccauuauugugcuauacuauauaaauuuguaucaugccuuuuaaaauuaacauuauuggccagguacaguggcucaugcuuauaauuccagcaucuuggguggcugaggcaggaggauggcuugagcccaggaguucaagaucagccuggcaacauggcaagaaccuguuucuacaaaaaaaauuuuaaaaauuagccaggcaugguggcacgagcuuguagucccagcuagcugccugggaggcugaggugggagaaucguuugaacccaggcguuugaggcugcagugagcuaugauugcaccacuacauuccagccagggcaacagagugacacccuaucucaaaaaaaaaaaaaaagaaagaaaaauaaacaaauaaaaguaaaauuaacauuauuacauaagcuuuuccucauuuuauuauaacaucuuuguuguauuuaaugaacugugauaaauguaaugaacuguggcauuucaucaugugacuguaccauaauuuacuuaaccauucucuucuuauuggacauuugcaguaucaccaaacuaaaacuuccaucugguuguagaaaaauuuuaaucauguuuuaaacuugagagauaauucacauuuauuugacccuuaaccuuaacugcaguacuaaaccagaaccacccaucuguaagaaagaaucucauauagugagaacuuauuauagcaaacacccugaauuagacuuauaauuaaaacaaaaaucagugugcuguuguugcauuuuauacagagaaauacuagaauaggaaaucauuguuuuagucucagaaguucauuuuaaaaucucaaugaaauuuuauuuucacagaugguugguaaaggcuuuuuccuaguucagacaaaggaaguguccaugaaagcugaggaugcucaaaggguuuuucgggaaaaagcaccugacuuccuuccucuucugaacaaagguaccuucuggaugauugguauacuuuuguggauauuuucuuuacaugcugauuugauuuacuuuugccuuuaacauuuguuuuacauugccuucucuuucucauuuguucuuuguuuuuuuucuauuauuguucugaaaugucaaaauuucacaucacucaaggagcccuagacaacuaacuagaaauuaggcauucuuuuuuuuucccuauccucuguucuuaguacugaaagucacauuuuauuauguaucuuauuaucauuuuaauuguuguauuauuguuguaccuuuauaguguagugauaaauauuucaugcucccugcucagaguugcaaagcacuugaugaagauucuuucuaccuucagugugcuuuaaucauacuggaaaagaaauaagaaauauaaagugguauacuauuuuauguauuuaauaugauugauuaacuuccauguauaauuagaauuguuuucccuaguggguaaaugccaccaauaaauuucagauacuggauauaggucuucaaagagaggaacuugaguaugugugcccacuugaaggguuacugucugccuaccuguauuugaagguguauugauucuagaggacagaguacucuuuaucuguucagaguggggccauuguuugcucaaggcucaucaggcuuuccuugacuggccugagcaaauauguauaguaauacgcaguguugauuggguauucccuagagagagggcacaucugcauuuuaugugcucuuuauguauaaaaauauuauaauaaacugcaaaaaucuguaugcaaauguuagaggaauguuaggauaauaaguaaugcuggguguaacucagcugguaaguauuaaugcaguauuugauaauacuucugugguuacuguagugguagcaaggacuugcugugacccacugcaugaaucuaccccagaauauauguaggaaauucugaccuggccccuuugaugcaaccauuuugacaugggaacauuuggaagcuugaaaaugaauguuuaacuucuuagcagcuuuuggaaauugaaucagguaauaaguguauuggacauccuaaagugugagaguuaggaauaaagugagcauaucgguagagcuaaauuaaugauuuauguaccugugugauguuagugaagucguauuguagaauugcuccaacccaaauauaauaucugcauuuaaguaacagaacauuccacauggaagaaguaaaauguucuauugcugcaaaaaguagaacuaaaaccaauaagcagauguugcaggaauuucagcaaauaaauauuauauaaacaagucuuaaaaacaagagaugccuauaggaaguauucaaagacugaugaguucauaucaaaagaucuuaggagccagcuugaaggaguuuccaugggccaaauuugggacaauuuaacaauuaaaaggaauacugggacuggauguagugccgaaccccuguaaucccagcauuuugggagggugaaguggaaggauugcuuaaggccaggaguuugaaacccaucugggcaacguugcaagaccuugucacuacaaaaaauacaaaaauuagcuaggggugaugcauaccuguagucccagcuacucaggagcugaggugggaggguugcuugagcccaggagcuugaggcugcagugaguuaugcucaugccacugcacugcagccugggcaacagagcaagaccuugucucaaaaaaagagaagaaugaagguaaugauuuaacaacagaaaucuaugcauccauauuguuaaacaaaaaggggagagaagaaaagaauguucaucugcuguuuauggaauauugugagcuaaaaaaugcagaaggaaugcuggacuuuggaaaucaccauuuccaaccccaauguaauaauuauuucagacaaagauuaucagugggugcuaaaacuauugggguaaaaguugcuaagaaguaggauauuuggcugggcguaguggcucauaccuguaaucccaacacuuugggaggcugaggcggguagaucacgaggucaggaguucaagaccagccuggccaacauggugaaacccugucucuacuaaaaauacaaaaauuagccgggugugauggcgguugccuguaaucacagcuacuagggaggcugaggcagauaauugcuugaaccugggaggcggagguugcagugagccaagaucgcugcugcacuccagccugggcaaaagagcaagacucugucucaaaaaaaaauggccgggugugguggcucacgccuguaaucccaacacuuugggaggccaaggcgggcagaucacaaggucaggagaucaagaccauccuggcuaacacggugaaaccccgucucuacuaaaaauacaaaaaauuagccgggcgugguggcgggcgccuguagucccagcuacucaggaggcugaggcaggagaauggcgugaacccgggagguggagcuugcagugagccaagaucgcgccacugcacuccagccugggcgacagagcaagacucugucucaaaaaaacaaacaaacaaacaaacaaaaaaacccaacaggauauuuauacauccuaauucaaaggggaaguguaccuuuacagcagagauuuggugaucaccauguuaacccagugaucaaacagcaucauugauggacagccuaacguguuauuugugaugugaugcauugaaaaauacacaacaucauauguagaguguucuugccaaaguaaccugaaucuaauugagccaagacuuaacuuguaguuuguaguguaggaagaaaagaaauauguuaaaugacaccauaaggaaauaagacaaauccaaaauagaagacauucuacaagacaacuggcuaggucucuucagacaguauaauggaaaacaaaaaauaugggggaauuauucuggauuaagagacuaaagagauauaacaacuaaaugcaaugagugaaccuugauuggaucuuagguuggguuggagugagcuguaaaaagcauuuuugggacaaguggggaaguuugaagaugagauagaauuaucguugauccuuugguauaauaaugguggugugguuaugcaggagauacaugcugaaguguucuuaugucugcuacuuucaaaugacucagcaaaacaaagcauauaugugcagauagaugguguuuauuuuguaauaaagcaaauggggacaaauguuaacuuuugguggguguaggugaagggcaaaugcauauuuaugcuauucuuucaauucuucuauaauguauagaaauuuucaaaauaaaaaguuggggaaaacuuuuaagcugcucagcagugcgcugauuccuguggaauacugaguaggcuggcaguggagauauucuagcaggaguuggauggacugggcccuuaucuaaaaguggccaucagucauucuaaggcaggguuucucaacuguggcacuacagacauuuuaggccagguaauucuuuguuaugagaggcuguccuauaccuuacaagauguuuggcagcaucucuggccucuaccuauuagaugccaauaaaacaccaccccaguuguggcaacgaaaaauguuuccagauguccccaggggugugggagggaggcaaaauugcucccaguugagaaucacuguacugaacuaaggguggucuuauuuauuuauuucuuuugagaauucacauguaucuuaaauaguuugcaccucagagucucucaauuuuccucuucaguugcaauagucacauuuauuuuuaauauuuaauaaagcuauuugacugcuuaauaagagaauucauuguuuuccaucaugaggaucuccaaaucugacuaauccucagaaccauccagggugcuuuuaaaaauguaaauuuucagccaggcacgguggcucacaccuguaauuccagcacuuugggaggcugaggcaggcggaucacuugagccuaggaguucaagaccagccugggcaacauggcaaaacccugucucuacaaaaauuagcugggugugauggugugcaccuguagucccagcuacuuggaggcugaggugggaggaucaccugagcccagggagguugaggcugcagugacccaugaucgugccacugcacucgagcuugggcagcagagcgagaccuugucucaaauacauaaauacauaaacaaauuuuccuuccuuccuuccuuucuuuuuuuuuuuuuuuuugagacagggucucacuguguuguccaggcuagagugcagugcugcaaucucggcucacugcaaacccugucuucggggcucaagcaauccucccaccucugacuccggagcucgagcaauccucccaccucugacuccugggcucaagcgauccauucaccucagccuccuggguagcugggacuacaggcgugcaccaccauacccagcuaauuuuuguauuuuuuguagagauggcauuuugccauguugcccaggcuagucucaagcuccugggcucaugugaugcguccgccucagccuccuaaagugcugagauuauaggcauaagccaccaagcccagccaauaaacaaauuuucuacucccaccccagaaagccugauucagaaaucuuugagauguacccuuggaauguuccuuuuuugauaguucuccagauuagucagacuuggguucuuuuguuuuagggaguaauucauucaauuauucaacaaacauaguagaugaggucugagaaguagagagagagauaaugaagggccuuguaggccacuguagagacuuuggcuucuauaguagucugagugagaugagaugcuacuggacauuugugggcuuuuuuaaaauaaacuuuuuauauuggaaugauuuuagguuuacagaaaaauugcaaagauaguacagaaaguuucuguauaucccuuacccagcuucccuaaauguuaacauaaccauaguacauuugucaaagcuaagaaauuuacauugguaaaaugcuaacuuaaacuacagacuuuauucaaauuuuaccaguuuuucaacuuauguccuuuuucaguuccagaauucaauccaagaucccacauugcuuuuuguugccaugucuccuuaauuuccugugacagaugugacauuucuucagucuuccuuguuucucauaaucuugaaacuuuugaauaguaguggucaauuauuuuguagaauguuccucaauuuauguuuaucugacauuuuccucugguuagacuaggguuauggguuuuuaggaagaggaagugcccuucucaucacgacaucacagggcacaugaugucaauaugaggugauaucugccagauuucucugccguaaaguuuccauguuucccuuuccauacuccauucuuugaaaaugagucacuaagaucaacacacaaucaaggagaggagaauuaagcucuaccaucgggagacaggaauauccacauacauuauuuggaauucuguaagaaacauuuguccuggcugggugugguggcucacgccuauaaucccagcacuuugggaggcugaggcaggcggaucacgaggucaagagaucgagaccauccuggccaacauggugaaaccccaucucuacuaaaaauacauaaauuagcuggaugugguggcgcaugccuguagucccagcuacucgggaggcugaggcaggagaaucacuugaaccugggaggcggagauugcagugagccaagauugccaccgcaguccagccugggcgacagagugagacucugucucaaaaaaaaaaaaaagauuugucccuucuccccauuuauucaaucauuuauuucucauggguguguauuuuguucuuuuaaguuauaauccaauacuaucaaauuguucugguuuuaaccaucuggagcucuuuuagguuggcuuuuuugucccuuugacaugccccauccuuuugaauuuugaacacuuccuuacuuccuggcccuacaagaugcuccaggcucauccuguauuuuuccuugcuccagaacuaguaucaaccauuucuccaaggaacgcugguuucuuuuauucuagaaugauaguuagaaaccaugaucugggugcuaggugugcccuuuacuaaugggguaccacugguucuaggcccuuucaacagacaaagguaaaaaauacauguaugacuauuaaccuguauauacacacacaucuauaauccuguaucuaucuaucuaucuauuaaaauaccucugacccuaauccagcaccacaggguucauucuagcaucccuucccuugcuuuuuugugacuucuuacucugaaagugagaaaccuggcuuccauuauguccauuuuauucacuuauuuguuuaacccuaguauaaauauaauauauuuuuagaauuacuaacccauaccccugugagaaacuuauuugccaacuagagugcaguugguauuguacagucuugucuuuagccuuacaguagccacucaaaacaguuuuccaaaguccugagguuagcuccuuuuucccuuauccccuucauugaaguauuggcacacauuucuaauacuguuagauucauuuguuacaagcuucauuccauccuuggauacugugacaucuugguuaauuuuuuaaaauuugcauacaguaacauucaguuggcaugaguuuugaugagugcauaaaguccaccaccccacuuaucaccccaguaccauggaaaacaguucucccuaaaaauuucccuuguguggccccuuuagucagucaaccacaacuccuggcaacugauuugucuccugucccuaugauuuugucuuuuccagaguguaccauaaauggaaucauacaacauguagccuuuugggucuggcuucauuuauuaaaaugcauuugugauucagucuucuugcuaggugacucaauaacuuguuccuuuuuuuuucuuuugucuuuuuuuuugacaaggagucucgcucuguugcccaggcuggagugcaauggcgugaucuuggcucacugcaaccuccaccuccuggguucaagcgauucuccugccucagcuucccgaguagcggggauuacagaugccugccaccacgcccgacuaauuuuuguauuuuuaguagagauggcguuucaccaugcuggccaggcuggucucgaacucccgaccucaggcgauccgcccgccucggccucccaaagugcugggauuacaggcgugagccaccgcuccuagccaacuuguuccuuuuuauugcugaauaguauuccuuguauugauguaccaguuuguuuuuccauucaauuguuggacauccugcuuguuuccaguuuugccaauuaugaauaaagccaguauaaacauuuguguguaaguuuuuuuauuaagguaaaauauacauacauaauuuaccaccuuuaccauuuuuaaguauacaguucagugguaauacauuuacauucucuuuuuuucuccacauucccccccaccccacuguccccuuuuccagccucugauaaccaccagucuacucucuaucuucaugagauccacuuuuuuuagcccccacauaugagugagagcaugugauauuugucuuucugugcuuggcuuauuucacuuaacuaguggucccuaguuccauccauguugcugcaaaugacaggauuucauuccuuuuauggcugacuaauauuccauuguauaaggguaacacauuuucuuuauccauuuaucuguugaugggcaauuaggccgauuucauauuuugacaauuaugaauagugcugcagugaucaugagugcaacuaucucuuugacauacugauuuccuugcuuuuggaucuauacccaguuguggaauugcuggaucauguuguaguucuauuuuuaguuuuuugagggaccugcauuguauauagguuuuugaguguacauaacuuuucaagucacuuggguaauuugcuagcauuugcuauugucaguuuuccaauaggugugucaugauaucucauuguguuuuuuaaaucaacuuuuaauuuugaaacaauuuuagauucacagggaauuugucaagauaggccaggcgugguggcucaugccuguaaucccaacacuuugggaggccgaggcaggaggauugcuugagcccaggaguucgaaaccagccuaggcaacauaaugagacuuugucucuacaaaaagaaaaaaaaaaugagccgagcauggugucaugcgccuguagccccagcuacucuggaggcugaucucaggagcaaggcaaagaugccuuccaucacuauucugcaaguguucagucucacccuuaggaaugauguaggccgggcgcaguggcucacaccuguaaucccagcacuuuaggaggccaagguggguggaucacuugaggccagaaguucgagaccagccugccaacaugaugaaacccgggucucuacuaaaaauacaaaaaauuagccgggcgugguggcacuugucuguaaucccagcuauuugggaggcugaggcaggagaaucgcuugagcccggcagguggagguugcagugagccaagaucgcgccacugcacuccagccuaggagacagggcgauacuccaucucaaaaaaaaaaaaaaaaaagaaugucaguggccaggcgcaguggcucaugccuguagucccagcacuuagggaggcugaggcagguggaucacuugagcccaggaguuugagaccagcgugggcaacaaggcaaagccucaucucuacaaaaaaauacaaaaauuaguugggugugugauggugcgugccuguagucccagcuacuugggagacugaggugggaggaucacuugagccugggaggcagagguugcaguuagcugagaucacaucacugcacuccagccuuggggggagugacccaaggagauccugucucaaaacaacaaaaacaucgaugucagguuuaggcacaguugcuuaugccuguaaucccagcaauuugggaggccaaggcaggaagauugcuugaagcaaagaguucaagaccagccugaacaacaaagugagacccccaucucuuaaaaaaauuaaauuaaaaauuuuaaaaggaauuaugucaguuguaguuuuucuuuuuuuuuuuuuuuaagacggaguuuugcucuuuguugcccaggcuggacugcgauggcgcgaucuuggcucaccgcaaccucugccucccagguucaagugauucuccugccucagccucuugaguagcugggauuacaggcacgccaccacgcccggcuaauuuuguauuuuuaaugaagacgggguuucuccauguuggucaggcuggucucggugauccgcccaccucggccucccaaagcgcugggauuacaggcgugagcuaccgugcccggccgucaguuguagguuuucauacauacuuuuuuuuuuuuuuuuuuuugaggcagaguuuugcucuuguugcccaggcuggagugcaauggugugaucucggcucaccgcaacccccgccucccggguucaggugauucuccugccucagccuccugaguagcugagauuacaggcaugugccaccacgcccggcuaauuuuguauuuuuaguagagaugggguuucuccauguuggucaggcuggucucaaacuccugaccucaggugauccgccugccucggccucccaaagugcugggauuacaggcgugagccaccgcgccuggugcaauacauaacuuuguuuaauguguguuuaaagauaccuuauuuagcauauacuguugauucguuaacauugaacucacagccaacagcacuagaacugaugcuggagcaaagcuuaucuaacacauuuucucaugaggcacaucacaacuuuccucaguuuaggagccauuagacagcacuucagcacuguguuugggggcuauuuuauuuuuuuggagacagggucuugcucugucagccaggguagagugcagugguaugaccauagcucacuguaaccucaaacucaugggcucaggugauccucccaccucagacucgcaaggagcuaggacuacagguucacuccaccaugcccagcuauuuuuuuuuuaacauaaaagagacagggucuugcuuuguugcccaggcuggucuugaacugcugggcucaggugauccacccaacuuggccucccaaagugcugggauuacagguaugagccaccacgcccagcccccagcuauuuuuuuaaacaauguuguagaguuggggucuugccauguuacccaggcugaucuugaacuucuggccucaagcaauccucccuccucagccucccaaagugcugggauuacaggcaugagccacugugccuggccuaggggauauuuuaaacagguaaaaucaccaacaaaaagcacaaaaaugugaaaaauacggcacuaccuagaccucacaaaggacacuuucuuauacuacaauagcugaaacaggcagaguaucaccuuguucagccucagcugggagcaugcacaucaggcaauucuaauuuuuugccacugugcauguccacaaauaaccaugaaagcacugcaagcauugauuuggggaguuagaaaugaauuuuagcaaguagguaaauuugaaaugaagggaucugcauauaaugaggauugacuauaucuguuauuuaauguuacaauuuuuccuuuaagcacugcuuuagcacaucucacaaauuuugauauguuguauuuucauuuuuauuuaauucagaguuuggcaaauuauggcccacugccugcuuuaauaagugaagucuuauuggagcacagccacgcucauuccuuuuuuuuuuuuuuuuuuuuuuuuuugugagauggaguuuugcucucgucacccaggcuggagugcaguggcacacugcaaccuccgccucccggguucaagcaauuguccugccucagccucccgaguagcugggauuacaggugcccgccaccacgcccggcuaauauuuguauuuucaguagagaugggguuucaccauguuggccaggcuagucucaaacuccugacaucaggugaucugcccgccucagccucccaaagugcugggauuacaggugcgagccaccacacccggccacucauucuuuuaucuauuacauuauggugcacaaagccugaaauauuuccugucuggcccuuuacagaaaaaguauguugaccacugauuuaguuaaaacuauuuuuuaguuucccuugagaccucacuugauccacggauuauuuagaaguauaauuguuuaauuuccaaacauuuggggauugcccaaguguauuucuauuauugauuucuaaauccuguuaugguccaagaauacacauuuguaugauuucuguuuuuuauauuaaaauguauuuuauggcacagaauauggcuuaucuuggugaauauucuaugugcaucugagaagaauguguaaucugcuguugcuugguugaauuuucuauaaauguccacuaggucaaguugguugauagugcuauucagguuaucuguauccuugcugauuuucugccuacuuguuccauaaaucaaugagagaggaguguugaagccuccaacuguaauuuuggauuugucuguuucucuuuucagauccugucagguuuugucucauguauuuugaagcucuguuauuaugugcauacacauuuaggauuguuauaucuucuuggagaauccuucaugguuaugugaugucccucauuuuuuuaagagagggguucuugcucugucacccagucugggguacaguggugcagucauagcucaacugcagccucgaacuccuggggcucaaguaauccucccaccucagccuccucaguagcugggauuacaggcacaagccaccauguccgacucugaugucuuucuuuaucucugauaauuuuccuuguucugaaaucuacuucaucucaaauuaauauagcuacucuagcuuucauuugguuaguguuuuauuguaaagauuuaucuuuuuuucuuguagcuuaucaaggcuguauauuuaaagugaguguucuguagacagcauguaguugguuuuugcuuuucaauccagucucuuuuaacugcuguauuuagaccauucacauugaaagggauuauugauacaguuggaucaaaaucuuucauuuugcuagcugauuuguuccaguuguucuuuuuuucuuauuaccucuuuuucuuuuuagcaguuuuguaauuccacuuaaucuugucuauugacauauuuauaccucuucuucaaaaacuuauuuaaugguuauguuggguuuuacagcaaauauuuuuaaauaauuugagucuaccuucuaauauuacacaacuucaccugucaucuaaggaccugauaacauuauauucuuaauucuuccuucucaucucugugucauuauugucauauauuacuguuguauaugcuauaaacaccuaauacguuguuaauguuauugcuuugaacugucugguguuuuuuuguuuguuuguuuguuuguguguuuguuuuugagacaggaucucacuuugaugcccaggcuggagcgcaguggcuugaucucggcucacugcagcuucgaccuccagagcucaggugauucuucuaccucagucucccgaauagcuuggacuacagacaugggcuacuacgccuggcuaauuuuuguauuuuuuuguagagauggggcuuugccauguugccuaggcuggucuugaacuccugggcuaaagcgaucugccugccucagccucccaaacugcuaggaauacaggagugagccacugugccuggccugaaccgucacuuauuuuuagagcaauuaaaaauaaaaauauagaucauacuuuauaggcaguuuuagagcagaggaaugucaugguccuuuuaaaguguaaauccugucacuggucgcuuuaauggggaagcagaaagaccagcuaggaggcuguugcaguaaucuaauugagacauaguggcuuguuccaaggucauguuagaucucagaaggguucacuagauaagacauccagaaaucuuuuuugucugcuucagagucucacaauuuuucaugacagcugaaauauuuagaucuaaagcuaccaugaacucucugaauaagauguucauauuaaaacacuaaaaacaugaccaguaauccuuguugaccucauaguucaguuagaaauaaucacaguaauuggcaucaucauuagauagagggacaaauaguaguguuuaacaaguguguugucaacauuguaguuuuuaaaaaauuuaguagugcuuagcaagugcauugucaacacuguaguuuuuuuaaggguuuuuguuuguuuaauacauaugaaaagaaugcauaaacaaagaauugagacaugagaaagcauugguucaacacuaaugaaucuaaagaauuaggauuugggaagguggaaaagauuaccuaaacauuuucaaaaauuggaaacugcaaccaaaauaagcugauaaaaaucccuauuaacacuuaugaagagucuucagacucuucccaugauuuuuauuaaacuagagagccucaccuggcugcuauaggagucuucauaugcagaacagaaauaaggagacuccccugacgguuccccauguugcuaaguguuuuccccacccccaccugacccugagcuucuuaaugaagcaggccuccauccuccuaauuugagaggaugugaaucauuccacagaugucugucuucuagcaccaccccucauauuuccucuacauaccaggucuucagcugcguucuaggaacaccauaaacuacugaguugcaaaucuaugucaagcauauaagacaaacauuguagucuuuuuaaauuuaagauuauccacacauguuaaaacaaaugcauuuguccacuuuuuuguuggaaaauuauuaggucauuuauuggaaguuuaucauauucuagucaauaucaaucaaguuauauaccugaguaauucuaccaagauuguauuucugaauucuagauuacauguucuuuauagaaagacuggaacuuuuaauaauaaaugucuaacuuaaauacacacacacacuauauuuccuuguagugaugaaacuauauucuaccuuaauucaaacuuucuaccuugcaaaacuggaaacccuacauuuauuaucaaccuuuucuuuuuaguucaguauuuauuagguuuaaaguacuuuuuaaacucauuuugcaaauuuccaaauguacuaaauguagagaguacaaugacccccauguguacccaucacccaguuucaucaacuucuugccauacuuaaaaaaaaaacucauuguuugcuaaaacauuuuaaucaaauugauucauccugucauuucaucccuaaauauuucauuaucuuaaaacaaaauuaaaaauguuuucuuaacuacagugcauuaucacauuuaacagaauuaacaauaauuccuuaguauccucuaauauucagucuauaugcagauuuaccuacuuacuaaaauaauucuuuguguuuuuacaguuaauuugauccagaucuaaaauagacccacuuacuguauuugguuuuuuuuuuuuaaucuucuaucgcucuuaaaucaaaaacagguguucccccucuacuacuuuuuucuugccuuugucuugggaaagaagcuuggucaauuauguuauaguauuuaugagguuguuuaauucguuccuccauauuucuugcagacuagaaguuagaucaaagccuuguuuacguucagguuuaguuauuuuuuuacuuuuauuuuuuaauuuuuuuuggcaggaauacauagaugguacuguuuccuguugcauuaauugagaaggcacauaauguuugauuguuguacuuuuagggauacuaagauuuaaugguuggguuuacacggugacgaccuucucuuuuuauuguagaguuuccugcagucuucucugugggaugcuaaaaccauugaugauuguugccugaaccaauuguuuuaauaggcguugcaaaaugacuguuuucuguauuuucuuucuuuuuuuuuuuuuuuagcaaacuuacuuuuuaaucuugucacuaccucugcauuuauuaacagauguuaacagaacuccucguaugccagagcuguuugguuaacuugaaauaugcuucaugucagaaaagcagaauaaauaaagagaaaaauaagcaucaauuuucagaguagugaauuggugcccuagcaaccuccauugguauacagugaauuuuguuucucucuucuuuuuuuauuuuccuuaaaaauaucugguaguaaggaggaucucucuaaguaucauuaugaacucaugacuuuuuauauauuaauuuuaauaaaucagagucauuauuccuucuguuucacuaugucucaucuuuggccauugggagccccuucaggcuggcuucugucuccuuuugauagaaccccacuggccuuugauagcuucauuacuuuuuggcugaagaaaauauuccacauugaccuuaauccauuucuugccccagacauggaaucaucuauuuuucuaagauuacuuaguuauuuuuaguggggaaugauauuuagaaauacauguuaggugcuauguauuacuggguugucauuucuuuuaagcuuuuucaguggacauagcuagaaacuauguauuuuuaaaaaggaaaagaucaugaguuuacauugauauuucuaaauaaaaauuuaagauuuuaagcuuuucuuuuguaagguuagauguuuuauuacaauauguucuugaacuccuggccagggcugaaggcaagaggauugcuugaggccaagaguuugagaccagacugagcaacauagugagaccccauaucuauuuuuuuuuugagacauggucucgcucuguuguccaggcuagagugcaguggcuugaucauggcuugcuauaaccucaaacuccuggggucaagugaucuuuccaucucagucccucgaguagcugggacuacaggccugugacccugcacccagcuaauuuuuuaauuuuuuguagagacggggucuugcuuuguugccuaggcuggucuucaacuccagggcuugugauccuccugccuaggccucccaaaauucuacgauuacaagcaugaaccacugugcccagccgugagauucuaucucuaaaagaaauuuuaauacauuuuuaauaaaguauacaggaggaugugcauaaguuauaugcaaauacuauaccauuuuauuaauauauaagggauuugagcaacaaauggaaccaauccuugcagauaccuagggaccacuauauccugccuuuucuguauuuguugccuguauuauaucacaagccuccaagaaaaaaaaaaucacaagccuucaguuaucuugaugcccaauguaguguaaccuuuucuuucucauucuuguaccuuguacugcagcacacgguuacauucaauuuaguguuucauauucauucacucuaguauuucauuacuucguacuucauuauucuguguugguuuguauuuguuuaauggguuuaugucuucuuucaauacauuuguaauuuccuggagaucaagacuuuuccaucacuguaggagguuuuuaauguuuucaaauuaauguaugagaaaggaggcacagauauucuauuaaaaggauuaaaaaauaaaaacuuugucuauguuucuagaauguagcuuuaagacacacucaaggaaaauacuuucagauggucaucacuuuuggugccuggccucaauucuuauuuggcuuagcuucauuauugguggccuagaacuuggcugguaaguaggagaguuggaagcaaggcuggcugccuggcaaaaccuacuuauguugacuuggauugcuuuugaucuuauuugcuauuuuaucaacuauuuuuauacuccuaaaugaguagaauuucugugguuuuuauagaagaaugagaaccagaaaagccagacuauuuacaacacuuuaaaaaugugacacuaguccuauaauaguacugaagcuacuuguuaugagacuguguuaauuuguuuuaugauuagcguaggaagaagcagcugaggugauaugucccaucugucugcuuuccucuuccuucucuuucacccucaaagaagaugcuggagauucuucagggaagaauaaaaagauuaaauuuagaauauauuuguauuuguguuaagaaaauguuucuuggguuugcuuauagguccuguuauugccuuggaguuuaauggggauggugcuguagaaguaugucaacuuauuguaaacgagauauucaaugggaccaagguacaagauuuuauugacuguauuucaaucuaacuuuucauuucaucuccuuuuccuuacagucaaauaauacuuuaauacuuuugucccuaauguugcuuggaauuuuugggguguguguguguguguguguguguguguguuuaaagcagaucaugauuuuuagaaccuuugauaaauaauugggaacuaagcugugauuuuuuucuugccaaacuaaacuuuaauuguuuaaaauaauuacaaaauaagaaucuauuuauuaaaaaccuucuauaguauauguuucuaaaguaaaaagucucaucaaaugucuuuucaagucuuugcauuuuuaaaaauacugauuuguugaaaauauuuuauuucuaagauuauagucuuuagauggacgauucuguugcccaggguucauuuuuacgcccaggguucauuuuuacuugcuucaguaaugcuucaccaaaaauugaacuucagauauacauagaaaucaucacauguaggccgggcgcgguggcucacgccuguaaucccagcacuuugggaggccgaggugggcggaucacgaggucaggagaucgagaccaucccggcuaaaacggugaaaccccgucucuacuaaaaauacaaaaaaaaauuagccgggcguaguggcgggcgccuguagucccagcugcuugggaggcugaggcaggagaauggcgugaacccgggaggcggagcuugcagugagccgagaucccgccacugcacuccagccugggcgacagagcgagacucugucucaaaaaaaaaaaaaaaagaaaucaucacauguaggcauuuucuaaauauauugaugaaguugcuguaucuaagaauugcagacauaaauaaauuuaaaaccaaacauagaggauuacauuagcaaaucuauaauugacuacuuuuugauaaauaccugggaggacauuuugguuuuaucaucugauuuggcuuaugauuccuugaauuuacaaaaauuaaaguacuuugucuuugaucucauuuuaucaucacaguaguacuaagggagagggaaaauaccagguugaauagaaaaggaaacugagagauaaaaugguuagaauuuggacuuuuagagcugaaugauuuagagauuaucuaauccagcuuucucauuuuacagguguaguuacugagcccacagagguuuauuaaauugucagcaucauaugcuaguuuacgauaaagcuagaauagaacccacaucugcucuaauuccuugcugacauuuguaaaagcuacuuuagaaggguucuauugaguauugcuucauugauguuuagcagauaguuuauuuaaaaauaacaggcugggugugguggcucacaccuguaaucccagcacuuugggaggcugaagcgggaagacugcuugagcccaggaguucaagaccagucugggcaacauagugagacucuacaaaaaguaaaaaaaaaaaaaaaaaaaaaaaaaaaacuagcuaggcauggugguacacaccauuaguaccagcuacuuggggggcugaggcaggagaaucacuugaguccagaagucuaggcugcagugagccaugauugcaccacugcacuccagccugggcaacagagcaagacucugucucaaaaauaaauaaaauaaaauaaaaaauaauaauauaucuuuagcagcuuugaaagggauaaucucaaguuuugcugcucagacuacugagauuauuauuagaaaauagaagaaacaaagaguuuuuuaagugacucuuauucaguagcuuccguaauauugaguguuguaaaaguccagauguaauaaaauacaacucaaguauuaugaaagcagagaccuuaauuauauaagugcuuccaaaagagcuuaauuuacauuauagcuauucaaaguguauuacaugaauucuaaagaaaaucuacagauuaaauauugucauuauaaaugauguacuugaacuucuuuugaauaauuagcuuggaacuuuguucuguggagaacaugggcuuuggcauucugaaguacuugguacugauuuuuuuuuuuaauuuucuauuuaaaauagauguuuguaucugaaagcaaggagacggcaucuggagauguagacagcuucuacaacuuugcugauauacagaugggaauaugaagugcaauguggaaccaggacuugguauuaagccuuucccaacuugugaauauagaauuugauaauacacuuuuguguauuagcaaugguuuuuacuaaugcuaaaacuuuuaaaguuuauuuuuuaauaaauuguugaguauuacaucauuuacuugagguucaaaaauaauucauuuuaaauuaaguaguuuuaaucagcuuaaaagcuauuuaacccauuuuaauaagcuugcaguuuuguuucucugcauaugauauucuuauuagaaaacagaaguagcuaaaaguuuauuauuuuaauccuauuuaaauguucuuucaaaucucuaauaauuuaaacuuuccucagugcuccaugauacuuuuuuugagacuccauaucauugcuuauuuuaccuuuuucaauuuagagggauuuguuacuagucgaucaauuagaaugaaccuaugcacauuuuuauguacacauauccaguuauauaauugcuuccuaguugcauuauauggcaaaugagauuuuguacauggaguugacauaauacuuuguaaauugaauuuuuuaaagaaauaggcauuugauaaccagcuuggcaaguaacucuacuaacagauguugguauagcuauuuaaagacuacuucguaaguaguaugauuauuugaauaaauuacacauuguuuaguuuuuuaauacaacugcuauaugacucuucugcuuccugauaagaaaagguauaugcaaugcuaaaacuguagaagcccaaucaccagcaguuuuuaaaaaggugauaacuuuuauuagcucuugugggcuaucaagagaauuggaacaaaaccuugugacuuuuagguaagaaauaggcaugaugauaagcuaugcagauuauuaaaaagcuugauacauuugauuuuucauuagauaugccauucauaucaaguaauguucaaguaugauaaaauuauuuugguugcuuuaaagcacuguuucccaaaucuaccugaucauaauaauuuaccaggaagcagaggagagcuacuuguuuaaaaauccacauucuuggacccaauccucagaugcacggauucagucuucaggggaaacucuguuuuaagggguauguuguaaucuaaaguaauugguucaggaggugucaauagguugaacuugugagaaggcacugaaucugccauccacaucacauauagcagcuauuaugaaaucagcuuucauaggccuauuuuuaaaaggaaucugaaauuuaauucuauuuugauaaaacuaagacugaaaauaaccacuuguaaacauuccuaugauuguuacuaaaauguauuuucauguuuaaaauguuuuuggauauuuuuggguuaauaacuacuacauugaauugcauguuaaggugcagaaauaauacauuaaaagauuuucacuuuaaauuaauuaguaauauugagcgcucacccugugcguggccuugugcuaaccauuagcacugcaucauuucaauucuuuuauaagggcauucaauacuacaaaaucaacaugauuucauaaggugcaaauaaaaguuggugacagauuuaauauaauuuugaucacaauuuacaaaugaucuuugcaaauaguggucagacggcauuaguuuuucccuuaguuaagcuaaauuaaagggacuccauccuguuaugauuauauuauuauuauuauuauuauuauuuuugagguggaguuucacucuuguugcccaagcuggagugcaauggcgcgaucucggcucaccacaacauccgccuccuggguucaagcgauucuccugccucagccuccugaguagcugggaauacaggcaugcgccacuacaccuggcuaauuuuuguauuuuuaguugagaugggguuuuuccacguuggucaggcuggucucgaacuccugaccucaggugauccguccaccucagccucccaaagagcugggauuacaggugugagcuaccgcgccuggccaugaugauauuauuaaacaccauuauucacauuucaaauaauaacaauacuuuuuguuuuucaaaaauaaaaugcaauguuauauaaagcuauaaacuaaguucuuuaugauauuugagcaacaacucaggaauauaacauauaagggagauguuaauuuaaaaauuuccacuacacuuauuaucuauuaaccaaagcuuaaaauuuuguauucuucuguuagauaagaccuuuuacccauuuaauuugucuuuaaggacagucauuuggcuucugaauguuugaaacgauuuuaaaaaauaaguagugcuaugguuguuucuauaauucuaaccuuugauaguaaucagaauguauuacauuucauuucugaauagcuuuugaauuuaugaaaaauuauuaacaaugaaaaauugguaauuuuauuaaguuauauguguuuaaauauuauauuagcuuauuucucuugcauuaauaguacugcuguuuuuguuuugcuucuuuauauuuaugucuagcuuuuauauguaauuuaucuaguguuuauaaaaugugauuuguaauaaauguuguuaaaaugaa

SEQ ID NO: 192812 - RNA, 45445 nt, Homo sapiens
uucauuuuaacaacauuuauuacaaaucacauuuuauaaacacuagauaaauuacauauaaaagcuagacauaaauauaaagaagcaaaacaaaaacagcaguacuauuaaugcaagagaaauaagcuaauauaauauuuaaacacauauaacuuaauaaaauuaccaauuuuucauuguuaauaauuuuucauaaauucaaaagcuauucagaaaugaaauguaauacauucugauuacuaucaaagguuagaauuauagaaacaaccauagcacuacuuauuuuuuaaaaucguuucaaacauucagaagccaaaugacuguccuuaaagacaaauuaaauggguaaaaggucuuaucuaacagaagaauacaaaauuuuaagcuuugguuaauagauaauaaguguaguggaaauuuuuaaauuaacaucucccuuauauguuauauuccugaguuguugcucaaauaucauaaagaacuuaguuuauagcuuuauauaacauugcauuuuauuuuugaaaaacaaaaaguauuguuauuauuugaaaugugaauaaugguguuuaauaauaucaucauggccaggcgcgguagcucacaccuguaaucccagcucuuugggaggcugagguggacggaucaccugaggucaggaguucgagaccagccugaccaacguggaaaaaccccaucucaacuaaaaauacaaaaauuagccagguguaguggcgcaugccuguauucccagcuacucaggaggcugaggcaggagaaucgcuugaacccaggaggcggauguuguggugagccgagaucgcgccauugcacuccagcuugggcaacaagagugaaacuccaccucaaaaauaauaauaauaauaauaauaauauaaucauaacaggauggagucccuuuaauuuagcuuaacuaagggaaaaacuaaugccgucugaccacuauuugcaaagaucauuuguaaauugugaucaaaauuauauuaaaucugucaccaacuuuuauuugcaccuuaugaaaucauguugauuuuguaguauugaaugcccuuauaaaagaauugaaaugaugcagugcuaaugguuagcacaaggccacgcacagggugagcgcucaauauuacuaauuaauuuaaagugaaaaucuuuuaauguauuauuucugcaccuuaacaugcaauucaauguaguaguuauuaacccaaaaauauccaaaaacauuuuaaacaugaaaauacauuuuaguaacaaucauaggaauguuuacaagugguuauuuucagucuuaguuuuaucaaaauagaauuaaauuucagauuccuuuuaaaaauaggccuaugaaagcugauuucauaauagcugcuauaugugauguggauggcagauucagugccuucucacaaguucaaccuauugacaccuccugaaccaauuacuuuagauuacaacauaccccuuaaaacagaguuuccccugaagacugaauccgugcaucugaggauuggguccaagaauguggauuuuuaaacaaguagcucuccucugcuuccugguaaauuauuaugaucagguagauuugggaaacagugcuuuaaagcaaccaaaauaauuuuaucauacuugaacauuacuugauaugaauggcauaucuaaugaaaaaucaaauguaucaagcuuuuuaauaaucugcauagcuuaucaucaugccuauuucuuaccuaaaagucacaagguuuuguuccaauucucuugauagcccacaagagcuaauaaaaguuaucaccuuuuuaaaaacugcuggugauugggcuucuacaguuuuagcauugcauauaccuuuucuuaucaggaagcagaagagucauauagcaguuguauuaaaaaacuaaacaauguguaauuuauucaaauaaucauacuacuuacgaaguagucuuuaaauagcuauaccaacaucuguuaguagaguuacuugccaagcugguuaucaaaugccuauuucuuuaaaaaauucaauuuacaaaguauuaugucaacuccauguacaaaaucucauuugccauauaaugcaacuaggaagcaauuauauaacuggauauguguacauaaaaaugugcauagguucauucuaauugaucgacuaguaacaaaucccucuaaauugaaaaagguaaaauaagcaaugauauggagucucaaaaaaaguaucauggagcacugaggaaaguuuaaauuauuagagauuugaaagaacauuuaaauaggauuaaaauaauaaacuuuuagcuacuucuguuuucuaauaagaauaucauaugcagagaaacaaaacugcaagcuuauuaaaauggguuaaauagcuuuuaagcugauuaaaacuacuuaauuuaaaaugaauuauuuuugaaccucaaguaaaugauguaauacucaacaauuuauuaaaaaauaaacuuuaaaaguuuuagcauuaguaaaaaccauugcuaauacacaaaaguguauuaucaaauucuauauucacaaguugggaaaggcuuaauaccaaguccugguuccacauugcacuucauauucccaucuguauaucagcaaaguuguagaagcugucuacaucuccagaugccgucuccuugcuuucagauacaaacaucuauuuuaaauagaaaauuaaaaaaaaaaaucaguaccaaguacuucagaaugccaaagcccauguucuccacagaacaaaguuccaagcuaauuauucaaaagaaguucaaguacaucauuuauaaugacaauauuuaaucuguagauuuucuuuagaauucauguaauacacuuugaauagcuauaauguaaauuaagcucuuuuggaagcacuuauauaauuaaggucucugcuuucauaauacuugaguuguauuuuauuacaucuggacuuuuacaacacucaauauuacggaagcuacugaauaagagucacuuaaaaaacucuuuguuucuucuauuuucuaauaauaaucucaguagucugagcagcaaaacuugagauuaucccuuucaaagcugcuaaagauauauuauuauuuuuuauuuuauuuuauuuauuuuugagacagagucuugcucuguugcccaggcuggagugcaguggugcaaucauggcucacugcagccuagacuucuggacucaagugauucuccugccucagccccccaaguagcugguacuaaugguguguaccaccaugccuagcuaguuuuuuuuuuuuuuuuuuuuuuuuuuuuacuuuuuguagagucucacuauguugcccagacuggucuugaacuccugggcucaagcagucuucccgcuucagccucccaaagugcugggauuacaggugugagccaccacacccagccuguuauuuuuaaauaaacuaucugcuaaacaucaaugaagcaauacucaauagaacccuucuaaaguagcuuuuacaaaugucagcaaggaauuagagcagauguggguucuauucuagcuuuaucguaaacuagcauaugaugcugacaauuuaauaaaccucugugggcucaguaacuacaccuguaaaaugagaaagcuggauuagauaaucucuaaaucauucagcucuaaaaguccaaauucuaaccauuuuaucucucaguuuccuuuucuauucaaccugguauuuucccucucccuuaguacuacugugaugauaaaaugagaucaaagacaaaguacuuuaauuuuuguaaauucaaggaaucauaagccaaaucagaugauaaaaccaaaauguccucccagguauuuaucaaaaaguagucaauuauagauuugcuaauguaauccucuauguuugguuuuaaauuuauuuaugucugcaauucuuagauacagcaacuucaucaauauauuuagaaaaugccuacaugugaugauuucuuuuuuuuuuuuuuuugagacagagucucgcucugucgcccaggcuggagugcaguggcgggaucucggcucacugcaagcuccgccucccggguucacgccauucuccugccucagccucccaagcagcugggacuacaggcgcccgccacuacgcccggcuaauuuuuuuuuguauuuuuaguagagacgggguuucaccguuuuagccgggauggucucgaucuccugaccucgugauccgcccaccucggccucccaaagugcugggauuacaggcgugagccaccgcgcccggccuacaugugaugauuucuauguauaucugaaguucaauuuuuggugaagcauuacugaagcaaguaaaaaugaacccugggcguaaaaaugaacccugggcaacagaaucguccaucuaaagacuauaaucuuagaaauaaaauauuuucaacaaaucaguauuuuuaaaaaugcaaagacuugaaaagacauuugaugagacuuuuuacuuuagaaacauauacuauagaagguuuuuaauaaauagauucuuauuuuguaauuauuuuaaacaauuaaaguuuaguuuggcaagaaaaaaaucacagcuuaguucccaauuauuuaucaaagguucuaaaaaucaugaucugcuuuaaacacacacacacacacacacacacacacaccccaaaaauuccaagcaacauuagggacaaaaguauuaaaguauuauuugacuguaaggaaaaggagaugaaaugaaaaguuagauugaaauacagucaauaaaaucuuguaccuuggucccauugaauaucucguuuacaauaaguugacauacuucuacagcaccauccccauuaaacuccaaggcaauaacaggaccuauaagcaaacccaagaaacauuuucuuaacacaaauacaaauauauucuaaauuuaaucuuuuuauucuucccugaagaaucuccagcaucuucuuugagggugaaagagaaggaagaggaaagcagacagaugggacauaucaccucagcugcuucuuccuacgcuaaucauaaaacaaauuaacacagucucauaacaaguagcuucaguacuauuauaggacuagugucacauuuuuaaaguguuguaaauagucuggcuuuucugguucucauucuucuauaaaaaccacagaaauucuacucauuuaggaguauaaaaauaguugauaaaauagcaaauaagaucaaaagcaauccaagucaacauaaguagguuuugccaggcagccagccuugcuuccaacucuccuacuuaccagccaaguucuaggccaccaauaaugaagcuaagccaaauaagaauugaggccaggcaccaaaagugaugaccaucugaaaguauuuuccuugagugugucuuaaagcuacauucuagaaacauagacaaaguuuuuauuuuuuaauccuuuuaauagaauaucugugccuccuuucucauacauuaauuugaaaacauuaaaaaccuccuacagugauggaaaagucuugaucuccaggaaauuacaaauguauugaaagaagacauaaacccauuaaacaaauacaaaccaacacagaauaaugaaguacgaaguaaugaaauacuagagugaaugaauaugaaacacuaaauugaauguaaccgugugcugcaguacaagguacaagaaugagaaagaaaagguuacacuacauugggcaucaagauaacugaaggcuugugauuuuuuuuuucuuggaggcuugugauauaauacaggcaacaaauacagaaaaggcaggauauaguggucccuagguaucugcaaggauugguuccauuuguugcucaaaucccuuauauauuaauaaaaugguauaguauuugcauauaacuuaugcacauccuccuguauacuuuauuaaaaauguauuaaaauuucuuuuagagauagaaucucacggcugggcacagugguucaugcuuguaaucguagaauuuugggaggccuaggcaggaggaucacaagcccuggaguugaagaccagccuaggcaacaaagcaagaccccgucucuacaaaaaauuaaaaaauuagcugggugcagggucacaggccuguagucccagcuacucgagggacugagauggaaagaucacuugaccccaggaguuugagguuauagcaagccaugaucaagccacugcacucuagccuggacaacagagcgagaccaugucucaaaaaaaaaauagauauggggucucacuauguugcucagucuggucucaaacucuuggccucaagcaauccucuugccuucagcccuggccaggaguucaagaacauauuguaauaaaacaucuaaccuuacaaaagaaaagcuuaaaaucuuaaauuuuuauuuagaaauaucaauguaaacucaugaucuuuuccuuuuuaaaaauacauaguuucuagcuauguccacugaaaaagcuuaaaagaaaugacaacccaguaauacauagcaccuaacauguauuucuaaauaucauuccccacuaaaaauaacuaaguaaucuuagaaaaauagaugauuccaugucuggggcaagaaauggauuaaggucaauguggaauauuuucuucagccaaaaaguaaugaagcuaucaaaggccagugggguucuaucaaaaggagacagaagccagccugaaggggcucccaauggccaaagaugagacauagugaaacagaaggaauaaugacucugauuuauuaaaauuaauauauaaaaagucaugaguucauaaugauacuuagagagauccuccuuacuaccagauauuuuuaaggaaaauaaaaaaagaagagagaaacaaaauucacuguauaccaauggagguugcuagggcaccaauucacuacucugaaaauugaugcuuauuuuucucuuuauuuauucugcuuuucugacaugaagcauauuucaaguuaaccaaacagcucuggcauacgaggaguucuguuaacaucuguuaauaaaugcagagguagugacaagauuaaaaaguaaguuugcuaaaaaaaaaaaaaaagaaagaaaauacagaaaacagucauuuugcaacgccuauuaaaacaauugguucaggcaacaaucaucaaugguuuuagcaucccacagagaagacugcaggaaacucuacaauaaaaagagaaggucgucaccguguaaacccaaccauuaaaucuuaguaucccuaaaaguacaacaaucaaacauuaugugccuucucaauuaaugcaacaggaaacaguaccaucuauguauuccugccaaaaaaaauuaaaaaauaaaaguaaaaaaauaacuaaaccugaacguaaacaaggcuuugaucuaacuucuagucugcaagaaauauggaggaacgaauuaaacaaccucauaaauacuauaacauaauugaccaagcuucuuucccaagacaaaggcaagaaaaaaguaguagagggggaacaccuguuuuugauuuaagagcgauagaagauuaaaaaaaaaaaaccaaauacaguaagugggucuauuuuagaucuggaucaaauuaacuguaaaaacacaaagaauuauuuuaguaaguagguaaaucugcauauagacugaauauuagaggauacuaaggaauuauuguuaauucuguuaaaugugauaaugcacuguaguuaagaaaacauuuuuaauuuuguuuuaagauaaugaaauauuuagggaugaaaugacaggaugaaucaauuugauuaaaauguuuuagcaaacaaugaguuuuuuuuuuaaguauggcaagaaguugaugaaacugggugauggguacacaugggggucauuguacucucuacauuuaguacauuuggaaauuugcaaaaugaguuuaaaaaguacuuuaaaccuaauaaauacugaacuaaaaagaaaagguugauaauaaauguaggguuuccaguuuugcaagguagaaaguuugaauuaagguagaauauaguuucaucacuacaaggaaauauaguguguguguguauuuaaguuagacauuuauuauuaaaaguuccagucuuucuauaaagaacauguaaucuagaauucagaaauacaaucuugguagaauuacucagguauauaacuugauugauauugacuagaauaugauaaacuuccaauaaaugaccuaauaauuuuccaacaaaaaaguggacaaaugcauuuguuuuaacauguguggauaaucuuaaauuuaaaaagacuacaauguuugucuuauaugcuugacauagauuugcaacucaguaguuuaugguguuccuagaacgcagcugaagaccugguauguagaggaaauaugagggguggugcuagaagacagacaucuguggaaugauucacauccucucaaauuaggaggauggaggccugcuucauuaagaagcucagggucagguggggguggggaaaacacuuagcaacauggggaaccgucaggggagucuccuuauuucuguucugcauaugaagacuccuauagcagccaggugaggcucucuaguuuaauaaaaaucaugggaagagucugaagacucuucauaaguguuaauagggauuuuuaucagcuuauuuugguugcaguuuccaauuuuugaaaauguuuagguaaucuuuuccaccuucccaaauccuaauucuuuagauucauuaguguugaaccaaugcuuucucaugucucaauucuuuguuuaugcauucuuuucauauguauuaaacaaacaaaaacccuuaaaaaaacuacaguguugacaaugcacuugcuaagcacuacuaaauuuuuuaaaaacuacaauguugacaacacacuuguuaaacacuacuauuugucccucuaucuaaugaugaugccaauuacugugauuauuucuaacugaacuaugaggucaacaaggauuacuggucauguuuuuaguguuuuaauaugaacaucuuauucagagaguucaugguagcuuuagaucuaaauauuucagcugucaugaaaaauugugagacucugaagcagacaaaaaagauuucuggaugucuuaucuagugaacccuucugagaucuaacaugaccuuggaacaagccacuaugucucaauuagauuacugcaacagccuccuagcuggucuuucugcuuccccauuaaagcgaccagugacaggauuuacacuuuaaaaggaccaugacauuccucugcucuaaaacugccuauaaaguaugaucuauauuuuuauuuuuaauugcucuaaaaauaagugacgguucaggccaggcacaguggcucacuccuguauuccuagcaguuugggaggcugaggcaggcagaucgcuuuagcccaggaguucaagaccagccuaggcaacauggcaaagccccaucucuacaaaaaaauacaaaaauuagccaggcguaguagcccaugucuguaguccaagcuauucgggagacugagguagaagaaucaccugagcucuggaggucgaagcugcagugagccgagaucaagccacugcgcuccagccugggcaucaaagugagauccugucucaaaaacaaacacacaaacaaacaaacaaacaaaaaaacaccagacaguucaaagcaauaacauuaacaacguauuagguguuuauagcauauacaacaguaauauaugacaauaaugacacagagaugagaaggaagaauuaagaauauaauguuaucagguccuuagaugacaggugaaguuguguaauauuagaagguagacucaaauuauuuaaaaauauuugcuguaaaacccaacauaaccauuaaauaaguuuuugaagaagagguauaaauaugucaauagacaagauuaaguggaauuacaaaacugcuaaaaagaaaaagagguaauaagaaaaaaagaacaacuggaacaaaucagcuagcaaaaugaaagauuuugauccaacuguaucaauaaucccuuucaaugugaauggucuaaauacagcaguuaaaagagacuggauugaaaagcaaaaaccaacuacaugcugucuacagaacacucacuuuaaauauacagccuugauaagcuacaagaaaaaaagauaaaucuuuacaauaaaacacuaaccaaaugaaagcuagaguagcuauauuaauuugagaugaaguagauuucagaacaaggaaaauuaucagagauaaagaaagacaucagagucggacaugguggcuugugccuguaaucccagcuacugaggaggcugaggugggaggauuacuugagccccaggaguucgaggcugcaguugagcuaugacugcaccacuguaccccagacugggugacagagcaagaaccccucucuuaaaaaaaugagggacaucacauaaccaugaaggauucuccaagaagauauaacaauccuaaauguguaugcacauaauaacagagcuucaaaauacaugagacaaaaccugacaggaucugaaaagagaaacagacaaauccaaaauuacaguuggaggcuucaacacuccucucucauugauuuauggaacaaguaggcagaaaaucagcaaggauacagauaaccugaauagcacuaucaaccaacuugaccuaguggacauuuauagaaaauucaaccaagcaacagcagauuacacauucuucucagaugcacauagaauauucaccaagauaagccauauucugugccauaaaauacauuuuaauauaaaaaacagaaaucauacaaauguguauucuuggaccauaacaggauuuagaaaucaauaauagaaauacacuugggcaauccccaaauguuuggaaauuaaacaauuauacuucuaaauaauccguggaucaagugaggucucaagggaaacuaaaaaauaguuuuaacuaaaucaguggucaacauacuuuuucuguaaagggccagacaggaaauauuucaggcuuugugcaccauaauguaauagauaaaagaaugaguggccgggugugguggcucgcaccuguaaucccagcacuuugggaggcugaggcgggcagaucaccugaugucaggaguuugagacuagccuggccaacauggugaaaccccaucucuacugaaaauacaaauauuagccgggcgugguggcgggcaccuguaaucccagcuacucgggaggcugaggcaggacaauugcuugaacccgggaggcggagguugcagugugccacugcacuccagccugggugacgagagcaaaacuccaucucacaaaaaaaaaaaaaaaaaaaaaaaaaaggaaugagcguggcugugcuccaauaagacuucacuuauuaaagcaggcagugggccauaauuugccaaacucugaauuaaauaaaaaugaaaauacaacauaucaaaauuugugagaugugcuaaagcagugcuuaaaggaaaaauuguaacauuaaauaacagauauagucaauccucauuauaugcagaucccuucauuucaaauuuaccuacuugcuaaaauucauuucuaacuccccaaaucaaugcuugcagugcuuucaugguuauuuguggacaugcacaguggcaaaaaauuagaauugccugaugugcaugcucccagcugaggcugaacaaggugauacucugccuguuucagcuauuguaguauaagaaaguguccuuugugaggucuagguagugccguauuuuucacauuuuugugcuuuuuguuggugauuuuaccuguuuaaaauauccccuaggccaggcacaguggcucaugccuguaaucccagcacuuugggaggcugaggagggaggauugcuugaggccagaaguucaagaucagccuggguaacauggcaagaccccaacucuacaacauuguuuaaaaaaauagcugggggcugggcgugguggcucauaccuguaaucccagcacuuugggaggccaaguuggguggaucaccugagcccagcaguucaagaccagccugggcaacaaagcaagacccugucucuuuuauguuaaaaaaaaaauagcugggcaugguggagugaaccuguaguccuagcuccuugcgagucugaggugggaggaucaccugagcccaugaguuugagguuacagugagcuauggucauaccacugcacucuacccuggcugacagagcaagacccugucuccaaaaaaauaaaauagcccccaaacacagugcugaagugcugucuaauggcuccuaaacugaggaaaguugugaugugccucaugagaaaauguguuagauaagcuuugcuccagcaucaguucuagugcuguuggcugugaguucaauguuaacgaaucaacaguauaugcuaaauaagguaucuuuaaacacacauuaaacaaaguuauguauugcaccaggcgcgguggcucacgccuguaaucccagcacuuugggaggccgaggcaggcggaucaccugaggucaggaguuugagaccagccugaccaacauggagaaaccccaucucuacuaaaaauacaaaauuagccgggcgugguggcacaugccuguaaucucagcuacucaggaggcugaggcaggagaaucaccugaacccgggaggcggggguugcggugagccgagaucacaccauugcacuccagccugggcaacaagagcaaaacucugccucaaaaaaaaaaaaaaaaaaaaguauguaugaaaaccuacaacugacggccgggcacgguagcucacgccuguaaucccagcgcuuugggaggccgaggugggcggaucaccgagaccagccugaccaacauggagaaaccccgucuucauuaaaaauacaaaauuagccgggcgugguggcgugccuguaaucccagcuacucaagaggcugaggcaggagaaucacuugaaccugggaggcagagguugcggugagccaagaucgcgccaucgcaguccagccugggcaacaaagagcaaaacuccgucuuaaaaaaaaaaaaaaagaaaaacuacaacugacauaauuccuuuuaaaauuuuuaauuuaauuuuuuuaagagaugggggucucacuuuguuguucaggcuggucuugaacucuuugcuucaagcaaucuuccugccuuggccucccaaauugcugggauuacaggcauaagcaacugugccuaaaccugacaucgauguuuuuguuguuuugagacaggaucuccuugggucacuccccccaaggcuggagugcagugaugugaucucagcuaacugcaaccucugccucccaggcucaagugauccucccaccucagucucccaaguagcugggacuacaggcacgcaccaucacacacccaacuaauuuuuguauuuuuuuguagagaugaggcuuugccuuguugcccacgcuggucucaaacuccugggcucaagugauccaccugccucagccucccuaagugcugggacuacaggcaugagccacugcgccuggccacugacauucuuuuuuuuuuuuuuuuuugagauggaguaucgcccugucuccuaggcuggagugcaguggcgcgaucuuggcucacugcaaccuccaccugccgggcucaagcgauucuccugccucagccucccaaauagcugggauuacagacaagugccaccacgcccggcuaauuuuuuguauuuuuaguagagacccggguuucaucauguuggcaggcuggucucgaacuucuggccucaagugauccacccaccuuggccuccuaaagugcugggauuacaggugugagccacugcgcccggccuacaucauuccuaagggugagacugaacacuugcagaauagugauggaaggcaucuuugccuugcuccugagaucagccuccagaguagcuggggcuacaggcgcaugacaccaugcucggcucauuuuuuuuuucuuuuuguagagacaaagucucauuauguugccuaggcugguuucgaacuccugggcucaagcaauccuccugccucggccucccaaaguguugggauuacaggcaugagccaccacgccuggccuaucuugacaaauucccugugaaucuaaaauuguuucaaaauuaaaaguugauuuaaaaaacacaaugagauaucaugacacaccuauuggaaaacugacaauagcaaaugcuagcaaauuacccaagugacuugaaaaguuauguacacucaaaaaccuauauacaaugcaggucccucaaaaaacuaaaaauagaacuacaacaugauccagcaauuccacaacuggguauagauccaaaagcaaggaaaucaguaugucaaagagauaguugcacucaugaucacugcagcacuauucauaauugucaaaauaugaaaucggccuaauugcccaucaacagauaaauggauaaagaaaauguguuacccuuauacaauggaauauuagucagccauaaaaggaaugaaauccugucauuugcagcaacauggauggaacuagggaccacuaguuaagugaaauaagccaagcacagaaagacaaauaucacaugcucucacucauaugugggggcuaaaaaaaguggaucucaugaagauagagaguagacuggugguuaucagaggcuggaaaaggggacaguggggugggggggaauguggagaaaaaaagagaauguaaauguauuaccacugaacuguauacuuaaaaaugguaaaggugguaaauuauguauguauauuuuaccuuaauaaaaaaacuuacacacaaauguuuauacuggcuuuauucauaauuggcaaaacuggaaacaagcaggauguccaacaauugaauggaaaaacaaacugguacaucaauacaaggaauacuauucagcaauaaaaaggaacaaguuggcuaggagcgguggcucacgccuguaaucccagcacuuugggaggccgaggcgggcggaucgccugaggucgggaguucgagaccagccuggccagcauggugaaacgccaucucuacuaaaaauacaaaaauuagucgggcgugguggcaggcaucuguaauccccgcuacucgggaagcugaggcaggagaaucgcuugaacccaggagguggagguugcagugagccaagaucacgccauugcacuccagccugggcaacagagcgagacuccuugucaaaaaaaaagacaaaagaaaaaaaaaggaacaaguuauugagucaccuagcaagaagacugaaucacaaaugcauuuuaauaaaugaagccagacccaaaaggcuacauguuguaugauuccauuuaugguacacucuggaaaagacaaaaucauagggacaggagacaaaucaguugccaggaguugugguugacugacuaaaggggccacacaagggaaauuuuuagggagaacuguuuuccaugguacuggggugauaaguggggugguggacuuuaugcacucaucaaaacucaugccaacugaauguuacuguaugcaaauuuuaaaaaauuaaccaagaugucacaguauccaaggauggaaugaagcuuguaacaaaugaaucuaacaguauuagaaaugugugccaauacuucaaugaaggggauaagggaaaaaggagcuaaccucaggacuuuggaaaacuguuuugaguggcuacuguaaggcuaaagacaagacuguacaauaccaacugcacucuaguuggcaaauaaguuucucacagggguauggguuaguaauucuaaaaauauauuauauuuauacuaggguuaaacaaauaagugaauaaaauggacauaauggaagccagguuucucacuuucagaguaagaagucacaaaaaagcaagggaagggaugcuagaaugaacccuguggugcuggauuagggucagagguauuuuaauagauagauagauagauacaggauuauagauguguguguauauacagguuaauagucauacauguauuuuuuaccuuugucuguugaaagggccuagaaccagugguaccccauuaguaaagggcacaccuagcacccagaucaugguuucuaacuaucauucuagaauaaaagaaaccagcguuccuuggagaaaugguugauacuaguucuggagcaaggaaaaauacaggaugagccuggagcaucuuguagggccaggaaguaaggaaguguucaaaauucaaaaggauggggcaugucaaagggacaaaaaagccaaccuaaaagagcuccagaugguuaaaaccagaacaauuugauaguauuggauuauaacuuaaaagaacaaaauacacacccaugagaaauaaaugauugaauaaauggggagaagggacaaaucuuuuuuuuuuuuuugagacagagucucacucugucgcccaggcuggacugcgguggcaaucuuggcucacugcaaucuccgccucccagguucaagugauucuccugccucagccucccgaguagcugggacuacaggcaugcgccaccacauccagcuaauuuauguauuuuuaguagagaugggguuucaccauguuggccaggauggucucgaucucuugaccucgugauccgccugccucagccucccaaagugcugggauuauaggcgugagccaccacacccagccaggacaaauguuucuuacagaauuccaaauaauguauguggauauuccugucucccgaugguagagcuuaauucuccucuccuugauuguguguugaucuuagugacucauuuucaaagaauggaguauggaaagggaaacauggaaacuuuacggcagagaaaucuggcagauaucaccucauauugacaucaugugcccugugaugucgugaugagaagggcacuuccucuuccuaaaaacccauaacccuagucuaaccagaggaaaaugucagauaaacauaaauugaggaacauucuacaaaauaauugaccacuacuauucaaaaguuucaagauuaugagaaacaaggaagacugaagaaaugucacaucugucacaggaaauuaaggagacauggcaacaaaaagcaaugugggaucuuggauugaauucuggaacugaaaaaggacauaaguugaaaaacugguaaaauuugaauaaagucuguaguuuaaguuagcauuuuaccaauguaaauuucuuagcuuugacaaauguacuaugguuauguuaacauuuagggaagcuggguaagggauauacagaaacuuucuguacuaucuuugcaauuuuucuguaaaccuaaaaucauuccaauauaaaaaguuuauuuuaaaaaagcccacaaauguccaguagcaucucaucucacucagacuacuauagaagccaaagucucuacaguggccuacaaggcccuucauuaucucucucucuacuucucagaccucaucuacuauguuuguugaauaauugaaugaauuacucccuaaaacaaaagaacccaagucugacuaaucuggagaacuaucaaaaaaggaacauuccaaggguacaucucaaagauuucugaaucaggcuuucuggggugggaguagaaaauuuguuuauuggcugggcuugguggcuuaugccuauaaucucagcacuuuaggaggcugaggcggacgcaucacaugagcccaggagcuugagacuagccugggcaacauggcaaaaugccaucucuacaaaaaauacaaaaauuagcuggguaugguggugcacgccuguagucccagcuacccaggaggcugaggugaauggaucgcuugagcccaggagucagaggugggaggauugcucgagcuccggagucagaggugggaggauugcuugagccccgaagacaggguuugcagugagccgagauugcagcacugcacucuagccuggacaacacagugagacccugucucaaaaaaaaaaaaaaaaagaaaggaaggaaggaaggaaaauuuguuuauguauuuauguauuugagacaaggucucgcucugcugcccaagcucgagugcaguggcacgaucaugggucacugcagccucaaccucccugggcucaggugauccucccaccucagccuccaaguagcugggacuacaggugcacaccaucacacccagcuaauuuuuguagagacaggguuuugccauguugcccaggcuggucuugaacuccuaggcucaagugauccgccugccucagccucccaaagugcuggaauuacaggugugagccaccgugccuggcugaaaauuuacauuuuuaaaagcacccuggaugguucugaggauuagucagauuuggagauccucaugauggaaaacaaugaauucucuuauuaagcagucaaauagcuuuauuaaauauuaaaaauaaaugugacuauugcaacugaagaggaaaauugagagacucugaggugcaaacuauuuaagauacaugugaauucucaaaagaaauaaauaaauaagaccacccuuaguucaguacagugauucucaacugggagcaauuuugccucccucccacaccccuggggacaucuggaaacauuuuucguugccacaacuggggugguguuuuauuggcaucuaauagguagaggccagagaugcugccaaacaucuuguaagguauaggacagccucucauaacaaagaauuaccuggccuaaaaugucuguagugccacaguugagaaacccugccuuagaaugacugauggccacuuuuagauaagggcccaguccauccaacuccugcuagaauaucuccacugccagccuacucaguauuccacaggaaucagcgcacugcugagcagcuuaaaaguuuuccccaacuuuuuauuuugaaaauuucuauacauuauagaagaauugaaagaauagcauaaauaugcauuugcccuucaccuacacccaccaaaaguuaacauuuguccccauuugcuuuauuacaaaauaaacaccaucuaucugcacauauaugcuuuguuuugcugagucauuugaaaguagcagacauaagaacacuucagcauguaucuccugcauaaccacaccaccauuauuauaccaaaggaucaacgauaauucuaucucaucuucaaacuuccccacuugucccaaaaaugcuuuuuacagcucacuccaacccaaccuaagauccaaucaagguucacucauugcauuuaguuguuauaucucuuuagucucuuaauccagaauaauucccccauauuuuuuguuuuccauuauacugucugaagagaccuagccaguugucuuguagaaugucuucuauuuuggauuugucuuauuuccuuauggugucauuuaacauauuucuuuucuuccuacacuacaaacuacaaguuaagucuuggcucaauuagauucagguuacuuuggcaagaacacucuacauaugauguuguguauuuuucaaugcaucacaucacaaauaacacguuaggcuguccaucaaugaugcuguuugaucacuggguuaacauggugaucaccaaaucucugcuguaaagguacacuuccccuuugaauuaggauguauaaauauccuguuggguuuuuuuguuuguuuguuuguuuguuuuuuugagacagagucuugcucugucgcccaggcuggagugcaguggcgcgaucuuggcucacugcaagcuccaccucccggguucacgccauucuccugccucagccuccugaguagcugggacuacaggcgcccgccaccacgcccggcuaauuuuuuguauuuuuaguagagacgggguuucaccguguuagccaggauggucuugaucuccugaccuugugaucugcccgccuuggccucccaaaguguugggauuacaggcgugagccaccacacccggccauuuuuuuuugagacagagucuugcucuuuugcccaggcuggagugcagcagcgaucuuggcucacugcaaccuccgccucccagguucaagcaauuaucugccucagccucccuaguagcugugauuacaggcaaccgccaucacacccggcuaauuuuuguauuuuuaguagagacaggguuucaccauguuggccaggcuggucuugaacuccugaccucgugaucuacccgccucagccucccaaaguguugggauuacagguaugagccacuacgcccagccaaauauccuacuucuuagcaacuuuuaccccaauaguuuuagcacccacugauaaucuuugucugaaauaauuauuacauugggguuggaaauggugauuuccaaaguccagcauuccuucugcauuuuuuagcucacaauauuccauaaacagcagaugaacauucuuuucuucucuccccuuuuuguuuaacaauauggaugcauagauuucuguuguuaaaucauuaccuucauucuucucuuuuuuugagacaaggucuugcucuguugcccaggcugcagugcaguggcaugagcauaacucacugcagccucaagcuccugggcucaagcaacccucccaccucagcuccugaguagcugggacuacagguaugcaucaccccuagcuaauuuuuguauuuuuuguagugacaaggucuugcaacguugcccagauggguuucaaacuccuggccuuaagcaauccuuccacuucacccucccaaaaugcugggauuacagggguucggcacuacauccagucccaguauuccuuuuaauuguuaaauugucccaaauuuggcccauggaaacuccuucaagcuggcuccuaagaucuuuugauaugaacucaucagucuuugaauacuuccuauaggcaucucuuguuuuuaagacuuguuuauauaauauuuauuugcugaaauuccugcaacaucugcuuauugguuuuaguucuacuuuuugcagcaauagaacauuuuacuucuuccauguggaauguucuguuacuuaaaugcagauauuauauuuggguuggagcaauucuacaauacgacuucacuaacaucacacagguacauaaaucauuaauuuagcucuaccgauaugcucacuuuauuccuaacucucacacuuuaggauguccaauacacuuauuaccugauucaauuuccaaaagcugcuaagaaguuaaacauucauuuucaagcuuccaaauguucccaugucaaaaugguugcaucaaaggggccaggucagaauuuccuacauauauucugggguagauucaugcagugggucacagcaaguccuugcuaccacuacaguaaccacagaaguauuaucaaauacugcauuaauacuuaccagcugaguuacacccagcauuacuuauuauccuaacauuccucuaacauuugcauacagauuuuugcaguuuauuauaauauuuuuauacauaaagagcacauaaaaugcagaugugcccucucucuagggaauacccaaucaacacugcguauuacuauacauauuugcucaggccagucaaggaaagccugaugagccuugagcaaacaauggccccacucugaacagauaaagaguacucuguccucuagaaucaauacaccuucaaauacagguaggcagacaguaacccuucaagugggcacacauacucaaguuccucucuuugaagaccuauauccaguaucugaaauuuauugguggcauuuacccacuagggaaaacaauucuaauuauacauggaaguuaaucaaucauauuaaauacauaaaauaguauaccacuuuauauuucuuauuucuuuuccaguaugauuaaagcacacugaagguagaaagaaucuucaucaagugcuuugcaacucugagcagggagcaugaaauauuuaucacuacacuauaaagguacaacaauaauacaacaauuaaaaugauaauaagauacauaauaaaaugugacuuucaguacuaagaacagaggauagggaaaaaaaaagaaugccuaauuucuaguuaguugucuagggcuccuugagugaugugaaauuuugacauuucagaacaauaauagaaaaaaaacaaagaacaaaugagaaagagaaggcaauguaaaacaaauguuaaaggcaaaaguaaaucaaaucagcauguaaagaaaauauccacaaaaguauaccaaucauccagaagguaccuuuguucagaagaggaaggaagucaggugcuuuuucccgaaaaacccuuugagcauccucagcuuucauggacacuuccuuugucugaacuaggaaaaagccuuuaccaaccaucugugaaaauaaaauuucauugagauuuuaaaaugaacuucugagacuaaaacaaugauuuccuauucuaguauuucucuguauaaaaugcaacaacagcacacugauuuuuguuuuaauuauaagucuaauucaggguguuugcuauaauaaguucucacuauaugagauucuuucuuacagaugggugguucugguuuaguacugcaguuaagguuaagggucaaauaaaugugaauuaucucucaaguuuaaaacaugauuaaaauuuuucuacaaccagauggaaguuuuaguuuggugauacugcaaauguccaauaagaagagaaugguuaaguaaauuaugguacagucacaugaugaaaugccacaguucauuacauuuaucacaguucauuaaauacaacaaagauguuauaauaaaaugaggaaaagcuuauguaauaauguuaauuuuacuuuuauuuguuuauuuuucuuucuuuuuuuuuuuuuuugagauagggugucacucuguugcccuggcuggaauguaguggugcaaucauagcucacugcagccucaaacgccuggguucaaacgauucucccaccucagccucccaggcagcuagcugggacuacaagcucgugccaccaugccuggcuaauuuuuaaaauuuuuuuuguagaaacagguucuugccauguugccaggcugaucuugaacuccugggcucaagccauccuccugccucagccacccaagaugcuggaauuauaagcaugagccacuguaccuggccaauaauguuaauuuuaaaaggcaugauacaaauuuauauaguauagcacaauaaugguagaucacacuuauggagcacuuaccauguggcaggcaguuuuauguacuuuacauauauauauuuaacccucucacgaaguagguaucauuacccucauuguacagauaugaaaacuaaggcgcacagugauuaaggaacuugcccaaggacauucaacaauuaagugacagagcugugauucaaaccuaguuaaucuaauuacagacuaaauaaauuuaaaaaugauuccuaaaaagauuauucaagguaugguacaauuauguauugauuuuaaacuuauuuuacucuuucuuauuucuauaauucuccacaaugagggcauauuaauuuuuaaaguaauuaugaaaguaguuuuuaaaaaugcagucagcccagcaucauggcucacacaugcaucccaagcacucugagaggccaaggugggaggacugcuugagaccaggaguuugagaccagccugggcaacacagcaagaccccaucuuuauaaaaaaaaauuuaaaauuagccaggugugguggugugugccuguaguccuagcuacucaggaggcugaggugggaggaucccuuaagcccaggaguuagaggcuacacugagcuaugaucucaccacugcacuccagccuggacaauagagcaaaaccuugucuuuaaaaaaaaaaaaauguagucauauuccaaccacuuaauuuuuagcaaagcuuguuagguuuuuaauaauuaaaaguaacauauauucucaacacagaacauuugaaaaauaaaaaauagaaaugaagaaauaucaaccagggugcugcaacuaaaagaugcuacugccauacagguauacccucccaguuuucuuuuucucccauuacagaaauaauauaugcucacuguuaaauccauagaacuacaaaaaaagaaaacccugcuguuaaucaacugccuaagaauaagcaugccuguuaacauuuaaguaucuauaacuuuccagacuuaccuacuuaaaaaaaucaguuacuuaccuaauauucuacaaauuuucacuuacuuaauugugacauuuucuacauaaagucaguuuuaauggcugauaguauuucauccuauggcuacauuauuccauaccauuccaucgaauuuuauuaaacucaaauccuauuucagaacccucauucaaugcugccuccaaaaaaagaaacauacauuuaaaaauuguagagaauuacauggacaucacugccagaugacuguaaaauaaaaauaucagaaacaauucuaccucucuuauuuucuagagugcuuaucaucucugauuuuauaaacacaaacugaugagauuaugaugauuacuucaaaauaauguuaccuaaauaauaaacuauauuuuaauauuucacugcagauauuugaagagacuccuuuucaugaaaauucuacuuuuaaagacuugaaaauagugguaacuacccaacuucaauuucagaugaugaaguacucucaaacuauuuuacucuauuuuauccuguacauaucugugauguagguaagagaagucgaggaaagaaaaacaauuuuuauuguuuguuuguuuuugagacggagucuugcccucucgcccaggcuggagugcaguggugggaucucagcucacugcaaccuccgccucguggguucaggcaauucccugccacagccucccgaguagcugggauuacaagcacccaccaccacgccuggcuaauuuuuguauuuuuaguacagacgggguuucaccaucuuggccaggcuggucuugaacuccugaccucgugauccacccgccucggccucccaaagugcugggauuacaggcgugagccacugcgcccggcuggaaucugauuuuuaggugagaaaaccaaagucuaguaacuucucuuggcucccuauggaaugucuuuuugcuuuacccagccuuuuuggacuuccuaaccucucucaaauuguauacuuccuauugcgaaaaaaaaaaaaucauuauuuaaugcauuaaaacaaugugaaacaaaauucuguaauccuccugggguuuaacaaauauagaguuagcaaucauaguuucagucuaagcuguccuaagacauuuguguuaugacaugagaaagacucaaguuuuauuuuuuucaucucaagauucacuagcuucuauacauauuucccugcgaacucaucucauuuuuuaaaaaauguaaucucucaauauaauauauaagucuuuugucuuucagcauguuuugauacccucuucacauguacuugguauuuuauuuuuuauuuuuguuuguucucuucauuccuuaauucuguacuuucagaauaagauaggauaacuauagccaaauagucccuagacuggaaggcccuagaguccacaugcuuucagucacauuccugcuccaccaggcauucagcaacuuuccuuuaccacugagggagcauaacagcaucauguuuaaggguuaagguguggccuacacagccagacugccuggauuggaaucauggcucugcuuuuuccagcugaaugaccuuuugcaagguacuuacccucuuuauggucuauuuuucauaucuguaaaauggggaauaauagcaccuauuucauagaguuguuuugaguauugaguuaauucauuuaaauuccuuacaauagugccuggcauauaguaaacacuauguaaguguuaguuauuauuaucgcugugggauuguuuauauuguauuccagaggauaucuaaagaauaucauucuuccuggucauauucuuuucaagggcacacaacacugccauuucacauaccagauaccaaagguuaaaagguuaagaacauuuggugauucaugaagaaacacuguuuugauggcuuuuucuuuaaacaugcuaaauauucuuuauguccacuccucauuaccuaugaaaaaggaguuuaaccuaaauaauuacauauuuugaaaacuguuuguaguuuuuuuuuaaaucaccauacugcauaaugaaagcauuuaccucucagauguuggauuaacaugugaucagauagcucaaaagccagaagcacauuuuucuguaucuuaccagauucauggaauguuuuuaucacauaggcauaagcaaaagagaaaauauaaaagucuuaaaauuaaacuuuggcuucuguugguuuaaaaacuauaccucagauauacuuuguggauuucagacauuucuacauggguuuucuacauuguggaauauauagcuauugagagguauucauuuuuaguauuuuccuaaaaucauuccuuuugauauguuccaacuuaaaaaaaaaaaauccauucaaaaagagacuugaugaguuuuccggccgagcgugguggcucucgccuauaaucccagcacuuugggaggccgaggcggguggacugcuugaggucaggaguucgagaccagccuaaccaacauggcaaaacccugucucuacuaaaaauacaaaaauuagcgggcaugguggcaggcaucuguaaucccagcuacucgggaggcugaggcaggagaaucgcuuaaacccgggaggcagagguugcagugagcugagaucgcgccacugcacuccagccugggagacaaagugagacuccgucucaaaaaaauaaaaagagacuugaugaguuuuccauucacuucucuaugucuuuaaguuugguuuuuaaauucaaacagauuccuccugaaggaaccugauuaauggauaaucaauacauccuacugcugccuucccacuggagcacccaccaacuaaggaacugcugcuucuggagccccuaaccucuguaucuccaauuauuuuucaagcagaagcugcuaccccaaaaagccuucucuauucaugagcucaccaagacccacuguucaugagccuaugagcuuugccaaccuagcuuccaucucacucuucugcaucaagcucccuucuauggcaauaaaggaaaauaaggaacguaauguggagguugcucucacagucacaacaggguccaaaaguuguauuccuaaauguacuuuuggcugggugcaguggcucaugccuguaaucccagcacuuugggaggcuuaggcagguggaucaugaggucaaaagaucgagaccauccuggccaacguggugaaaccccgucucuacuaacaauacaaaaaaaauuagcugggugugguggcgcccaccuauaguuccagcuacuugggaggcugaggcaggagaauugcuugaacccaggaggcagaaguugcggugagccgagaucgcaccacugcacuccggcugggugacagagcaagaccccgucacaaaaaaaaaaaauugcauuuucuuacccccuaaccaauuagaacucuaaagaaauuuccccacuaaauaauuauaaaaugucaugcuuuacuaagcaguacuacuuuugugagcuucucuggaaaucaucuaguauaauggaaacucuuuaagggcagagaauuuugucuauguaucuucaucuccagcauacacuauaguucaucauuucugaguugcuaucaauuauaagaugcauuccagauaagcaaaaucauggaaaacaaauaggcauccuaucaucagugaaauaugauaacaguaacuagcacauaauaggugcuuaaugcuuacugauuugaauuauauuuuuuuaaaguuucuuugggaaaguauuuugaggcccaagcaaucuacuuacaaacaaaugcuuaaugcuuacugaauugaauuauauuuuuuaaaaguuucuuugagaaaguauuuugaggcccaagcaaucuacuuacagaugagucuguugggagagggggugguggcaaaggacuauaacuugaggguugccuguauuuccaauagccaauuugaaaagaauggaaguacuccagagugguacauuuuuaaaucuagguguaugacuauuucucuucucuuucuccuuaccucaucaauuaguuuucuggcauuugcaauaguguaaucaccagcaaauaauaccacuaagcaugauucaucgcugcucuucugucucugaccccgggauauuggaacaaugcuucuauuggcuucuguggaaacacgaacagcuuugagcucuucgguaguagguauaggaacauaguccugaaccacagcaucuucuggaagaaggcuccaguugaguucuccugacacagguguaaagucaugaauguuacuccauguauuguugaagauacuuagcccugcaucuuugaacuggaaagcuaauucaggauaguaccauugaaaacauccaaauuugauauuugaggaagacucaaugauggguugaguggcacaacacaaaaagacuuccagcuuucuacaaucucgcacacgaaauuguuggcaggcuaaugugcacuugcaaucucugcaauuccggaaaaacacgcugccuuucacgggucccagaaaaauuaugcaguuaguacagucaucaaugguaacuguagcagagugaucaaaaauauagauguuacaguucucacagucuugaaugagaaacuguuguccugcuaccgucccagguaagcgaccuacuguuucauccuucaguccacugaacauguagucuuuuggaucaaccugcaggaacaaaacacagaccuugaguauuauuaacauuauucaacaaguaucaacuaaaggacuauuggcugccaggcacaguucuuagugcugaaauauaaauucuuaaucucaaugacuuugaaacacaguaacaaaaugaacaggacaaauuguuucucucaauaauaauauaaaaccuaugaucuuagucaacauacacaccucccagaagacagauccccucucuuugcuauuaaauuguguucugggcaugcaaagcuaaaggguagccucugugacacuaugguuugaguuuucccaugacuuaacccaagugacaccuacaucaucauugcuacugucaauauugucaguaggcuuuuagccuauuuggaauuuauaaaaguaaaaaauguacuaagcuuuguagaguaccagggucaaaaauauauuuuuaaaugauuguuuuaauaaaagcgcuaugaaaaauucaacucauauccuauguaucuaaugaucuuaaccaugaccuugcuauuucagcuuucugauacuuuuucuuuuuugaugcuucauuuuuaaaacuucuaauuucuaaaaaaaucugaggcugggugcaguggcucuugcuuuuaaucccagcacuuugggaggccgaggugggaggaucagaugagaccaggaguucgagaccagccuggccaacauggcgaaaccccgucucuauuaaaaauacaaaaauuacccaggcgugguggcgcaugucuguaaucccagcuacucgggaggcugaggcacaagaauagcuugagccucggagguggagguugcagugagccgagaucgcaccacugcacuccagccugggggacacagugagacucugucccaaaaauaauaauaauaauaaaauaaaauucugaaauugggaauguacccagacugaaauauauuucucuauccuuuuucaaaucaauguauggucucaguuucuaaaccccaacugauuucugcaauaugcuacagaaaacagaagaaccugaaggcacaagaaucacaauauguaaaugcaagcaaauuugauucaagcauuuauuaagcuacaacgcaauuuuucaaauuuggccauuucuauucuuagaucuuccaaacuauagcucgcuccuuccuucacuccuucuuucgcuccuuucuuccuucgcuacuuccuuccuuccuuccucccucccucccuuccucucuuccuucccuuccuucccucccuccuuucucucucucucuuucgagacggagucucgcucugucgcccaggcuggaaugcaauggcgcaaucucagcucacugcaagcuccaccuccuggguucaggccauucuccgccucagccucccaaguagcugggaccacaggugccugccaccacacccggcuaauuuuguuuuuguauuuuuuuuucugagauggagucucgcccuguugcccaggcuggagugcaguggcaugaacucggcucucuccugucucagccucccgaguugcugggacuacaggcacccgccaccaugccuggcuaauuuuuuguauuuuuuaguagagaugggguuucacuguguuacccaggauggucuugaucuccugaccucgugaucugcccgccucagccucccaaaaugcugggauuacaggcgugagccaccacgccuggccccuguuuuuguauuuuuaguacagaugggguuucaccauguuagccaggauggucucgaucuccuggcuuugugauccaccugccucggccucccaaagugcugggauuacaggcgugagccaccgugcccggccuuuuucuuuuuuugagauggaguuucacucuugucacccaggcuggagugcaauggcgcaaucuuggcucacugcaaccuccaccucccggguucaagugauucuccugccucagccuccugaguagcugggauuacaggcgugugcaaccaugcccagcuaauguuguauuuuuaguagagaugggguuucaccauguuagccgggcuggucuuaaacuccugaccuuggaugaucugccugccuuggccucccaaagugcugggauuacaggugugagccaccgagcccggcccacauaaucuuuuaaacaguaugccuggaaaaugucacauuaauuuuuuuuauuuuaccugaccuaucaaaauauggucacuaaaagccuauuuuuguuucuuccaugugacuuucuuaucuacuucaacuguuuuaacuguuugugacuauauaaacuucaugcaaaaccauucaugcaccauaggcucccauauauacaauauguaaaaauuugauuuacaaagcaaaauuuaaucaucuuaaugauuagcaaaugagcuuaaauugacuuaguaauugcacaauagauauuguacuuagccaguuuuacaugcuguacuaggaggaacacuggucugcaguaugaggcaauaaaagaaguacucauuuuccagucccaauuuuguccccuauaagcaaccggaucuugaaaaaauccccuuaacuuucuggauguucagucacucuaccaauauuugaauacccaguaugagccagacauuguuuuaggcacuaaaaugaauaggaccagcucuuuccauaaaaguaaacauucaucuaaacuaaaaacaacuugaccauguaaugagagaugcugagaauauuuuggaggggacagagaagggacaucuggggcggggaagagaaguggggcggaaguucugcaaaacaugagaauggauaagcuagagcucauuagguaaaagggguaggaauaaaggacccucccuucccaugccaggcaaaaguaacagacggaacaaaguaaaauucuucagggaguaggaggaaaacugaaaguaguuugguguuacacaugcuaucagaaugcuaguagaugaagcuacagagguaggcagaaaccguauuauauaaagcuuagaaguuauccacagacaagagggaaccacagaaagauuuaaauaagcaaaauuuacaugucaggauaauuacucugaugagauaaggacacaugcaacauggauugaucggagagacuauuguagucauacagaaagggcuggaaccagagcuguaauuaguagggaagaagaagaugggaugaauuugagaaauacugaggaaacagaaucagcagacugguaauucaauggcuguaggagguaaggcagaaggaugaaucacagaggaaaggccaugugaggacacagcaagaaggcagcugucuguaagccaggaagagagcccucaccagacacugaaucugcuagcaccuugaucuuggacuucccaggcucuagagcugugagaaauaaacuucuguuauuuaagccaccagucugugguauuuuguuauggcagccuguuuuagucugcucagacugcaaaagccaaccucuugcuaugucaucaccagaccuguccucugugugaaggagagggagggagcaagugcaagcuaacugaaucuucuuauaaggacacuaauccuaucagaucagcacucuaccuuuaugaccucacuuaaccuuaauuacuuccuuagaggucccaucuccaaauacagccauguguagggggguagggcuucaacauaugaauuugacaaacauucaguccauaacagcugccaaugcugaggaguuaaauguaauuuacuacccuaaguauuuucucuggacgcuccacuuuuccuagcucauagggagaaauuaaucugauagcuaaagauuuuauagcuaaauaguucuguaguauaaaauuaguuggauugucagcacggccuuccaaggagaaauuuaagauuuauguugcuguacuuucucaacaauuccugaaaguuuuucaaaacaaaaagcauuaggagcuagacacaguggcucacaucuguaaucccagcuacuugagagugggccaguggccuagugagacuaggaguuugagacuggccugggugacacagugacacuccccuagcucuaaaaaaguuuuuuaaaacuuagcagauuauuugaagugaguugguggaagggggguaaaaaaacacaaaaacccuuagcugggcaugguggugugcgccuguaguccuagcuacucagaaggcugaggcaggaggacugcuugugccugggaguucaaggcugcagugagccaugaucaugccacugcacuccagccugggugacaaagcaagacccugacacuuuaaaaaaaaaaaaguaauaauaaacaacugaaacugaaauccuucguaauuuugcagguuacuaguucugaaauaaagugucuagaaucacaaacauggaaaggucauguuuuaaauuauuuuuuccuaagagccacuuaugaagugaguuuaguuuagacuguauuuuuuuuuucugacacagggucucacucuguugcccagguuggagugcaguggcacacucacagcucacugcagccucgaccuccaccguucaagcaauccuccccgccucagucuccugaguagcugggacuacaagugcacaccaccaugcacaacuaauuuuuguauuuucuguagagaugggguuucgccauguuguccaggcuggucucgaacuccuggacucaagcgauccacccaccucagccucccaaagugcuggaauuacaggcaugcgccaccgugucuggccuagacuauuucuuacuacaauccuuaaaagguaauggauauacuuuaaaaaaucaaggaaaguggccaggcgugguggcucacgccuguaaucccagcacauugggaggccgaggcggguggaucaccugaggucaggaguuccagaccagccuggccaacauggugaaaccccgucucuacuaaaaauacaaaacuuagcugggcaugguggugggcgccuguaauuccagcuacuugggaggcugaggcaggagaaucgcuugaacccaggaggcagaguugcagugagccgagaucgcaccacugcacugcagcguggaagacaagagccaaauucugucucaaaaaaaaaaaaaaaaaucaaagaaaaauuucaagaguuguaauucgucugauaucaauuuaauguccuacagcuauuaaaccaaguuaagcauuauuuuccuaacagaaaacaaaaaugaacaucuuauuaucuuacuaagcggcaauacaaauuuuucauuaaaauucaucuccacaguuaaauuuccauaaugauaaugugagauaaaauaaugggauuuguuaauuccaaugaaaauccagucugaauagaaguaaaaagauucaggaguauaagaagcacuauauauguaccaggcaccauacuaagugcucuauaaucauucacucaauccauaaaaaccccauaaggguuguguacuauaauuaucucuguuuuauacuugagaaaauugaggcacacagagacuauauaacuuguccaaggacacacugugaguccauauauauauauauauauauauauauauguauauacacauauaugaguccauauauauguauauacgcauauauaugcguguauauauauacacacacauauauacacauauauacacacauauauacacauauacacauauauguguguauauauauacacacacacauguguguauguacacacacacauguguguauauacacacacacauauguguguauauacacacacacauauauguguguauauauacacacacacauauauauagugugaucgauauagauauauauauguaaagagagauaugccuguuuaugaacucucuauuccauugauuugugcaucuaguaagcaauuguuuuguauauguauguauauauauacacacauauauaugguguauguguauauacauacauacauacauacauauacauauagugcagugaaccgagaucgcgccacuguacuccaaccuggcgacacagcaagacuccgucucagaaaaagaaaaaaaauuccuagaugugaaaccaaaaacacaauccacaaaagaaaaagugaguggaaauuggacuuuuacucaaauugaaaauguuugcucuucaaaagacacucuuaagagaaggcaaguuauuaacugggaaaaaaguauuugcaaaacauauauauaacaggggacuuguauccaggacauauaaagagcucugaaaaacucaauaauaagaaaacaaauaacccaauaaaaaaaugggcaaaugauuugaauaaacauuuuaccaaagauauauggauggcaaauaaguacaugaaaaaugcucaacauuuagguaaauacaagucauuugggaaaugcaaguuaaacuacaaugaaacaucacuacacaccuauuagaauggcuaaacauuuuuuuuuaaagcuaggcgaggugcaguagcucacagcuguaaugccagcacuuugggaggccaaggugggacgaucgcuugaagccaggaguuucagaccagccugagcaacacagccagaccuugucucuacaaaaaauaaaaauauuagccgagugugguggcagacacauguaguguaguccuagcuacuugggaggcugaagugggaagauugcuggagcccaggcaguccaggcugcagugagccaugaucaugccacuguacuccaaccugggagacugagcagacccugucucuuaaaaacaaauuaaccugacaauaccaagcaagugaugugaggaugcagagcaacuguaucucucauauacugcugguaggcaaaauggcauagccacuuugaaaaauaguuuggcaguuucuuuuuuaaauuuuuaauuaauuuuuuuuuuauagagacagggucuugcucuguugcccacacuggagugcaguggugcaaucagagcucacugcagcuucaaacuccugggcucaagcaauccuccugucucagccucccaaguagcugggacuacaggcauaugccacucugccuggcuauguuuauccauuuuguagagguggggucucacuauguugcccaagcgggucuugaacuccuggccucaagcgauccuucugccuucaccucccaaagugcugugauuacaggugugagccacugaccuggcaguuuuuuguaaaguuuaauaaacaauuuccauaugaucagcaaucccacucaugaguauuuacccaagugaaaugaaaacuuauguucacucaaaaaccuguacacaaauauuuaugguagcuuuauucauaauuaccaaaauuggaaacaacccaaauguccuuuaacugaugaauggauaaacaaacugugauauauccauacaacggaauaccacucagcaauuaaaaaggaacucccggcuggguguggugguucaugccuguaauuccagcacuuugggaggccaaggugggcggaucaccugagcucaggagugcaagaccagccugggcaacguguugaaaccccaucucuaccaaaaagauacaaaaaauuagcugaguaugguggcacucgccuguugucuccacuacuugggaggcugagaugggagaucacuugagccccggaggcugaggcugcagugcgccaagauugugccacugcauuccagccugggugacacagugagaccccaucucaaaaaaaaaaacucuugauacaugcaacaacauggauaaaucuuaaaugcauuaugguuaagugaaagaagccagacucaaaagguuacguauuguaugauuccauguauaugacauucucaaaaagacaaaacuauagggauagaaaacuuaucaggagcugggaguggggcugacuacaaaggagcaaacugacuauacaaaggaagaacuuuugggggcgauggaaccauuuuauaucuugauuggugauagcuccacaacuguauuuauuugucaaaacucauagaaccguacacuuaacaaggguaaauuuuacuguauauaaauuacacuucaauuaaaacaaauacuuaaaguuuaaacauuguuaagucagcuucagggcuagauagcuauguagcugagagguuauuucacaaaugaaaacauuagugccacauaauuauagaacuaauagugcugaaauauaaauucuuaaucucaaugacuuugaaacauaauaagaaaaugaacaggacaaauaguuucucucaauaauaauauaaaacuuaugaucuuagucaauauacacaccucccagaagacagauccacuaucuuugcuauuaaauuguguucugggcaugcaaagcuaaaggguagccucugugacacuaugguuugaguuuuccugugacuuaacccaagugacaccuacaucaucauugcuacugucaauacugucaguaggcuuuuagccuauuuggaauuuauacaaguaaaaaauguacuaagcuuuuaugaacagacacuucucaaaagaagacauuuaugcaagccaacagacacaugaaaaaauauucaucaucccuggccaucagagaaaugcaaaucaaaaccacagugagauaaccaucucacaccaguuagaauggcgaucauuaaaaagucaggaaacaacaggugcuggagaggagguggagaaauaggaacacuuuuacacuguuggugagacuguaaacuaguucaaccauuguggaagacgguguggcgauuccucaaggaucuagaacuagaaauaccauuugacccagccaucccauuacuggguauauacccaaaggauuauaaaucaugcugcuauaaagacacaugcacauguauguuuauugcggcacuauucacaauaggaaagacuuggaaccaacccaaauguccaucaaugauagacuggauuaagaaaauguggcacauaaacaccauggaauacuaugcagccauaaaaaagaaugaguucauguccuuuguagggacauggaugaagcuggaaaccauaauucucagcaaacuauagcaaggacaaaaaaccaaacacugcauguucucacucauaggugggaauugaacaaugagaacacuuggacacaggaaggggaacaucacacaccggggccugucgugggguugggggaggggggagggauagcauuaggagauauaccuaauguaaaugacaaguuaauggguacagcacaccaacauggcacaugcauacauauguaacaaaccugcacguugugcauauguacccuacaacuuaaaguauaauaaaaaaauuuuuuuaaauaaaaaaaauguacuaagcuuuguagaguaccagggucaaaaauauauuuuuuaaaugauuguuuuaauaaaaggggcuaugaaaaauucaacucauauccuauguaucuaaugaucuuaaccacgaccuugcuauuucagcuuucugauaccuuuucuuuuuugaugcuucauucuuaaaacuucuauaaaaauuucugaggcugggugcaguggcucuugcuuuuaaucccagcacuuugggaggccgaggugggaggaucagaugagaccaggaguucgagaccagccuggccaauauggcaaaacccugucucuauuaaaaauacaaaaauuacccuguaucuugagcuuauauaguauaagcucaagaccaguaucuugagcuuauauacuauugaugauucgagaaacugaaguacuacauuuauauuagcuuaccauuuugugaaauauauaacaacaaaauagaauuaugaaauuuuaggauugaaaagauuccccauaucaucuaaucuaaucugaaucuauuuuuacauccuaucacauucccuuuguucauccagauuugccugaauguuucuagcaaugcuuaccuccccucaugggcugcucaaagaauucaagaacuggaagggaucuuaggaaacugagggcuaaaagcuaaauuaguuuaccagugagguguaguuaggugcagaauacaaauuaaaauuccagccccauauacuuuucacucucuaugcuuuuuaccuuuaucaaaauuuuauaugggugaagaaacaacacucacacauugcugguggaaauauaaauggugcaggcacucuaaaaaacuguuuagcaguuccucaaaaaguuaaacauaggccagucgcgguggcucacgccuguaaucccagcacuuugggaggccaaggugggcagaucacgcagucaggagaucgagaccauccuggcuaacauggugaaaccccgucucuacuaaaaauacaaaaaauuagccgggcguggcggcgggcgccuguaaucucagcugcuggggaggccgagacaggagaauggcgugaacccgggaggcggagcuugcagugagcugagaucacaccacugcacuccagccugggcgacagagugagacuacgucucaaaaaaaaaaaaaaaaaaaaguuaaacauagaguuaccauaugacccagcaauuccaaaccuagauguguacacaacagaaaugaaaacauguccagacaaaaacuuguauacaaauguucauagcaccauuauccauaauagacaaaaaguagaaacaacccaaauguccaucagcugaugaauagauaaauaaaaugugguauauccauacaauagaauaaagucuugauacauguuacgauauggacaaacuucaaaaacaugcuaagugaaagaugccagucacaaaaggcuaaauauuguggcuccaaugaagugaaauguccaaaauaggaacacuuauagagacagaaaauaaguuugugguuuccaggggcucggagagacgagaauggggaaugacuacuaauggguacaggguuucuuuuuccagggaugaaaauguucuaaaauuagaccauggugauaagccugugaacuuacuaaaaaauacugaauuauauacuuuauuuuuaaacuaaauuuauuuuaaauuuuuauggauauauaauaauaguaguaugcauuuaugggguacaugugauauuuucauacaagcauacaacaauguaaugaucaaauauggguaacugggauauccauuaccucaaacacuuaucaugucuuuguguugggaacauuccacauuuucucuucuagcuauuuugaaauauacaauaaauuauuaucaacaauaguuggcugugguggguaguggggaggagaggaugaagagugguugguuaaugaguacaaaaacacaguuagacggcuaggcacuguggcucaugccuguaaucccagcacuuugagaggucgaggcaggcagauugccugcggccaggaguuucgagaccagccuggccaacauggugaaaccucaucucuacuaaaaaauacaaaaacuagcugggugugguggcacgcgccuauaaucccagcuacuugggaggcugaggugagagaaucgcuugaauccaggaggcggagcagugagcggagaucauaccacugcauuccagccugggcaacagagugagacuccaucucaaaaauauauauacaguuagauagaaugaauuauauacuuuaaaugggugaauuguauggcauaugaauuauaucucuaaaaagcuauuuuuaaaauuaauaaacaaagaacuaguuauauccuuuaaacaacuuuauauagaggauuuaaaaccuacuggcaaauucuuugacacuccucccauugagaggucaccuccucuuggaacugggugggcauuugugacugccucagcauuacuccugccacauccaaauuaagucuaauuaagugacuuaagaauucacuuaauaagcuaguuagaaaaaaaccaugcagcuucugccagucucucuuaggaugcuugcccuuggaacccugccaucacacuguaaggaagccaggaauacauggagaggccccagcugagcucccagcccaaagccagcaucaacuugccagccagcuauguggucaagccaucuugaaagcugucacgguugaugccacauugagcagagucaacccugcuuaaccuuaugcaaauuaaagaguuaugaacaaaauaucugccauuauuuuaaaccauuaaguuuuagggugguuugguacacagcaauggguaacuagaauacuuuucauacuuaaaagaaggcuaaaaacaguaucuagccuccuccuacuuagugcagacacuucuuucuagcagauuaccacccuaacugucugacaauuuugacuaacauggagaucagguccucaacgaagccaccccuuccacugaugaccaauccugggaauuaugaucugccuuauguuaaaaccaguucugucaugcccaaccucugguuuaaguucuuuccucagaggugaccauuacugucuaaaccucuucuucaggacaggccuuuaccuuacuaaacaguagagaaaucuuuagcauuguccuacuauauagcugaggaaccugaagugcacaaauuggcugcuuuacccaaaguuacacaauagauacucgaauuucugguauaagauuuuuguuuaguauuauuucuauugaauaugagacaaauauaacagacacauguguuguccuuacucaaaucacaauuuucacacuuaagccauaauuguuuagaguuaauccucauuucuauuaucuaggaggaaaaguaugggcaugaauacuggaagaugaaaacuacuuuuccguaucacucuuccucaccucauauguacuuaaauguuuccuguuuuaacuccagaaagccaguaaacucuuuuagggcagggauaagucuuauaauuuugagacuuacuugguguuugaguacauacauacugaauaauuugccuaccuauggguggcagcauacagauaaggauaaaaacauuucuuuugaaauaauuuaaacacaagucuuacaauccaaaaauauuucucaucacaucaguguaagaauuguaaucuuuuuucuuuuucaaagucaguagcaauagaaaaugagcuucuuacacuguugacuacaguaugucaguugcuaugacaaugcuuaguccccagacauuccuucuaaaugagacaauuucucccagcuucaguccccuaagacugacccaauuacacaacucaaaccccaaaacccaaggggugcccuucaauaaagauacucugggcugggagcgguggcucacgccuguaaucccagcacuuugggaggcugaggcagguggaucaccugaggucaggaguucaggacuagccuggccaacaaggugaaacccugucucuacuaaaaauauacaaaaauuagccaggcgugguggugcacgccuguaauuccagcuacucaggaggcugaggcuggagaaucgcuugaacccaggaggcagagguugcagugagccgagaucgcgccacugcauuccagccugggcgaugacagagccagacuccaucucaaaaagaaaacaucaaaaaaagauacucugauuacacaaccuaaggaaaaauguaaacacccuuuucuaagcugcaaggaaauuuuucaggcaacccauuuuguuuuuacauguaaaagucuuacaaguugaaugguaauugucugauauaacuuuaaaacuguauaugcuauaauccauaaccacauuccagaagccuaaacuuuuaauauaaaucauuucuauuaauaugcaugcaucauaucucauuuauguucucugggcuguauuugcaaucuguuccuuuuaagguacaacugaaaucuucuaggagcaagcaaggccaugcucaguaaacguaucauuggacuaauacagaacauuugcacacuagcccaaauuaaccucacgggaggcaaggaacuaggaaaaaauauuuuauuuauuuauuuuuuuuuuuuggaaacagggucucacucuguugcccaagcuggagggcaguggcccgaucaugacucauugcagccucuaagucccaggcucaggugauccucccaccucagccuacugaguagcugggacuacaggugugcaccaccaugccccacuaauuuuuguauuuuuaguaggaaugagguuucgccauauugcccaggcuggucuggaacuccugggcucaagagagccaccagccuuggccucccaaaguccugggauuacaggcaugagucaccaugccuggcccuagaaaaaaauauuuuaaauuguauaaaauuuaacaagcuaucaaaaugaggcaacuuagaaagaauuccuaguaauuccaaaagaaaaaaaaacuaaaaagaaaaagcuauguugggaaaugugguaucugcauugucucaaaauguaagcugguaauucucuucaacaguccaaaauauuuuaaaacugggguuuuuuucagaaugcucauuugguuagaaauucucauuuugauuggcugaguugaucaagauuuuaacuuuuauuauacacacacucagaagcaugagcuuauuuuauauauccaauaacaucucuuacaacucuacaacuacagaacuuaguaguguucucaaaaaaaaagguucucuguaagcucaaaacaguuucuacaauugaaaguuuauuacacacucauuuguggggaaaaagcuuagauguugguguccaauguuauauuucucaaugcauuuacuuagccaaugggcaaaagaagaaaaaaaaucacaggacacacacacuuaucuaaaagaaggauuaacaugagaaguccuaacuaaccugaauauuauguuaauaaacauuaacuguaaaacaauuuauugugaaacgaugagucauaggcagccaagacuacuauaaauaaaaaaggcauuuuauuuaguuuagauuuagccugaguucaaaagaaaaaacuaaaauaaaaaugaaauaugcaacuuucucuaaggcagacaauucaagcuaaaagaacauuguuagaaagccaaaggcugaggaaaacaauaucuuuuaaaaaccgcccaucagauaacuuuaaauggcaggugcaaucuucuugugaaauagaaagcauaguacuuucuuccccuacauuauaaaaugcuacuaucgaguaugacuaacagagaauaaagguaccaugugacccaagaaggguguguaugagaaguaggggcagaaagacggggcugagaaaagcugcaaaaagcuuucaauuuccuaacucugacucuuagagaccagagcuuaccugaauacauucugcuggggauuggaaaucaugcagaaaggucugugauuccaaaacguuaauacauuuauuauaaaguaaucuuggguaaagauauguugccuuaagcaaagaguuaacuguucauaauacccauuugaaaaaucucucauuuuguuugggagaaauaauugauaaguccaucaaaguaguuuaguaagcacaaauggagaacuauguagaaagaggaacuauuaugaaauguaugaccgaguguguuuuguguaagacuaauggagguuuucaaagguuuuucguuucuggcuauauacaaaaauaaaaauaagggcguuuucauucauuuaaaccagcaguaaaauacugccugguuuaugccgcuuauuuucaccuuacagucuuaauacacauuccaagacugaugcgauauucauuauuucuuucggauaacuggaagaggagggggaguaaagcuguacauuaaacaguccacuugguaauugagaaaauucagcagugaaauauaucaugaggcaccaaagagauuugccggggagggcagacaaaagagaaaacagccacagaacauuaagccccggaagagaugagaaucggucccauauacguaacucgacgacuggacaaaaccccgcuugacgcugccggugggugaaacgaggugauuugagauucagggcguucucggcucuuucccucucucgaaucgaucaucuccaacaggaagucagagcaaggcaggguucggagucagagaaagcucccgggggagucugucuaccacgacaacaaacuccuaaggcuccuuccggagcuccacagcccucugggcggccucucuagcgcuguacuucacguccccgcuccccaaaaaagucgugcaccccgacuucagcuauccgcguucaagagagugcggcagcaguugggucggcccccucagcggucccgggccguaagggaccuggcggagcggcucagggaggcugagacggcggcuacacgacuuucauuaccuucucgcgcugaucccagcuguacugcuuuggccgcuccuccucguucucgggccgcgacuccuugucagccuuccgucucuuggagaagaagcagcccauggucccagcccgcggagcucguuggccagcucacuagcucaggcacuuccuagaguguggcgugaacccugggaaccccggccucgcagcucuccggacaacgccccgcggaaccgcccaacgguccgcagccuuaguuugcccgccaggcccagcaccccuuccccuuuuucgucgcccugacgaccc

SEQ ID NO: 192813 - RNA, 10805 nt, Homo sapiens
ugacccaauaaggguggaaggcugagucccgcagagccaauaacgagaguccgagaggcgacggaggcggacucugugaggaaacaagaagagaggcccaagauggagacggcggcggcuguagcggcgugacaggugagggcgggcccgggagggcucgguuucuggagcggcugccgggcacgggcagggagcccggaccgaaagcucagcuccaggauggcugcgcuugggccccggcguucccugcccggaaccggaggagugguuugacccggggcgagaccaucgucgacagcgggggugggguggguaacaggaauaggcgggcaaggcugcgggugaugguuucgcccgcugcuagugguggugcgccugcgcagagccggaagcccuuugguaggcgggacccgaccgaguggugccgggauuccgucuuaacccccgcuaagguguccaaugaccuuuccuuaccaacugcggggaguguguggaaacgcgguucacuccccgguuuccuuauucuggaucagugucugaccgcccccgccgggagaaugucaggauucucgccucuguaaccgccuuccaugaucccucauucaguuuagaccaguaauaugccugugaccccucacagguugucaaggagaauuuuggagcucccucuuuaccuccauuuuucuccccgcaacaccauaccuuccuucuccuuuugcuaugacaaugucuggugguccaccauuaccuccccaguucggcucaaugucuggucauuuccauuuccacccuucuccccauuacagucccuagugacgccuguuacaucucccuuccgcauaguauguagugaccccccccccccaugaauuccucaucauagaggcuugggacuuccauuagccaccuaacaacggugucugugguccuaacaucaacauuacaccccagggcuuagggauguccacagugcccuuuaaggacauguuuggugcaaccuccaucuuccccaaacuaagggcaguaucugauaauccucucuuucccaucaccgugccugcgacuccucccucaccacaguaacuggcauuucccccguucucuguuaaaaaaccaggacacuuugggaggcugaggcggguggaucaucugaggucaggaguucgagaccagccuggccaacauggugaaaccccgucucuacuaaaaauacaaaaaauuagccgggcgugguggcacacgccuguaguuccagcuacucaggaggcugaggcgggagaauggcuucaacuugggagguggagguugcagugagcugagaccaugccauugcacuccagccugggcaacaagagcgaaacucugucagaaaaaaaaaaaaacagaaaaaaaaaaaaaaaaaacccaggacauucuguucgugcuucuuauguaccugacggcucagugcaguguguacugacuuccccauugguccccagcacagagucuugugugcuccucuacccuccaagacaguaugcucugucccccuucccuguucucucccccgcaacccugugcagugaagcugagaccuuggcacucaagagugagacaagcaacaggagggccugagcagagaaggaacuggaaggacuucagaugugagcaggaucucuuggacugucgugugaaaauuaggcugcagggggcgacaggagccuggacuuugaauuuuauuuuguccccugccacuuugcuucuagacuaucauuauuggaccucugaauucuugucugccuucuuguaggagccccauggcaccugcccagccccaccucagcccaucuugacaaaaucuaaggcuccauggagccaccacggggccccccugccaauggggccgagccaucccgggcagugggcaccgucaaaguauaccugcccaacaagcaacgcacgguggugagucauggaagcgaaauggcaggggcuguggauggacccaguuguaacucugggaucaaaagggugacaacgguugggggaggccuuugcagaaggaugggaacaucagcugcgcuucuguugggcauugaggaccccuacaucugcacauacacacaggugacuguccgggauggcaugagugucuacgacucucuagacaaggcccugaaggugcggggucuaaaucaggacugcuguguggucuaccgacucaucaaggggugaguguggcagccccacgcccacccacugggugucccaccucccauccccuccucagucauuugauuccuucuguacuuuaucacagagucuuccauuagucuucccuuagucuuuaguccccccuuaucugcaggguacauguuccaagacccccaguggaugcuugaaaccauagauaguaccgaacccaauugcuaucagucggaacauguuucuauucuugucuucuacccauaaauguaaugccuuuuccgucuuaacuaagcacguaucaugcacuccggccaucacuuuugcaguuugagguaugacaucaaaacuagcaugaauuuauuuuuccuucuucacaauuccaaagauggaagauucuuucuuacaguagaucucagcaaccucagcauaugauuuucuuuuaagucaagaacuuuuaccuuuuugcuuaaaggaagcacauuacagcuucucuuuggcauguccgaauugccaccaacacuacucuugugcuuuugggccauuauuaaguaaaauggcggucacuugaagacagccacuaugauauugagucaguuguuugauaacugagcaggcuacuaagugaugggcgguagcguagacaguguggaucugcuagauaaagaggugauucacauccugggugggauggugcaggauuucaucacgcuacucagaaugcacguaauuuaaaacuuaugaauuguuuauuucugcaauuuucaauuuaauacuuucccacccgguugaccacagguaacugaaaccauggagagugaaaccacagauaagggaggacuacuguaguucaaguaaucuaugaguucauccaucuuuuguuuuguuacuucauugguuuauuggccuguaaggucagcaacucauucuccccuggcccccaaguccucacccugguccaucacuucugcccagauuucaucuauuuuguccuuucacgaugucaugacuucaucaggucucuucuuccucauuuuccccauucucugucugcugaguugggucuugcugacuuuauuuauuccucucucguggguuuccuuaauuuaugaugcaguucacacacugcacuuuauuuguuguuucagugccuccucagcccccuuuucaggggcuggcuuagcgcuucuaagauguaguuguuuaguuucauuugcuucuccccuuccguuucagagcauggacucuucacaccgucaugccucucauuacccuuguggcccagggccagucacuuuaucccucugagccuguuuccccaucuguaaaguuggggcaaggauagugacuaauuucuagaguugcugugaugagaauuaaacaugccagacaugacccuguggguagcaggcuuggagggacuuguggggguucccugccuccccauggccccuacccaaccucccacucauuccuuuccaugcccccugcagacgaaagacggucacugccugggacacagccauugcuccccuggauggcgaggagcucauugucgagguccuugaagaugucccgcugaccaugcacaauuuugugagugcaggguggacgguggggguggaccaugguuggggguguccuugaccaggucucaaacuucccugcucuguggcaucagguacggaagaccuucuucagccuggcguucugugacuucugccuuaaguuucuguuccauggcuuccguugccaaaccuguggcuacaaguuccaccagcauuguuccuccaagguccccacagucuguguugacaugaguaccaaccgccaacagugagcccagccugggguggguggggggauggggagcacagaggcccagccacgaggcccuuacagacagcugacccguguccccuugcuuuauacccuucaugcccucaagguucuaccacaguguccaggauuuguccggaggcuccagacagcaugaggcucccucgaaccgcccccugaaugaguugcuaaccccccagggucccagguagggaugccuuagcugaagagcugcugggggagaaaaagaucuuggggcucuuguagaccacgagccauacuuuauucauuuguuuacuugacaaacauuuauugagcaccuacaagugugaguaagggcaugaaacugggaccuugggcaagucaccucauuucucugggccucaguuuucucaucuguaaagaggggaugaugauacuuucuaccauauaaagguucuggugaggcuuaaaugaguuaagacauguucagugccuagaacaggaucugguacaguguaaauaaucaauuuuuuuguuauuaauuauaaauauauuuauaagcaucuaacuacuuugcuaauucuaguauaaucauacucaagccuuuccauuuugaaauacguauuauuuuaucauaaauuacuucccuuuuauugcuuuuuuauguuaaauauuauauaaaacuauagcuauauuaaaauauauuauugcucuaauauauauuuuaugaugugcauauuuuaugguauauuuauguuauuguaucauguuguauuacauaauuuuauauaauguagaacaucauacauguuuauaugauacauaaaauaaaguuaggguauuauuuuaaauuaugaguguaugugcauuaauuaccuuugaguuucauuucaggauagugaagggaacauuaacauauuuuuguaacuuuacaauauguuuagcauauaucauauguauaacauguauguauaacaauaugguaauauguauauuuuaaaacauugccauuuuuauauagaugauacauauuauauaacauuugaaaaguacauguaauuauaauauauaauuauaaaauaugauacauuacccuuuccccacuaucuguguggccugcuauccugccuuuaggcguuuacuccauugucaucuccuccucagagaaaccuuuccugacacuuucuaggaacacuuugugucuccuuauuuugcuuuacuauuuuucuuuauugcaccuaucaccaucaggcauauuauauauuuguuuuuuauuucagccccaccagggcaagaacuguuauuuuguuuuacaguuuuaucuccaccaccuagaaugguaucuggcacacagcaggcacucaauaaauguuucuugaagcaaugaauaauaguacugccaguggacauucgcucugugugagccaaaugcauguuuauggcugggggugggguggggggcuuucucgguucucugauuccuggcagugauuucacagccuuuccccuggcagcccccgcacccagcacugugacccggagcacuuccccuucccugccccagccaaugccccccuacagcgcauccgcuccacguccacucccaacguccauauggucagcaccacggcccccauggacuccaaccucauccagguuggugcugugggggacaaugccggggaccacagggcagaggguagagccaucccuguuggccuccaugcccucuuuuugacuccugucccucuucuucuagcucacuggccagaguuucagcacugauggugaguccccugugccugcacccugacccccgcugccccacuuaccuccacucacauccucucugcaacugcagcugccgguaguagaggagguagugauggaaccccccgggggagccccagcccagccagcguguccucggggaggaaguccccacauuccaagucaccagcagagcagcgcgagcggaaguccuuggccgaugacaagaagaaagugguaugcucgagggggauccuuuuggggccaccaaggcugagugacgugggaugagggaugugggcaggccucuuagaugccacccaucuggcccacagaagaaccugggguaccgggacucaggcuauuacugggagguaccacccagugaggugcagcugcugaagaggaucgggacgggcucguuuggcaccguguuucgagggcgguggcauggcgauguggccgugaaggugcucaaggugucccagcccacagcugagcaggcccaggcuuucaagaaugagaugcaggugcucaggugagguggcaugugugcguggauggggguggcaggcccggccuuggcaucucucugggaaaaggccaugcuuggagugcuuccuggacaucaccuguguuuguguuguuaaaccaucaucagaaguuguuucucucugaagggugucccuuuccccucugggaaaugaguauguuuagaggaccugugaucaugcaguuguuuguguuuggguuauuaaugaaugguucugccuccaaaaugugggucuucucauuugccugcugcgaacugggucugugugugggccaccauucuuguuacugcauugccaggaaggcuuccaucuuuccuuccccucugcuugggcuacaaugguaauguucuguuuauaguguugguucuuguuauucauuaauucuaauaccuugauuuaaacaauauuaucaucaucaccauaaucuaaucauugcuuaauuauuauaauugcuguaauauguaaucaauacaguauucaucuagucacgcuaagaaagccaggugucuccuuuuugcugcuauaguuacuauguagcauaguacuguauaccuauauacuacagguaguacuggauagcgucuaccaacccuggggauguuggcauuggcuuuuccucugugucagaugggcacaauuauguuacagagaauaagguagcuaaugcaaugaucaguuuuacaguugaggaacaugaggcccagagagguuaaaugucuuucccaagguuguaccuugaguaccuggugaggccuagauuugaacaugaguccagacuccaagcucuuuaccucuaagcuucucaugcugcugaacaggcucuaaucaucauauaucaccaauguuuuaauccugcaucuauccauauuauauugauacaucagugaggaagguuggcauucugcuuucucaucugugagauggucacagacccagguaauggucagagucagaggggugggggauguuaaugauuagaaaugcugcuguaggcagggagggggaggggcagcaauuccucccuccugcuuuuguugggagacucggauggggaagcuccacauaugagcccacagcacagaaucauagcccaguaaacacaucucacaaauucauggaaucuggcaaugcuuugguccugagugccccaaaagacagggugaaaauaaaugaccgaggaagguaaagaacagugccacuccugaugcucgguaagugacaguugcuauuuuuccuccccaccucugacacugcccucccugccugcaggaagacgcgacaugucaacaucuugcuguuuaugggcuucaugacccggccgggauuugccaucaucacacaguggugugagggcuccagccucuaccaucaccugcauguggccgacacacgcuucgacaugguccagcucaucgacguggcccggcagacugcccagggcauggagugagccucccagccuggggagggguggggggaaagggugggggaaaugagguaacccccagccaauccgccaccugccuccacccccacagcuaccuccaugccaagaacaucauccaccgagaucucaagucuaacaguaucuaucugucccugggcugggguugagugggggugucaagggcuuagaaggaugccucuuguggggguucugggaauuacaagggaggggcaugugucccagagcuccuugccagguggcagagcuguggccagccagggggcuuuaauggcagucucuuagaagucagagguguggcugguucagguacuauucuuggggacucugguuagagucugaugucugacaguuguggagggcauuauggucaacaucagaggcauaguggguucggaugcccuccgaggggcuuccuguucaggagucacagcggggcugaguguggggggcauuagcaggcguucccugcccacgucaagguuguggauaguuugcgugauauuaaggggcuccuggucaggaucagagggaugagugguauaggggcaccaaugggaaccucccaggcagggugagaggcauggcuauuaggagucccuguagugguccuugacccuggcggacaucuuccuacaugaggggcucacggugaagaucggugacuuuggcuuggccacagugaagacucgauggagcggggcccagcccuuggagcagcccucaggaucugugcuguggauggugaguugggccaggcuggauggggggcacauggggacgugggcuccgggauugggguguguggggccaaguggggacggggaugccugugccagaugugggugucuggacuccucaugucccaccucguguggguggcucugaguuguacccuguguggccagugggaucugggacuguggaccagccauuugcugaccuccguggucccccugccuggucuggccuguuguaggcagcugaggugauccguaugcaggacccgaaccccuacagcuuccagucagacgucuaugccuacgggguugugcucuacgagcuuaugacuggcucacugccuuacagccacauuggcugccgugaccaggugagccccacaccuuacccacaguucccugggcugagggauccccucaggcauccauaccccacauccccuccuuugcacugauaaaugccacacuuuccccagaaaccuaaaauuuucuaggauaaggacucccagaaucccuugggcuccagacacuuacaauaaauucucugggucuccccuaccccaacuucccucuucucacauccacagcccucugggacaaaaaucuuugaaguccaaaaugccccgaaucucuauaccuagaauccccugaggcccccaaauaccccaaagcccucuguaucccuagacgccuauagucgucugcucuggguacucaaaaucccccagauccucaaagcccagaucucauuucucccagcaucccauuuuuccccagaaacagaaccccuuugugcuucuggaauagucauggacacccacagucaccuaggccuuggguaucuagcaggccccagggccgggauaccuagaacccucuaggccccagacccccacagaaguacaagcucccccagacccagaacuccauguuuucccgagacucaguacuuuccaggucccuaagccuccuagaaacccgugggccuauaauccucugagccccagauaccuacaauccuugacaaccccaaauuuaaaucccucuguucugaaagcagagaauccucccaaguccucaaggacagagaauccucugggccuugauacugacaguaccccagcucgcuaaaaaugaaccuuccaagucccucaauacaaaauuccuugggccucccagccccugaccccagaucaccccuuuccugcccccgucugcccccagauuaucuuuauggugggccguggcuaucuguccccggaccucagcaaaaucuccagcaacugccccaaggccaugcggcgccugcugucugacugccucaaguuccagcgggaggagcggccccucuucccccaggugggcuggguagggggcuggacaccuugggugggugacucugggauagaggaagacugagauggaggcagaugugaauaugaaagcucagagguauaguguguguguguguguguguguguguguguguuucaccaugaggcugggacuguuggggguguguguguauguguguuucgccaugaggcugggacuguuggguguguguguguguguguguguguguguguguguguuucgccaugaggcuggggcuguugggaugcccacagggcucuggacaccccuccucacccccaccugcccucagauccuggccacaauugagcugcugcaacggucacuccccaagauugagcggagugccucggaacccuccuugcaccgcacccaggccgaugaguugccugccugccuacucagcgcagcccgccuugugccuuaggccccgcccaagccaccagggagccaaucucagcccuccacgccaaggagccuugcccaccagccaaucaauguucgucucugcccugaugcugccucaggaucccccauuccccacccugggagaugaggggguccccaugugcuuuuccaguucuucuggaauugggggacccccgccaaagacugagcccccugucuccuccaucauuugguuuccucuuggcuuuggggauacuucuaaauuuugggagcuccuccaucuccaauggcugggauuuguggcagggauuccacucagaaccucucuggaauuugugccugaugugccuuccacuggauuuugggguucccagcaccccauguggauuuuggggggucccuuuugugucucccccgccauucaaggacuccucucuuucuucaccaagaagcacagaauucugcugggccuuugcuuguuua

SEQ ID NO: 192814 - RNA, 47957 nt, Homo sapiens
ugcugggccuuugcuuguuuauuuuguuucccgacucuucucuugggguucagagccgcugagggguggggugaguccaggcaaggagugaaggucagggggaggugcggaccacauaaacagcgucacugcacgcaucaccacaggcggcacgaugaacgaggaccacauaugccaagcacggcacaaaaggaggccacgucagucacagacacagacaccacagcaaagguggggaagcggagaccacuggccuuccgugugcaaaggauucugggaagauggguggaguuugcauauuuaaagacagcugucagaggcaggaaacuggggagggggucccugggggaaccgagggguccuggaagugggaggggcucccaagguauugaaugagguugaggggagcuggugaagggaaauccuuguggggcuagguguuggguggcauuugaagauguggaucuucagagggauggaagauccaugggaaggggcucaacaguagggguuucuugaggauuuggaaaauuaugaugggaaauaggugugcuggagagauuugggaccaaaaauaggguuuuccaggaacuucagggcuccaggaagggauucugcaauggguugccugguauuugggcacuuccaggaaggaaaacgcccucuggggaaaccaggggcggaggucuucaggaauguggagguucuaaaacagaaguagauccugaagugaccacgagugggguucuaaaaggacuuggggauuccacaugugagaaccggauuuagggccaggaggagucagguuucucaagguacucggggaucuugaggaaugagagguggaaucuuggagaaccgggagauggguucucaagggauuuggagacuccaaaagugagaaauggauucagggcccagagaaggguugcccagggauuuugggguucucagagugggguaucagucggagaagaggcuggcgaaagacuuccucaggcugcggauggucucagcuuucaccucguccuggcuaaggcugggccugggcggggcuggcucuggaagguugaaggcauuggucagagacugggauuugcuagagagagacaagguggaggcgugggaggaagggggaagaggaaggggaggaaggggagagaaacacaacguuaccccaggcccagccccagcccugccccucugauccuggggcugugccugugaccuccccaccugccaccaugggccuggacccuaacagguucucaaggcugggagcacucagguggaguggguggaguccugggccagggaggcgagaucugggacaggcugggaggacuuggauccagggugaagugugggauucguggcaagaguccugggcagaaccuucucugugaauucuuggcuaguuugauacaaaggggaagaugagcagggaaguuuccaaucuaagggugaggugucuaggagggcauagaaagggcuuggaccaaggacaggcuguugggcaagucagccuaaggcagagcagcuggguggggcagggaggacgucugagcugggaugggaguuggaauggaccagaaaaggcagaugggugaugauucgcggggagacugagaugggccagaaggaugugaaggaggaggaaaaguaugaggauggagugggaagagccagaugauaggaggacuaggacucgggccaggaguuuuagggauggguugguggcgggggggcgaguuuggcagggaaggcucugggcugggcaggaaguugcagagggugggucagccaggugccugggaggcccuggaggaggaaacuuucccagggccuuugaggaggaauucgaacugagugcaguuucucugggauucuggcaccaaauuccuggggugggggugcggagccucuggugggccgggaggagcgaaagcuugggggaagggcuuggcucaggcuggagagaguucgugggaccccugcauaggaccugggucugaggagcaagggagcuagggcugcucuacuggggcagcggcccgcuuugugagcagcaaggcgaaggcugcuguagggguccccuuacuugagcugggggugcggaggucccccugcagcggcgguggcggguggcggcacguccuggcuggguuucugggccagcugugguuugggacguccagcggggcccgggccgcugggccgaggcugcugcgugguggguggcccagugcggggcacgggacccgccuggcuggccuggcguguggggccggcugggccuggggguuucuggggcgggcccuggcgcugcugcccgcccgguggggccccagaggccuuuggcggagccgggccagagacggaugucugacggguagccuguggggggcccgccuggcgcuggggagacggagaggcgggcgggcgggcugcuggaggcgccccggggccucccgccacuggccgggauuggcggccuugacccugggucggcggcgcggccugggacgcgggcugcuggggcgcugaggugggacuuggaaggcgcuggggcagggggcugccagcuggggguccaaggccugaaaggugcugcuggcccugcgggggcgggcgcugcugcaaugggggucccuggcgcugggggccuggacccggcuguggagggccgccugggggacagagggagagaaagagcacacgugagagugagcggguaagagauggcgggcugagggaggggacugcgaccgccagccucucgcuuacccuguggugggggucgcugcugagccgggggcccugcgggcugcugggaggucuggcggcccaagggcagggccccuggggacggagucugcggcagaggaauggagcaggagagguuaaaaauaguuaccagccaguggagcaucagccagugaugacacagguucccugugcgcuggguguugccccacuuguggcugagcugaggguacucuggguuguggggugggggaccuguucccaggggcggggcagggaggugcucagggaagucagggcagcagcugcuuaucaauguuuuaaacaauuggcaaucgcagccacaugugugcaaaggugaugcugugagccuacagauuaucagcuucauggcacagcaugacccagggccggccuccccacacuagcucaagccacuagcucagcgccaggggccugaccuggccaugggagccccugccaggggaggcaucccgcugucgcugccggggcagggccugagccaucuuguugaccacgagcucuacgaugagcuguuugucuucauccugguggucaccaaugagcggcauggaggaacccaccaccugggggaaggaaaggauccgugaggggagaggcaggccucgcaccugaggcggcaguaacaccgugcuuucaguuggccaagggcauggccgccgcugagccccagugucugaggcacugauugugcacggugaggaaggcuugucuguuccaagguaccuuacagcuuagaaggugcuucagagcagggcucagcaaauuagggcccaugggcccaaccuggccgaccaccugguucuguaugacccagagcuaaggaugggucuuuaaauuuuguaacaguugaaaaaaaucgaaagauuuuauaacaugcgaaaauggcaugaaauuuaaauuucaauguccauaaacaaaguuuuauuggaacacagccacacuuauuuuuuuaacauaucgucuauggcugcuuuugcagaguugaguaguuacggcagaggcuacguggccuacaaagccuaaaauauguaccgucugcuccuuuacagaaaauguuugccgaucccugcuucacgguuuucuaggugcuuuguccuuuccaaaaugcuuugcugucgguccaguucgcagaauacuuuaaagguuacuaagugccucgccauucaccaagaugucucgauucgcagagcacuaaacaaucuaauaaggguuuugcuagucaccagggacgugcaaguucagucuaguguucugccauugcaagggauggccccuucgaaaguucgucaggcaccuuacaguguacuaagcacauugcuguuggcugaggaccucugugccauggagugcuucaguuugcacugcugcugccuggcaucuguuccucccucuaccccaccuaccccugggugcucauaccucaaugaugugaucccuuccguccuugccauguagcgcuuccacugcgcagauguccagucccccaaaaaucucugagcacguguccacccacagcuuguaucugccaagacaaaggguggggaagccugucagucucucaccugagcugucgugcucccacccccgcuuccccucacacccugaguucgggcugcccaccugucagacauggcaauuugcuccagcaucgcagagccaguauuggucuuccaguucccugacacugacguccuccugggggacaaggggacagaagcucaggggugccucagcugcaugaggcaaggcaggggaccccuuccagggcuuuggucucuccacucacauguaggccuuguaguucugcccaaucuucuggacacgcacgucauauuuggcaucgaugaagggcucggcaguggcauacgucuuggucagugccacgacacuugcgauguccuggaagucaugcugguugucaaccuugaccuguggaagugcgggcaaggaucagggccuggucaggauagggcagcuguggggagugggggugccugggggagcauguauacaugacacacaggugaggcgaguacacaaaaauuagguggacaugccaaggcgcucaagcaggcacgaucaugggucuccuguuuuguaugugagcacacaggcacaaaguuggguguguagaacacugagcauaccaaaauguauuggauugucuacuuuaaaugggugaguuguagggugugugaacuaucucucacuaaagcugugaaaaaacuguguauguacaauauacuaauauaggcauccagacacaaaaucaauuguacacacaacaugcuaagauacagaaacucggacacaaauuacaagucuacuuucuacguacacagagacaaaaucagauggauguaaagcacacaggaccccaagacuuuggaacauaaaagaucacaccacaucauguguguucggcacaggcaugcauguacacacagacacgaugcuggagacaagcaaaauaacaggacacacaaaauuggcugaaugcaggaggaaaaaggggucgaugaggucagcugaaugugagaaaacaaaaaucuauuagguuggugcaaaaguaauugugguuuuuaccauaagaacuggcaaaacccgcaauuacuuuugcaccaaccugauagauaacgacaccccaggagacgcgaucacacagaaugacuggugugcauugcacaaauacacaucuaccuaugcacagcccagccagagacucaccuugcccaucccagagugugcgugccccaucuucacaaccacgggguacguuguacugcugagcugguggggaaaaggcagaggagacaugcucagggcagaaagggugaccuccagggguggggcggcacugaggggaucccagccagugggaacugcauuaugagucacuucccaggacacacaggucagagacaggcaggcagcagcugggggucacacagugucuccaccuccgggcccagaauugaacccagagcccugucugucugucccucacuccaccccaccaacaaguuccagacgucccgccccugcuuucccgggcagaggcaugguaugagcgugggggacuguuccaguaaaaagaaaguuuguuuuuacaguggauggaugauagugaggcaagugugugccagugcgugugugugggggugggggggguggggagugguggugagcauguagugacugaaccccucagccaaaccuuguauguaagccucaccugcacacauaaacuauugagaggcaugagcccuuggaacucagauguacaucgccaaacccagagaugccagugacauugagacugacagccaacacaggcucaaagcacaugagcucuggagcagcacagacacccacacagucauucagccagccaggugcccauagcgugggucagcagccagcacuccagggcagcacacacuggacacccuuaggcacacaaucaauacuugggcacacacccagguucccuccccucacccaaacccacaucaccaucaggggaacacacacaacacaaaagauuacccguccaaucaagagacacacaacuccacaggcacacuccacagaaccgggcacauacucaacacacaggcacacauaaaacaccccuaggcaaaugcacagcaaauaaggcccuacacaacacacagagguguaugcacuucuagguauucacaucaccacugggacccguaagagacccacgccacauuccugggcauacaaaaaguauaucuagacacacacacaacaugccuugccacauauacaauacagagaggcuacacacaaccagagacacccacaacucaguuugcagaaaacauuccugggcacucccaccccaacacacauacagucacacauucaggcgagagggauaccucaagucucccccgcuccuggaugggguagaggaaaccagguuggacggcccuaggcuccccgcucccuccacccccacccccacagcacagcugcacagugccccucugguggcccucccucucgcugacaagguagagagauggcauucccggaggggcugcuggggcgguggugguucccaguucccgacaggcacaggaagcccgcagacucagggugaccgauugaccuuaaggccucccucugcacacccccccuuccucauuucccaaaugacuggcgucauuaugaggugggcugagaggcacgauguugggacggggguuuggggcaucucugggcagcgggccagggaaacgaugccgaggcggaugcauacaguaccacccaggugugcgcacagcacacagaagugcauaaugcacucaguuacauaugcaacccagauccgcuuugccgaggcugguagacaacucccagaaguaacacacaaaacacacaggcacaugcucgacucuuagcaauggacacacaacacaccagagagcugugcguacacacccauaccucccccaacaacccugagguuucuaggugccucuuuucguuaacuguccuuguuuucucuggacuugagccugaacacaacgcucuguauaugugugugugcccauacaugugugcaugcagagugcuuugaacucugacucugggagcuccuggaaagcccuaggucugaauuuuggccuuucuucuuccuaaggccaugaaggacacaaccucucccugagccucaguuuccccaucugcacaaagagcacaaugaggcccaagcaccugguaugcugugggcauugucagguguccgcuuugcacaugccuccuggacccccaugggcccccacacccauccagcuccccagauggucacacaccccuccaugaacaccccucccacucuccauuucaaaacugcacaauaaccggauccacacgacuccucauguaaacagucggcaacacucugugcugacucagguuucaaagaguuggcgucagaaccagagucagcgaggggccaaggcaggacuuccccugcccucacuucucccucggaggcaccagguuacucagccccgucucauucacucucacugucccacuuucauaaucagcuccuacagauuuuuuugguuuacuucccuuccucccuguuuuugucgcccccccacccuccccccaccaccccgcagcagagccauuucuucauucucauuccuggguaggucacucagcccuuuugugucuaaguuuccucaucuguauaaugagaacaugagcuauaucuaacucacagggauauugugagaaauaaguuaguuauuuugggaaaaaugcucuacaugguaucgggcauacaguaagccucgauccucaagaaguguuggguacucuuauuauuggcuuaacaucucuuccuuaacuaacauuaaugaacaaagaggcaaucgggauugauuaaaugagauaaugucuguaaaaagacuuuagaacagugcuuuuuuuuuuuuuuuuaaauagagacaggguuucaccauguugcccagacuggucuugaacuccugagcucaagcgaucugccugccucagccucccaaagugcugggauuacaggugugagccaccaugcccggccaagugcuuucuuaaaaaauagauuuaggcugggugccguagcucacgcauguaaucgcagcacuuugggaggcugaggugggcggaucacccgaggucaggaguuugagaccagccuggccaacauggugaaaccccgucucuacuaaaaauacaaaaauuagccaggcgugguggcgugugccuguaaccccagcuacugaggaggcugaggcaggagaauugcuugaacccaggagguggagguugcagugagccaagaucuugccauugcacuccagccugggaaacaagaucgaaacucugucuaaaaaaaaaaaaaagauuuagaaggccgggugugguggcucacgccuguaaucccaacacuuugggaggucgaggcagguggaucaccugaagucaggaguucgagaucugaccaauauggugaaacccccgucucuacuaaaacuacaaaaauuagcugggggugguggugguguggcuguaaucccagcuacucaggaggcugagacaggagaaucucuugaaccccggaggcggagguugcagugagcugagaucgcgccacugcacuccagccuaggugacagagcaagacucuugucaaaaaaaaaaaauagauuuagaggguacagcugcaguuuugugacauggauauauuacauaguggugaagucugggcuuuuaguguccccaucaaccaaauaguguacauuguacccauuaggcaauuucucaucccucacauuccucccacccagaauagugcuggauacgcaguaagcacuccauaagggcugcugguaguuuuuguuguguucuuguuauugggcuaucaucccugaguuaaucaaacuuaauuagcaagggaguauggugagugaaugagauaauuuauacaaacacuuuagcacauaguacacagaaagugcucaauaaguggcugccaucaucacuacaauuauuauuauugaucuauccuccucgaauuaaggauguuaaucagaaccccagggaagguuccugcauugucagaaagcuggugggcaaggauugccccaccccaccccccaccagggguacagguccauggggagggggcagggcaggaugggguggggauuaguuuucuacugacccacucacuugcuucuuucaccaucauucauggccacccccuucccaaugcucauucauucacccgcaccauucccugcuugcuaggacggugccacuccugaguuacaacccuggugccagguagccucuguuugaaucccggccaugcccugugaucuuaggaaaauucuacaguuccucuacgccccauauuuccucauccguaaaacgggaauaagaaccgguacccaucucagagauuuguugugagcuuugagugagauaaacuaugcugagugccugguauacaguaggugcuguauaaaugccggcuauuugccuguguuauuugagacccuggcuuuggcuccuggccaccugaguuccagucucaguucugccauguauugacucugugauccuggguaagucacuuaaccacuccgugccucaguuuccccauuuuguauuccuccccuuucaccugccuuaucucccuccacugcugcuacuuaauuuguuuccucucugccaccccucaccagcaugucagacauacaaaacaagggauuuuugugugcuuggcacacaguagaugcacaauaaauguugaagggcugaacuaauuuggguuugagucauagggagcuugggggaugugggugauuggauagauucuggagacuuuaggggacugggccgggggaaaugcggccucuaagcucuccgcugaggcggcuuggaaggaauagugacugacguggaggugggggagguggcuggcccgggcgaggcccagggagagggagaggaggcgggugggagaggaggaggguguaucuccuuucgucggcccgccccuuggcuucugcacugaugguggguggaugaguaaugcauccaggaagccuggaggccugugguuuccgcacccgcugccacccccgccccuagcguggacauuuauccucuagcgcucaggcccugccgccaucgccgcagauccagcgcccagagagacaccagagguaagcagggcccgggguggcccagcagggaccggagcugggcugcagcuugggugcuggccaccaggcccgugcacucccgugccagaugccugucuacucagcuuggccugcggguaccaggacccugggcuagucuagggggaagagggucggaggcuggaacugcuuucccaaccccgaggcuccaaacucccuagaaccccugacauccgcccccaauucccccaaacccaugacccccuaauaucacaaaugcuuuccaaauccccccgcaaauuccuucaucccgaaauuucccucaucgcccccuaaauacccaccgcuaaccccugcagcucccuaaacucccccagcuccccaauccccaguuccccagcucccaaacuucuuuugcccucaaauuccucaaguauccccauugccuuaagcccccaaauucccccaaccccuucaaccuccaaacucccccagcucccuaaacccccaaccuccuccaaauuccucaaccucccuaaauucccccagccucuuauaucucuuaauauacacaaccccuaaacucugccgucuccaaacuccuccagcccccaaucccaaauuccucacccccaaacuccucaaccuccagaauuccccaauccccucauuccucaaacuuccucagcccccuucucccccaagugccacaaccccauaaccccgcaacucacucagucccucaauaauuuaaacucucccaacucucuaaacccuaaauuccucugcgcuccccaauccccuuaaaaucccuaagcuuaccaaccccucaagcccaaauccagcccccuaaucccccccauaggcugccccggggcaagaugggguggaugaccugcccaggucagcagaucagcugggccggggccugccugacaucccccuuccccacagaacccaccauggcccccuuugagccccuggcuucuggcauccuguuguugcuguggcugauagcccccagcagggccugcaccugugucccaccccacccacagacggccuucugcaauuccgaccucggugaguccucaccccacucagcccacacacucugccuugguuucccuuucaguccaguggggcucaccauggcacuuaccucuagaaugauuccacucgccccugcacuuccucugcuuuagccacacuggcauccucacacuuccuugaguacucugugcccaagcccaccacaggaucugcaugcuggcugcucccucugccugguacacuuuccccccagguauccacauggguggcugccucaaacgucaccuucucaggauggccuucccuggccauccuguuuaaaauuuuaaccccugccccuuaguacuccugaucuccuguuaaacagaaaaauauucagugauacuuguuauaacacaguaaggaagaccauauucaggaccauggugauggguauaggaaccacugcaaugggaucuugcagucggugggagagauugggcucaacacugaauauagcaugggccagugggaauguguagcuaaggagcagugugagggucuguggguggaaauuacuaagaagaaacaucagggguaagggggauucuggcuaaaccgacguaacaggauucuugcugaaggcaggccaaggggaaucagacaucaccugggggaugguggaagaugaagaacccagucagauagcaaggaugaucagguauugaggaugaucagagauugaggaugaucagagauugaggaugaucagguauugaggaugaucagagauugaggaugaucagguauugaggaugaucagagauugaggaugaucagguauugaggaugaucagagauugaggaugaucagauauagaauauagggguucuugcuaaacugacuuagcaaggcucucggcuaaaacuggauuuuacaaggaagugcacagaugggccuaggaggagguucaggagccugaguaaaguuuggucaagcaaagaaucuuugucagccccuuacccaggucuguaauuccccauuauacuuaaugucuaacauuccauauccuuauuuuguuuguucuuagccugucuccuccuggcuagaaugugaacuccacaaggaaagggauuucuguguuuuguucacuguugugucccuaacacccagaacaaugucuggcacacagugggcacucccaaauauuugaggaguaaaugaacaaaucaauguaugaaaauggcuuaagcagugcccggcaaagagagacacucaacauacagaugaaucaaugaacaaauguguaaaucacuuugugugcugucuggcauccaauaaccccuauuuauguaugcgcuuugcugguaugaugaugaugaugaugaugaucuuauuuuuauuggcucaugcaguccauuugacucauauuucccuccucuccugcagucaucagggccaaguucguggggacaccagaagucaaccagaccaccuuauaccagcguuaugagaucaagaugaccaagguauccccugcccccgccucuuucccagcauuuucuaacaucuuccuccuggucaaaacagaaacuucuggccacugguuggugcgagaaaguuggcugugaucuugggaugcuauaugacuucagggaagaaccuggagugggaggauuaugucaguaaaagagacacuuccccucauccaucaacagauguauaaaggguuccaagccuuaggggaugccgcugacauccgguucgucuacacccccgccauggagagugucugcggauacuuccacaggucccacaaccgcagcgaggaguuucucauugcuggugaggcaccguccccgcgcccugugccacaccaaccagucccuggggcgcggccuagcaaccacgagggggcgaggcucugaugggaauggucccacuggaaauggggaccaccccaauuucagucuaucagaaggccgggccuuuggcagcuuggcagcucagccaaucacaagcugcuugucgguccccgccccgccuuucuccuuaggaaaacugcaggauggacucuugcacaucacuaccugcaguuuuguggcucccuggaacagccugagcuuagcucagcgccggggcuucaccaagaccuacacuguuggcugugaggaaugcacagugagugccuggacccugaccuccaacgggagauccuucccggggccauucccuaaaucgugggcuuguuucuugcucccucuggcuauucugugucccuguggcugcuccccaacccuaagggcugucccugaucucucuugcuauuuccccaagcccgagacugcucccuuacaaauucuggcugcucccuuucccuguguccaauaccgugugaucaccugucccucccuggucccucuaauucucccuugugacuauucuguaaucccacuccccguuccugagcccccgggauuguuucuugguuccccagaauguucuccaagaacccaaagugcuguucccuaaucccacugacccuuccucagcacaucugcuuguugcucugcagcucugacuauuccagacaccagaggguguuacacugaccuccuggcuaguccaagccuguucccugauggcuccugauggccucugagcccagugacuaucuugaagccccacuggcuauuccugugcuuaaacuccuuagccgccaaccggguggggccccuuacuacugccaguuuuucccuguccuuugggacaauuccacaggcgaccugccugacugacccccagggccuauuccccagccaccauuccaggacacugauuuacuggcuuacuguuaccuuucaggacccagugacauuucccucaaugggaggggcuguccugggguauguacuuagguggggugagagcaagucuccccagcggcucaguguugaaagcugaggagaggaaguucugcuccacgggggaggcagggagaagcccucagagauguuucccuccucccuuccagguguuucccuguuuauccauccccugcaaacugcagaguggcacucauugcuuguggacggaccagcuccuccaaggcucugaaaagggcuuccagucccgucaccuugccugccugccucgggagccagggcugugcaccuggcagucccugcggucccagauagccugaauccugcccggaguggaagcugaagccugcacaguguccacccuguucccacucccaucuuucuuccggacaaugaaauaaagaguuaccacccagcagacacuguuucuguguagugccugggaacaaacccauguugcugaugaccuggugugagcacccugggaccaguggggaugagggaugccaaauguuggguuuuuauauuuuacuuaaauucugauguacugguaguaauucucaacauuggcauuagcacugaugaucugcaacagcagcaauggucacugaaccugcauuaucaaccguaaccucugaauaauuucuccagccaauacuuuaaaacauuuuccuauacugauuccuaauugcuauuugcccagggcuuucuaguuauaaauuaucccacagcugacaaaucacugccuuacuggaaauuccccauucacacaucuugccagcugacagagucauugacaaaugcccuaccaauuggcaaaugacuaucauugccucaagcacaguccugauguuguccagugaggaugccccauccaaacacguggguguuacuguccucauccucagguuuuguaccaugagucugacuugagugaaaggggacccagggcacccagagucccacaguaacccagcuggggacuugggaagaagggguggcccuggcuccccagccauggcugcaggacauuccuuggaagggacuguuuggggcagaggagaggugggauggagagaagguaugagcuaaaaauccccaagcucugccauccucccuccccuacuucuccccucacuccucugaccaacuuggaaggaaauacugacagcaaugaaaugcagguaggguucaaaauuaagaccagccagauaugcuggcccauacccuccacacaccucccucaacccaacuguccccucacccaaacuagggucucuagacucgacccucaccuuuaugaaucauccuuucucuagaaaaacugagugagagaaccuccaaauacuccccucugaggccuuccugcuuccacagcgggguccagucccuggcuccugccccucauacuccaaaggucuugacucaagugaggcccuugggaacuagaauuucagacuggugcaaacauucaauggagcaccuguguccuccugaccugaacgugcuugaaaagggccccaauauaucuccuuugguaaagaaaaggacccccaaauucccucucaucagaguacccacugcucuuaccaguaagaacccaggucuccuccagggcauucuaggucaccaagcacagcccccuggaucuucugugguccugucccagagccuuuuacacuccugggagguuaccccacggcccaaauuaugucccggaugggaaugggcagauuuugaacacacaguacucagccacuuaagcagggaaugcgcaugcagcaacaauuucuacaucaacaucuacaccuugguuacgcccucggagggucugaaccuuguccaccgaaggggccaaccgcagccuuugcugaugggcacaacuguaagguaagggcccgagcccugguucaucccuggugaccuugucaauguucccucagcugccugcaagaggcugaccgcuccuggcaauucgccaaaccuuagugucagcuaccugcacucuuaagcugcucccuggccucagggcccauuuccuaaguccucagcucuuccaagcccuagggggaaggugaaguagcaggggaaggauggaacccagcguggaggucguucuccugccgaccugucuacccugcaggucagcccuucgccaagugcaaugcagaauggacagggaggaccggagaccagaacaggucucaggggacacagagcccagaacagcagacgaggcuaccuccaccagagaccuggcaugagcuccuggcaggaucuguaacccugggcucauuacaucccccauugcucuuguagaacaucuguuaaaauaggucaagugagcauccuccauccccagcauucggggugucugugggugaaucucugggagagacucugugacagcugagaggaagcuuguaggggucacagccaugugguauucagcaugggacccagcucaguggggagccuggggggccaguccuucucucaccugagccucaguccuucucgccauguuuaaacauggacgucacaguccuggcccagaauccuucagaggucuguggugggguuggaggauguuuacggggugucuuugccccuuggauauuuuugggggggucaaaacacaggaaaugggacagucaugguggcugacgccuguaauacuagcacuuugggaggccaaggugggcagaucacgaggucaggaguucaagacgagccuggccaacaugguuuccaucucuacuaaauauacaaaauuuagccagcugugguggcgcaugcccuguggucccaguuacuugggaggcugaggcacaagaaucguuugaacccaggaggcggaaguugcagggagcugagaucaugccacugcaccccaggcugggggauagagcaagacugucucaaaaaaaaaaaaaaaaaggccgggcaugguggcuuacgccuguaaucccagcaauuugggaggccaaggugggcagaucacgaggucaggagaucgagaccauccuggcuaacaaggugaaacccugucucuacuaaaaauaccaaaaaaaaaaaaaauuagccgaguaugguggugggcgccuguagucccagcuacucgagaggcaggagaauggcaugaaccugggaggcggagcuugcagugagcugagaucaagccacugcacuccagccugggcaacagagccagacuccgucucaaaaaaaaaaaaaaaaaaaaagcaggaacccuggagccagaucaucugcauucaaaucuugccccugccaugucuuagcucuguguccuugaauaaaucauauugccucuuugagccucaguuccugcaucuguaagacagggauaaaaagaaggccuaacucauagagacaauguccauauuaaaugagguuguauaugugaaguacuuggaacagugcuaggcauauagcacuuacaagcauuaguuacuagaaguaguuaugauaacuauaacuuauaacuuuaguagugauuauuuauaauauugcaaacaauguuugauauuaggcaugauaauauacgauauuggaaauaauguguaugauuaguaccaauaauuuaauguccauuucucccccacaccagucuccucaccaaaauacaagcuccugacccugcucugccugaaggaaugggguaggucuccgagacccaaaagcuccugaugugauacuaagaucccagcucuuuacgccauaaauguuccucagucccagugucccucucucuuuucccccucacagacaauccaguuuccuaguggaguccugaaccuguggcucacagaagcaccugaaaauaaagagcaaugugguuagauccuucuacacgcccacccacaacaacuguggcgacaccaugaggagagguuccccuuuagggauuccuaacggcaggccagccaaccuguccccacccuguguggacuccucacccucaggucucccucugcaccacccuggaacaaaaaguccccaucccuggagcauucuccccacgaagaacccccgccucacaauacuauguucccaacuucagcccgucacagcaaauucuguccccaguccguaguguucugagucuuugagacuuggggaucauagcauguccuagccaagggacauauggucaugcuacacugguccuugggacauggccucugucccuccagguccuuugagggauagaagucugcacucugcgagauggggggugcauccuuggaaggggcucagggaggagcccagaaagggcuuccugacuuucuauaggaaaggaugcgauggggccuugagugagucccucagggacucccgcagccacaggcguccccuuuguguuguggcucaccccuguucuuccugccucuugcuccccuacuucuucuuccuauucccugcuccuuguccccguugccuacuuccuaucccuugguccuucuacauauucccuacucuuuuguaaaauguuuuauuuuauuuuauuuuauuuuugagacagagucucacucuguugccccagcuggagugcaguggugcaaucaugguucauugcaaccucaaccuccugggcucaagugauccucccaccucagccagcuaaguagcugggacuacaggcacaugccaccaugcucagcuaauuuuuuguagagacgggguuucaucauguugcccaggcugguccggaacuccuaggcucaagcgauccucccagcucagccucccaaagugcugggauuacaggcgugggccaucaggcucugccugcauguucccugcuaucaagcccugcuccagcuccuguucccacucuucgugguucccuuucuguuucuacucuugucagaacuacauaguuacaaaacagccaggaggugcugcugcccuaccaggcaccaggaauuaaugagaaaaguugcuguuaagguaguauggcuuugguacagguuuacagaaaguggccaauggaacagaauagaguucugaaccugcaggacagagauaugaaauguuaguauaggccgggcgcgguggcucacaccuauaaucccagcacuuugggaggccgaggcggguggaucaccugaagucaggaguucgagaccagccuggccaacauggugaaaccccgucucuacuacaaaugcaaaaauuagcuggguguggugggaugccccuguaaucccagcuacuugggaggcugaggugggagaauugcuugaacucaggaggcggaggcugcagugagccaagaucgcgccacugcacuccagccugggcaacagagagacacccugucucaaaaaaaaaaaaaaguuaguauauauaugacagagguggcauacaagcucagugggggacaagggcuuaccuauaaggaaaaagaugaacucaaucccuaccuccuucacacuguauaugaaaaggaauuucagaagaaugaagaauuuagauggcaaaaacgaaacuuuacuaaaaagucccucuuugcucuagugacuugagucacuacuuugaucauacacuaaaguuccauauguacauggaucuauaacuggacuuuuguuuuucuuccuuuaaucugucagccugucuauucaugggucagcaucacacuauuuaaauuauaaaaguuucaggcuggacauggcggcucaugccuauaaucccagaguuuuggggaggccaaagcaggaggauuacuugaggccaggaguuugagaccaaccuaggcaacauagcaagaccgugccucuacaaaauaaacaauaaaaaaauuagcuauacaugcaccuguaauuauagcuacucaggaggcugagguagaaggauugcuggaacccaggagguuggggcugcagugagcuacaaucaugccacugcacuccggccugggcaauacagcaagauuuugucucaaauaaauaaauaaauaaauaaauaaauaaauaaaugaaaucuucguaaaaugucugguggcagaggcaucagacucccugugggcugggaguaugaguccuuauuaucacuuuucuuuuucaggguuuuccuaguuuuucuugcauguucgcuuuuccauaugaacuuuacuaucaacucauuuagcucuagauauaaguuuguagguauauuuuugggaaccacauuaaauauauaaauuaaauaaggacgugagaaggugaacugccauuuucaugauguuaauucauucuacccgagaacaaggaaugucuuuccaucugccuaagucuaccuuugugucuuucaggaguguuuuaaacuuuuccucauaucacuuugcacaucccuuguugaucuuaucccaaaauaucuuauuuuuuuuguuguuauuguauauguuuucucuucuauuauaccuucuaucugguuauuuguguauauaaaaacuacugauuucugcauguugauuucauaugcugcuguuacugcauucuuuuuuauuuuuauuuuuugagacaaggucucgcucugucacccaggcuggagugcaguggugggaucauagcucacugcagccucaaacuccuggacuuaagugauccucccgccucagccucccgaguagcugggacuacaagggugcaccaccaugucuggcuaauuuuguguuuuuuuuguuuuguuuuguuuuuuugauagagaugggguuucaccauguugaccaggcuggucuugaacuccugggcucaagugauccuucugccuuggccucccaaaguguugggauuacgauguaagccaccgugcucacccuuaaugugguuuugaauuuguuugcuaauauuuuauuuaggauuuuugcauugauauuuauaguaaaaauggucuaugcuuuuuuuuuuuuuuugagacaaagucucgcucuaucacccaggcuggagugcaguggcaugaucucagcucacucaaccucugccuccuggguucaaguuauucuccugccucagccuccggaguagcugggacuacaggcgcacaccaccacgcccagcuaauuuuuauauuuuuaguagagaugggguuuuaccauguuggucaggcuggucucgaacuccugaucucaagugauccaccugcccuggccucccaacaugcugugauuauagccgugagccacugcaccaggucuaugcuuuucuuugugcuauuaauguuauaauugcuuuagaaagguaauauggaaguuugucuucauuuuccauucuguggaacaauuuauguggccauugggauuaacuagucucuagcauuucaguggaauuccccugugaaaucaucugggccugaugauuuuuuauggggaaguuccuuaaaaacuuucucuauuucuuuuauggaaauugguuuguuaaccucuaauggggucgauuuugguaaacuguguuuccccaggaaauuacuuauuuucaucuagguuuucuauuuuaucuguggaugccuuuuuuauauuuugacuuuuagaaccacgcuaacgucuuacauuuaaaaauauaaaauuaaaucagcauuaccaggcgugguggcucaugccuguaauccuagcacuuugggaggccaaggcagguagaucgcucaggcucaggaguuugagaguagccugagcaacauggugaaacccaaucucuuauaaaaaauacaaaagaauuagcuaggcaugguggcacgcaccuguggccccagcuacucaggaggcugaggugggaagguugcuugaguccaggaggcggagguugcagugagccaagauugcgccacugcacuccagccugggcgacagagucacggacucuaucucaaaaaaaaaaaaaaggcugggugcaguggcucacgucuguaaucccagaacuuugggaggcagaggcaaguggaucaccugaggccaggaguucaagaccagccuggcuaacauggugaaccccaucucuacuaaaaauacaaaaauaauuagcugggugugguggcacacaccuguagucccagcuacuugggaggcugaugcaagagaauugcuugaacccgggaggcagaggcugcagugagccaagaccacaccaccacacuccaguugggugacaaagugagacucugucucaaaaaaaaaaaaaagaaaaagaaaaaaaaagaccucccuuuuagaagggguccugcccaauacccagaaggaagggauguugcagagagagucuaaggcucugaacagacaggccuugcuggguuuccccacucagucuguuaguacaagaucacacccuuuuugucccaucacauuucuuucuuucuuuucuuuucuuuuuuuuuuuuuuugagacagaguuucgcucuuguugcccaggcuggagugcaauggugugaucucagcucaccgcaaccuccgucuccuugguucaagcaauucuccugccucagccgcucgaguagcugggauuacaggcaugcgccacugccccuggcuaauuuuguauuuuuaguagguacgggguuucuccauguuggucaggcuggucuagaacucccgaccucaggugauccgccugccucagccucccaaagugcugggauuacaggugugagccacugcgccuggcugucccaucacauuucuauacaguuauaaauccugccuaugcaaugaagucuccaugaagggcugaagaggauggaguuggagagcuucuggauagccgaacaugugggguuccuggaggguggcuaccuggggguggggcauggaagcucugugcucuuucccacaugcuucguccucugcaucucuucaucuguauccuuuguaauguaauacucuuuacaauaaaccgaucauguaaauaaguguuucccugaguuccaugagccacacuagcaaacuaauugaaccugaggaagggguuguggaccccgauuuauagcuaguuggucagaagcacagguaaaauaaccuggggcuugccaucagcauuagaaguagggcuuaguccugugggacuacacccuuaaccugugugaucugaugcuauccuccagguagauagugucagaauugaauugcaggacauccagcugguauauuaauuugcugcagaauuaauugcuucuugguguguguguaaaagccuccacacaugguauugugagagcagaagaaaaaacaguuugauucuucuacucacacacauauaacaauuuuauauauacacauauaugaaauuauauauauauacauaaagaaaugaaauguccuagcuguguacaaugagagggccuugaagcaagaacauuccaguagcaaugaguaaaucuaguucccagaucuuggcuuugaaauacuauuaucuuugggcuggggccgggaaagaacaagauaugccuggaggugaugucagcagaaauguaagagccugucuucuccuccuuaaaauugcuuaaaagcaaugagaacacuggcaaaaauugucaaaacaaacuuaucagaacucuggaaauugaccaagguuuacaauucagaaagcauuuuuucaagaaaauggcugaaucuugguaacaacaggaagcuguggcauuugaacuucucuuguacacauccccuucuccucaccuccacaagagccuugaaaaucaacagcccugcaauuccagugaaaaccagcagacuagcaaccauuggaggaggcagaacaggguuggaguuccuccaaaaucucauuuccagagaacugucuuuauuugaucugucuggcacuauccugaauacuccacucauggggcucaucugguauaaacagcuuucucugggggugcuuuucagaaacaauuagcagcaacuguuuaacacagcagugauaacauuuaggaaaaaacaacaagcuuuucaagaaaacuuaaaaggaaaaucuagguaauuauauauccauuaucaguccauuauuaggcuuuaaaaagcucugacauaugccugggaaucuagaaaaccacaaauacgcauaaggcuguauguaugccuaggaucucuggcugaccucaaaacucugcacaagcaggaaaugaaggauaaggcaaaguuguaaacagccugccuuugcauuaaaggcacacccugacaugcacauagagcccaucagcaaagucugggagacuuacugguuucaggugauuuaaagaaauaucuguccaaucauuagcugaccacuaagcuaacggagcagagacuuggguagccacauaugacaaagaacacaggcuuuacagaauuaguucaggaaggucacuaaaaacaaaacaaagcaauaaaaacaaauccugaggaggggagagaaccugauucccagaguugccacauuauauuauuuaaauguccaguuuucaacaaaaauguaugagagaugcaaagaaacaaaauuaaguguggcccaaacacagggaaaaaagcagucaaacacuaucccugaggaaacccagauguuagacuuaauaggcaaaaacuguaaaucagugauuuuuaauauuuucaaagaacuaaaggaaacuauguuuaaagaacuuaaaggaaaggauaaaaugauauccuaauaaguagagaguaucaauaaagagaaauuacaugaaaaagaaauucugggccgggcaugguggcucaugccuguaaucccagcacuuugggagacugaggcggguggaucaccugaggucaggaguuugagaccagccuggccaauacggugaaaccccccucucaacuaaaaauacaaaaauuauccaggcaugguggcgugugccuguaaucccagcuacucgggaggcugaggcacgagaauugcuugaaccugggagguggagguugcagugagccgagauugugccauugcacucuagccugggugacaggagugaaacuccaucucaaaaaaaaaaaaaaaaagaaauucuggagauaaaaagcauaauaacugaaaugaaaaauucacuagaggggaucaacaguagcuuugagcuggcaggguaaagaaucagugaauuugaagacaggucaggugagaugauccaaucugaggaacaggaagaagaaaaguaaacaaaaugaacacaguccuagaggucuguggaacaccaugaagcauaugaacacccacauaauggaagucccaaaaggagagagaaaagagagaaaaaaaggugcaagaaagacuauuugaaggaauaauggcuaaaaauccccccaauuugauuuaaagcauuaaucuaugcauucaagaagugcacugaacuccaacuaagauaaauucaaagagauaggcacccagacacaucauaaacuuauaaaagcuaaagacagagagaaucuugaaaguaagagagaaguaacucaucauauacaaggaauccucaauaggauuagcagcuaauuucucauuagaaaucuugaagucagagggcaguaggacaacauauucaaaguacugaaagaaaaagacugccaaacaagaauucuacauccagcaaaauuaucuuucaaaaaugaaggagaaauuaagacauucacagauaaacaaaaacugagauaguucaucacuaacaaacuucuacaaaaaaugcuaaacggaguccuucagggugaaauaaaaugauacuagcuaguaauguaaaucuacauaaagaaauaaauagcaccuguaaaguuaacuacauagguaaauauaaaagacaguauaaaugcauuuuuuugcguguaacacuuuuuuacuccugauuuaaaagacaacugcauaaagcaauaacuauaacuauguucaugggcacacaauguguaaagauguaauuuguuugacaauaauagcacaaaggagggaugaaggaauaaaguuauauagaggcaauuucuuuguauuacugagcuuaauuugguauuaauucuaauuggaguaauauaaauaaugauguuaauuguaauacccaaggaaacaacuaagaaaaaaaaaaaacaggcuaagugcaguggcucaugccuguaaucacaacacuuugggaggccaagguggguaacuugagcucaggaguuugagaccagcaugggcaacauggcaagguccugucucuacaaaaaaauuaaaaauuggccaggugcgguggcacacgccuguaaucccaguacuuugggaagccaaggugggcagaucacaaggucaggaguucgagaccagccuggccaacauggugaaaccccgccucaauuaaaauacaaaaaaauuagcugggugugguggcaggcaccuguagucccagcuacuaagaaggcugaggcaggagaauugcuugaacccaggagguggagguugcagugagccgagaucgugccacugcacuccagccugggugacagagugagacuuugucucaaaauaaauaaauaaauaaauaaauaaaaaauaaaaaacuaaaaauuagcugagcaugauagcacaugccuguggucccagcuauucaggaggcugaggcaggaggguagcuugagcccaggagguugaggcugcaaugagccauguuccuaccauggcacucuggccugggugacagagcaagacccuguaucaaaaaaaaauaaaaauuuuuuaaauuaaaaaaaugaauaaaagacauagggaagaaauaacagaaaaauuaaaaaugguacacuagaaaauaucuguuuaacuuaaaagaaggcauuacuagaggaauacaggaacaaaaaauaagauauagaaaacaaauagcaaaauugcaaacauaaacccuaccuuaucaggaauuacaauaacauaaguuaauuaaacacugcgauuaacccuuuuccuguuuaggaaaaaaaaacgugcagcuugcugccugugcucacuagauuuuauauaaacaugcucuuugaggcugaagcaaagcuaacugauuuucaaugucaaaacaaaauauaaaaacuauucuuggaguuauuucuaagcugaacuaacaucagaaucaucugaaucaucagaaucaucugaaucaucagaaccaucuauuuuggaaaaaucagauucaucaaaugauucuucauccaacgacuguucaagaacgauguuaacaucauuuguagggauguuacauuuucuaggauuugacauuuucaaugauugagaauuacuauauuuuguaaguggaaauaccacuccuaaaaacagaaugcuauaaauagaaugaugucuuuuguuuccaaagucgauauacuagagugaugugaaaauaauaauaaaaaugagacaguuuguggcaaaguuaucucaggguaaacacugcagccgcaagugccaucagagaguguucucagcacaaacgguaaaggguuaauaggcacaguggaugaaaaacgugacuuaauuauaugcuaucuguaagaggcacauuuuagauucaaagacccaaauaaguugaaaguaaauggauggaaaaagauuuaccaugcaaacaauagccaaaagagagcuggaauagcuauacuaauaugagguaaaauagaauuuaaaacagcaauuguuacuugagauaaagaaaaauauuuuauaagcauaaauggucaauccaucaagaagauuuaacaauaauaaguauaugugcaccuaacaacacagcacaaaauauaugaaauaaaaacaggcagaauuggagacagaaauagacaauucaacaauuauagcugaagacuucaauaucucauuuaaagaaauggguaaaacaacuagacagggaaccaaaaaggaaguuuuuuuuuuuuuuggagacguggucucacucagacuggagugcaguggugcaaucucagcucacugcaaccuccacuuucugggcucaagugauccucccacuucagccuccugaguagcugggacuauaggcgugugccaccauguggcuuuuugugugugcauguguauuuuuugcagaguugggguuuugccauguagcccaggauggucuugaacuccugcacucaagcaauccacccgccucagacucccaaggugcuggaauuagaggugugagcuacugugcauggccaauaaggaagauuugaaaaaugcuauaaaccaauuagaccucauaaacaucuauagaacacuucacccuacaauggcagaauacacauucuucuucagugcacauggaacauucuucaggacagacuauauguuaagccagaaaacaaaucucaguaaauugaaaaggacugaaauuauacaaaauauguucucugaccacaauggaaugaaauuagacaucaaaaacagaagaaaauuugaaaaauuuacaaauauguggaaaguaacacacuccuaaauaaccaauaggucaaagaagaaaucacaagugaaauuagaagauacuuugagaugaaugaaaaugaacacacaacauaucaaaauguaagggaugcaguuaaaguggugcuuaaaggagaauucauaguuguaacugccuauaucuaaaaagaagaaagauaucaaaaucaguaaccuaaucuuccauuuuuuucuaggaaauuagaaagaaaagagcaaacuaaguccaaagcaagcacaaggaaaaacauaauaagaguagaaauaaaugacauaaagaauuuuaaaaauagagaacuaauaaaacaaaaauuugguucuuugaaaagaucaauaaaauugauaaaccuuuagacuaagaauaaaaaagggcagaaaauucuaauuacuaaaaucaggaaugaaagaguggacauacuacugaccuuacagaaauaaaaaguauuauaagagaguauaagagaguacugugaacaauuaugugccaguaaguuagaaaaccuagaugaaauggacaaauuccuagaaagacacaaacuacaaaaacugacucaguaagaaauggaaaaucucaauagaccuauaacaagugaagagauugauuuaggaauaaguaaaacuuccuacaaagacauacccaggaccagaugucuucacuggugaauucuacuaaacauuuaaaaagaauuaauaccgaccaggcaugguggcucacaccuguaauccuagcauuuugguaggccaaagcaggaggaucgcuugagcccagggguucaagaccagccugagcaacacagcaagacccugucucaaaaaaagaaaaaaaauuaaugccaaucuucacaaaaucuucccaaaaauagaagaaggaacacuguccaacuuauucuaugaggccaguauuauccugauaccaaaaccagaaaaagacaucauaagaaaacuacagagcaaugucucuuacgaauauagauacaauaauccuuaacaaaauaaucacaaacuaaauccuacaacauacaaaaaggauuuauaccaaggccaagugagauuuagccuaggaaugcaaaugucuacaccuagacacaucauaaacaaacuuaugaacguaucaacuugcaugaaaaucaauuaauguacuacauaccauauucauagaauaaaggacaaaauucacacaaucaugucaauaaacacagaagaagcauuugacaauguccaacauccuuucacgacaaaaauacucaaccaacuaagaauagaaggagaaauuugucaacacugagguagcaguuaauauaugccagaugcauuguucuagacaccuuacauuuacuaaguaauuucauucucacaccaacuauaugaggcgggaacuauuauuaccuacauuuugcagaugaauaaacugagguacagggcguuuaaguaacuuuuccuguguuaagcaacuaauaaguuguggagguaagauucuuauacagaaauucuggcuacagaguccaugcucuuaaucacauucugcucuacugucucucaaagaauguagacuaauaauaaugauaaacaaauuggguuuccuuaaaacuaaugauucaagccgggcauggugguucaugccuguaaucccagcacuuugggaggccgaggcgggcagauugagaccaugcuggccaacauggugaaaccccuuuucuacuaaaaauacaaaaaguagcugggcgugguggcacgcaccuguagucccagcuacucgggaggcugagucaggagauucgcuugaacccaggaggcggaggcugcagugagcugagauugugccacugcacuccagccuggcgacagagcgagacuccuccucaaaaaaaaaaaagaaaaacuaaugauucaaucuuuaucuguaaguaaacuuaacuuacaacacuguugacguauaucagugaucauaauuuguaguacugguaagaauugcuaauauuaguagcaauguuuauuuaaucaaguugauaguguugggucaauauuuauauuuaauuguaauuuuagucauaaaauuggugaugaucauuuauaugaguaaacauaauuuguaauauugguaaaaauugacaaaauuacuuauacaauuugauugcauuaguaacaauuauuuaauuucuauuuguaacuaaaauuugauucauaacugugguacucauaauuuauauuaguaaucaaaauuuuaauauuagugauuuuuuuuauaauagcaguuagaauguuaaccauauuaguaauuauuucuauuaggaacuacaagauaauucaaaacacagguacucauggguuauauuaguaaucuuaauuuguaacacugguaauaguuauaucuguaaaaauuuuuacacuguuuguacuaaugguuuaauuuuauuuacuuauuuauuuaauguuuugagacagggucucacucuguugcccagguugggaugcgguggugcuaucauggcucacugcagccucaaccuccagggcucaagcaaucuucccaccucagcuucccaaguagcugggacuacagguguaugccaccaugccgggcugauuuuuaaauuuuuuguagaaauggggucucgcuauguugcccaggcuggucucaaacuccugggcucacgagauccucccacuuuggguuuaaauuuuuaaaaaauaauuauaacaauuuacaacauaaguacuaaucauuuauaguaauaaacuuaauuuguaacacuguaaugcauuguaauauuaguuguuauauuugaugauauuagcaaugauaauucaauuucuauuauuuaaacguucagcauauuuuauucuggcacauuguagcccaaugacccaacugugguagucuccacugcaugccauguuuauguaagucaaaacagguacuuauaauuuauauuagagcauaauuuguaauagcaauaaucauuuguaauaacagcaauaaucuuugaugcuauuaguaaugauuauucaauuucuacuagaaacuauaauuuaauucaugacauagguacucauaauuuacaacaguaaaaauaauuuauaauauuagugauaauuuguaauauuagugauuauauauauauauauauuuuuuuuuuuuuuuuuugagauggaguuucgcucuuguugcccaagcuggaguguaauagcgugaucuuggcucaccacaaccuccgccucccggguuccagcgauuccccugccucaacuucccagguagcugggauuacaggcaugcaccaccacgccgggcuaauuuuguauuuuuuuaguagagacaggguuucuccauguuggucaggcuggucucaaacucccgaccucaggugauccgcccacuucggccucccgaaguguugggauuacaggcaugagccaccgcgcccggccagugauuauauuucauaauaguaaccaaaaguucaauuucuauuaauuaauuaauaggagggaggcugaggugggacucuguugcccaagcuggagugcaguggcgugaucucuggucacugcaaccuccaacucccggguucaagugauucuccugccucagccucccaaguagcugggacuacaggcacgcaccaccaugcccagcuaauuuuuguauuuuuaguagagacggggucucauuauguugaccaggcuggucuugaucuccugaccucaugaucugcucaccucagccucucaaagugcugggauuacaggcaugagccaccgugccuugccaacaauuuaauuuauaacauuauuauugauaaauguuauuggcaauccuaauuugaauauagguaaaauuucuaucagaaggaauauuugauaauguuaguaauaaugacuuaauuucuauauguaauauauucugauucauuacauuaauucugucaauucacauuagaaauagguuuuuaauacuggcaaaaauagacaacaugaguaacaggaucugauacauauuagaauggaucaugauuuaguuuuccuuguaagcauaaggaaauucacgguagacccuaucacaaagcaacuucaugacuccacgugcacacagcagccacacucuugauaucgcacugcugauaauauaccaauauuuaauauuauugcaguaguuaugacucuucccuccugcccacucuauuuuccccaaacucaccauuucuuugugauugggguagaaggucugaucaauuagagggaauucuucuguccccaguuucuuaugcagucgaaccaucugggcaaacuaugagaaccaggagagcugggucagugaguccuucaccacgaaucuguaaguuucugaacacccucacuuccccaaaucgcagacugguuucaagcucccacauacaugcaugagcuguucccucugccaguggcacccuuccuguuacuuaccacccagggcuugucacagaaguuguagacagaaugcaaggaguuaacacuggggauuccagcauacugcagcccaaugaccaaacugcgguagucuccguugcgugccaugcugaaggcgugcuggcggaucagcacaaaauccggcuucagagaccuaguguggcagggguaggaguguugagaguucccccagaagcucccaaucacucucgaaacaaagaccaaguuuuuaaaucuccauagcucccagaaauugcaaagugguuucucaccucugcacacaugugugagcuguucccucugccuagugcacccuuucuacccucugcccaccuggugauccccuuuaagccucuccuaccuguucccuucucagcaaggucagcuugcagcuuaccgacacagcucugacaacucccuggucaccaucucucagacugcaagcugucuucaguguucugcccagaauaaauucuaaccuugggaccuuuaccaaggcuguuccaucugccuaaagcacuuccccccuagauaucugcauggaucacuccuucaccuccaucaggucuuuccucaaaugucucuccugcaaccaggccacccuaucccaacugcagaccccaccaucauccaacaauugcuacaucugcuuuagugcuauauauauauuuuuuucuuuuuuuuuuuucuguugagacggacuguugcucuguuguccaggcgcuggagcaaucauggcucacuguaaucuccgccucucggguucaagcgauuucccugccucagccucccgaguagcugggauuacaggcaccugccaccacgccuggcuaauuuuuuuauuuuuaguagagacgggguuucaccauguuggccaggcugauuuugaacuccugggcucaagcaauccacccaccuuggccucccaaagugcugggauuauaggcaugagccaccacauccggccacuguuauguuuuuucuuagcacuuuuacauuuucuuauuuauuuguguauuguguguaucucacaguagaauguaaguuucauaaggcccagguucuuuuucuuuuuuuuuuuuuggccuuucagcauguagaauaucuccuggcacacaguagguguacaauaaauauuuauugaauaugaaguccugagagcagcaucuggcaugcagcagaugucuagcaaauguuuauuuaauuaauaauugaaggcuggguguggcggcucaugccuguaaucccagcacuuugagaggacaaggcagguagauuguuugagcccagaaguuugagacaaaccugggcaacauagugaggaccccccccaucucuacaaaaaacauaaaaauuagcuaggcaugguggugcgcaccuguagucucagcuacuugggaggcugaggugggaggaucacuugagccugagagguugcagcugcagagagccaugauugugccagugcacuccagccugggagacagagcaagacccugucugaaauauauauauauauauauauauuuuuuuuuaaagucugacuuguggcauccuggggucccuggcucuuuuucugaagaaaaguugucuccccacauuccaugccuaaguucuugcccacagaaggauggguggggagguaggaacuuucccccagcucuaagggagaguucuuaugccuugcucauaacaccaagguacccuucuuauacucaccgcacgaccuucaccccauuccgaagaacuuccauauccacagagaauccaccauuggcaugggccacaagguugagaucagagaauucggccugggaaggagaaaaaaacuggugauucaccuacaucacacaaaaauggccacucaguuugcaguauggacaacugacccccagguccaaaugucccaacuuaccuguucuacuuuaaugucaauuucuccauggaucuuuuucccuuugaaguauuuugcccuggagaggaaaaacaacacaucugucaaugaugaaaucucagaagggaagacaaaacacaggcccuugacccuuuugccccuucaaugcuacuaaagaaaccacaaagugccuuauaauuauugaaauauuuugaaaaaaucaagagugcuuugugaauaaugucuguuguaauccucauggaguugcaaaaauauuaaaggacauugcaaacuguaaaauguggccuuacacugcagagagcagguauuucccaaaauuuagucugcucaucacauugucauuguaaauuuuuuaaaaaaacuucacaaaauuagcagcacuauguaaauuagaacauacuuugaaauugcauggagaccgguaaacagcaaagaaccuuagaaaacaccuaucuggccagguacgguggcuuacgccuguaaucucagcacuuugggaggcuggagguaggaggauugcuucaggccaaggguuggagaccacccuggacaauauagagagacccccaucucuacaaaaaaaauugaaaaaaaaaaaaaaaaaacaaaagccgagggcuguggcucacgucuauaaucccacaacuuugagaggccaaggcggguggaucaccugaggucaagaguucgagaccagccugaccaacauggugaaaccccuucucuacuaaaauacaaaauuagccagguguaguggugcaugccuguauucccagcuacuugggaggcugaggcaggagaaucacuuggacccaggaggcggaaguugcagugagccaaaauggugcuauuacacuccagccugggcaacaagagcgagacuccaucuccaaaaaacccaaaaaacaaaaacuagccaggcauaguggugcaugccuguagucccagcuacuggggaggcugaggcaggagaauggcuugagcccaggaggucgaggcuguagugagccgugauugcaccacugcacuccagcuuggggaacagagcaagaccuaggcaaaaaagagaaagaaauaaagagaaaggaaggaaggaaggaaggaaggaaggaaggaaggaaggaaggaaggaaggaaggaaggaaggaaggggaaggaaggaaggggaaggaaggaaggaaggagagaaagaaacuacauuucucugaagcgugccuguuuuuguguauuuuuuagugccuguguauaugucagugccugugucuggcuguguggccugaagcaucucucugcucucuggcccuuucgcaaggaggagcacauucaccaugugugguugugugcugugagaaacacaauggccauaggugggcagcugcauccgauaaggaggaguggauugaguggugcaggcuggguggcucuagagaagccaguguagcuggcaaugauggggggcagggaggaaugcagcugaggaggagagggagcaacaggagggagggggagugggagcagcaguaggaacaucacgaacugcuaugucauuguccccgggcccguccccagcugggcuugguuuccgguggccuccucccccaggcucaagauuucuagccaacaggcugcuugcuccagggauggaagcucauccucaaucagguuuaucauggaagggggaugagggggagagacacuuucagggcuacuggucacugacacacauacaaucagggucuuggacagacacacacacacacacacacacacacacacacacacggcacaaauggacccuggugacuugacugacauaugcaagagaccccaaguacagcuacuucuuuuuccuugcucucucucugacacacacacacacacacacacacacacacacaccaucgcugacacuauccccucagaaguguugagagagaaucucucucagcccugcacauuuuucaucuauaaacugaugaguggggaugaugaggguguaucacuguuucuaaaacuuuucugaccauaaguguaguuggauacugugguggucugcucaggccuccucuucagggacaauguaccuugaauggcagcuacugacagcucauggcuguguccccacugggaauugucuugucacagggaacugccuuguccaagguuacaccuacuucaugagggcauccccauggucuggucuaugaagggaaagaaaggccagccuccuugccucaaucugggcugacucugaaggacccucccagccccagggcucccccuaagagcagcggaggccccuaaggcaacuacaucuugagccagccucuuccucugcucaacccaacccuccucacaaguguugaucccaauggcacacuccaguaagccuccugcaugcaaaucuccaccucaaagucuuuuuccagggaacccaaccuaaaacagugggccauggaagucaaacuacaaggguggucuaaugcaauucuggagcuggguuacccagcagccagauggcagugaggacccaucaguagugggagguggggcauagauagccuccgauaugcuguagcaacgcaaagugcucugcagcagguccgggcuguggugcaagcaggaugugacuuaggccauaugauccagcagauccuaugacacuggaggugucaguaguaggaaaagaugcuguguggaauuucuucucccaggugggagaauacagcgcaggcccccaggguuuuggaguagcggugacuuuuccugauggugggcuguaaugggauucugguggaagggaauguacuggauggugaaauaucccuggaacuugagugaugucagggaaaugguaaccagacuugggugacuauucccuaaacgccauugaguagcugaagaaagaccugacaugcucagggugaauucaaggcaaaaugugaaagccagaggaucucccugacugcauuuaaggaaacccucaucuccugcagucagagggcagacagaagggagggccaggcucagaauuuaauucuacgugguggcggagcuucggagaaaguugacuucucaggcccagcacaucuccugggccaugcucaugucccuaauaggacaggaguaggacucugagauggggauaucugggcagaugcaguuaaacaccuugaacuuacagacucaccugcauccacugggccugcugaaguagacuacuccccugaguuagaauauagaccuucugcuugaagauaaugcagaggccucggaugaugcaggugcuuuguaagacaaugccugccccccucagagucuaccccccaccuacccuccuggaaaccagaccaaaaauuagggugaaauccuagugaaaccugacuggacagguucuaggcuugcaaagggagagaaaugaucuguagaagaaccuaaagaaucuggcuaguacguauuggcaggagcugggaagguaugcaugagacuggauccugaggacaaugggcgaaggagguagaacaggaaguuggugugcucucccaggauacggaacuuaaaacccuggcgaggacucuaggaaguguuacuaacacacugguauuuggaaaccuggaguaaacaauggcccacacuaagugaagcagaacuuccauggcagauugcacagggaaggauuaaagggcucaaagaagcagacauguuggaguagauauacuacugaagucuggaaaacccaccagcugauuaaggccuggaggauacacucaacuuaugaaauuaauaagaaacaugcuggugagggugguaccagucacgcugagaagcacaguagugguaaggugauaaaugaguccuggcccagguccugcuuacagugggucuggugggucuagagacccacccaguggucacuuccucaguucacaaaugcguaauugcaauggcauacuuuguaguugucagaaccccuacaugggcuccucagccugugggauaagagcuguuucaguagggaaguccaaauagaagcuucuaaaauggcgcacacccccaugcccugaacaaaacaauaaaccacaaacaauauugugugcauccuaugggugaugauggaaaucaaugccacauugaaagaucuaaaggaugcagggguguuggucucaucuuaucuccaucgaguugagcagucuggccccuggagaggucagauggguccuggagaaugcuugcagauuacugcaagcacaaucaaguaguacccuuaguuauaccugccauacuggacacgcugucauugccagagcagauuaauaagaccucagguacagcagguggcugcugacuuggcaaaugcauucuuuuuuauucugauuagaaaaaaggaucagaaacaguuuacacucacaugagacugaugauaauauucauagauggucuugcuguagggcuaugcuaucucucucaccuggugucauaauauaguccagagaaaccuggacuaucuggacaucccauggaauagcacacuggaccaccacauggauuacaucauacugauugugcaagaugagcaagagagggugagcauauugcccugguaagacacauccacuacagaggguggaggauaaacuccacaaagacucaggggaccgaugcauuaguaaaauuuuuaggaauccagugguccagggcaguaaaccaggacagccccuccaaagaauagagcaaagcauugaaucacgcaccuuccaccaugaagaggaaagcacaauaccuaggaggccucuucccauucuggaggcagcaugucccccacacacaaauaaugcucugacccauauuccaggcgacauguaaagcuaccagcuuugugugagggccagagcagaaaagggcucugcagcagguccaggcugugguacaagcaguccugccauuuaggccagaugaucuggcagaucuuaugauacuggaggugucaguaguggggaaagaugcagugaggagcuuaugggaagccugagugggaggcccuugggguucuggagcaaagccaugccaucugcagcagagaauuuuacgccuuuugagaaagacaccccauugaggugcugggcccugauagagacagaaugcuugaccaggcaccaaaugauugugcauccagaaguucccauuauaagcuggguccugcugggcccgccaaauaauaaagucaggugggcccagcagucaggauugagcccaagcagaaccaagcaaggugcaugagcagguaaguaacccugauccccaugucuuccacacuguugugcuagugccugucucacuaaggggacuccuuaaaacuagcugaugaaagagggaaaggucuaagcuugguucacaaauugguugucuuaguauguggguggaagccaaaaaugggcagugguugcacuauaacccaacuggaauggccuugaaagacaguggcagagcucccagugggcagagcuucaggcugugcaccugcucaucuccuuugugcagaaagagaagugccucaagauuagaauacauauauccacuuaugggcagugguaaaugguuuggcugguuggucaggggccuggaaauaaaaagacuggaagauccagacaaagaggucugggauacagaaaugugggcagacaccuaggagugggcaagaaaugaggagugagacugggcgcgguggcucacgccuguaaucccagcacuuugggaggccgaggugggcggauuaccugaggucaggaguucaagaccagcuuagccaauguggugaaaccccaucucuacuaaaaauacaaaaauuagccgggcgugguggcgcacgccuguaaucccagcuacucgggaggcugaggcaggggaauugcuucaaccugggagguggagguugcacugagccaagaucgugccacagcaccagccugggcaauagagcgagacuccgucuccaaaaaaaaaaaaaaaaaaaaaaaaagggaggagcgaggaucuuuggaucguguguuaacacccaccagacagcaucugccauggcgccauggaagugacacuaggcaaccagguagacagcaugagucagcccgaugaugucagccaggcucuaaucagccaccccaguguuagcagaugggcacaugaauaaguggcaauagcagcagagagagaagcuaugugugggggcagcaguguuacugcugaauguccaaucugccagcaacagagacuaacauugaaucccugacacgccaccaucccuccagaaggccaaccaaccacuuuguggcaagcugauuagauugggccccuuccauccugcaaagaacaguaaucgauuuugacuggaauauuccauauuugaguuugccuuuucuuacugcaggaccucagccagcucacugucuaagggcuuacauaacguuugauccaccagcacgagacccugcauaacacugcgucaaaccaaaggacacacuuuauagcaaaguaaaggaaugcaaagcaaaggaggugcaaaagugggcccaugaccauggaauuaacugaugguauuacacaccacgccacccgggagcugcuggccugauggaaugauggaacaauuuggugcagccacagcuaagaucccagguugaaggugagaucaugcaagaaugggcaccauccuccaaaacagugucaacccuaaaucaauggccauuguaggugcuguguuccuaacagguagaauacaccgguuuggggacacagagguuaggaaggaguggcccagcuuaccagcaaucccagugauccacuuuugaaauugugcuuccuguucccucagggcucugcaagguuagagguccugguucuccaagggggaacacugcuaccaggggacacagcaagaaucccauuaaacuguaagcuaugauugcccucagggcacuucguguuucucaugccaagggacauaaaaaggagccauugucuuggcaggggacgugaccaaccuugcuccucaggaggagguagagcugcugguacacaguggaggcagggaggaguaugucuggcacccaggggauccacuugggcaucuguugguacuccuugcucaacuuugauaguaaaugggaaaugugguuguuuguacagcagcuacagccugagaagggcauggggaccaaaggcucagggaucucugcaggaugggagccacccagaccaagaguggugcuagcugaggguggggggaaucuagaauggguaacaaaagaaggagaggaugaauaucauuuaugacguugaaaucaacugcagcagcagagacuauggcucaucucacuaccgugcucuuucaagugucccugagaaaacaagaccgauuagaauucuggaaaugccguuccccaauggggugaacuuacuauaagaaggaaguggaucggagcagugcaagguguggacuauaugcuccccccagauccuuaccuccuuguuccagaccuuugcaucuauccucagcuucuggaauuauccgcugcugauggcucauaggugucccucacugggcauuggccucugcaacagggauuugccucacccaagauuacgccuccucccagggggcagccuacagccaaugacugacauaggaauucaaagccuggccaccccgcuucaacugggacaacucugaagggucauuccagugccagagcuccccagaggauuggccgaggccucuuuugugguugcaucacagcucaacuuuucccucugcacaauccugcuucccucacaaccucccccacagguguuauucccaagcgcucuccccaguaaaucugcaugcaaaucucagagucucggggucugcuuccagggaaauauaucugagaaaagaagccacaguaagaaauaaagcuuauauaacccacuauauauguauuugcauaauaacucauccuauauauguauuauauaagacacauauguuguacagcaaauaugagaauauagaaugucuuauauauuauguaacauauaaaauguuguauauuacauauuauguguauauguauuuagaauguauauaaauacauaugcauaacuggaauuaaaguuucaauagauaauuaccuuuacuauguguaaugcagucugauuuuucuaugcuauuuuauuucauuucaugaagaagaacauauacauauagauguauuauguacuguaaagccauuguauaacacauguauuacauaccguaugucauauauaauauacauuacagauuguauaucuuaauggaauaacauuauauguuuugcuaaacaacaacuccauuuacuaugugcaauaugcucuguuauucucuauuuuuauuuauccuacuucaagaagaaagugaaaugcuggucauaagccaauaggugacccauaguuugagaaacaccagagagccgggcacgguggcucaagccuguaaucccagcacucugggaggccgagguggguggaucacgaggucagaaguuugagaccagccugaccaacauggugaaaccccaucucuacgaaaaauacaaaaauuagccaggcauaguggcaugugccuguagucccagcuacucaggaggcucgcuugaacccaggagacggagguugcagugagccgagaucgugccauugcacuccagccugggcgacagagcaagacuccgucucaaaaaaaaaaaaagaaagaaaaacacaggacaaaauuacccacaaaaugggggagaugagucucaacuuagaguuuucaacuuuaaaccacagaggaauugagacccaggaaggaaugaggguggugagguuugguggaaaaggcgucagacuguauuucgguguacauuccaucacagaguuugcacaacuccugcuuuauuuggggcugaaaucccugaagcuagugugguucugagugucugcaaguugguaaaacaggucucuguuccccacacugagccuggcguacauacauaggcucugucccuuuguccaccccaccccacauauaguagacacuaaauaaauauuugcuagauugccuggaagaaaagacuggaggggaugcugggauaaaggggggcuucugagaugcagaaggggaagggauggaucuuucacugaauucagcaggugcucaauaaauguuuucuggacaaagaaaaaauggaaaacauugaauuugugauuauggaaaggggaagggacuugucaguauuccauagauaauaaaugcuugauggaaagaaggaagcagacgcaaaggaccugcauggagggcuggaguggagaccggaagucuaaaggagggugauuaccuauauccagcagaggccucauugauguuugcugacuucaauggagcaaacuuaaccaggaagauaacacguuggugaguggacguuggugaaggaauuacagcacgugcuccauaaaugcuuuacagauugauagagaaaaaagcggagaagccugcugcagggaugauaauguggcuguuugaaaauaauacaguaagagauuaauaaguguuuucuggacuaauucggggagaaaaaggcagcuggggagauggcuacuaaguggaggaagaggccuagcuagaauaaauggaaaacagugcacauugugagcuuucaggauuguguuguguaaaaggcaggauggagauuguugaagggggaauugggacuacaaaaaggggagaagaggcauuuaacgcaggguucucaguaguauacgauaaaugcucauuaaaugauugugggguugcauggaggaaaagguauagcaaggccagcuggcaggugaggauuucaagcacaccugcauuuagaaaaaaaagaaggaaggggagcugaagaaggguuauuccuaguauauaauggugcauaauaaaugccucccacacuuucauggaaaggaugcaauaaauaucugcagaaugaauaaauugcucugaauggagagaaaggcuacucgguaaaggcuccugggggagagguaaucuaaccaguaaacagcugguacucaauacauuuaggcugaaguagaccccuagagagagagcucuugaggcagggucagggauuuccagagacuuggaaagaggaaguugaaagugacuuauacaguaagugcucaauaaguguuuacuuaaauaguaaaacuauuaaguaaauaguaaauuuaguaaauuuacuaaauuuauuuaguaaauuaagucaauaguaaaacuauuaaguaaaaguguuuacuuaaguaaguguuacuuaaauagacuaaaagcccuuuggggguaugaauuaaaguugguagagggaauccuagggguacugaagggagugggaaaggggugaucauuauaaacucagcucuggauuuaucacaggaaaggaccuugggagaggccuugugauuggaacaggcucuccuagggguaaggaagaagaauguacuccccaaaacaacagguccugcauaugugcucacuggaucuacuguuaagaaaacaauucuggggaggaggugugaauauacagaacacacagaagacacuccauaaaugcucaggggagccauuggaagaaaaggucuuugggggaggaugauuaaaauggagcacaugacagacaaggaauaaaugcucacuggauccauuagaagaaaaggccuuuggggaguggggcuggggauggacauauagucaccugaucaaggcucacugcaucccugaaggaaaaguccuauggggaggggaaaugggagugcagaaaguugaucuaugggagcucgauucuucauccauaggagaaaaggcuuuugugaagaaggcacacaaucagguacacagcaggugcuccauaaauacuccaaggagugauuaaaagaaaaggucuuuggaaagagugacuggaaugguacacacagcaagugccagauaucugagcacuguauuaacuggaggcacaggccuuuauggagaggucuaagguugggucaugcagaaagugcucaauacaugcagacugaagccacuggaggaaaggguauugcagaaaggguuugagggugggguauacagcaggcaccagucaaugcaugcuugcugaauacacuggaggaaagaacuuuuagagaaggcucacacugcaggcaguugauaaaugcuagauggauccaccaaaggaaaggucuuugaagaaguagcuggagaacgggggauacaagaggcacucaauaaauguuuucuagauccacuguagggaaaggucuuugaggagacggucugaagaugagucacacaaagaagguucaaaacugcucauggaacucacuggaggaaaaugauuuguuugagaagggguuugggggugcggcacguaucaggcacuuaacaaaugcuuccuagauccuuuggagaaaaggcccucagagagagggcuuggaguuggggcacagagaaggcauccaaucaaaacucacaggauccaugaaaggcaaagcuuuuggagagaagcuggggugggauacacagcagguacucaauguuuacuaaauaguuuaaaagggcuuuaaggacggagcuggggugggacacauagcauagacuggacacaugcucacaagacccauuagagaaggccucagggcaaggguugaggagaacaggacaguaucaggcucucaaagaaugcucacaaaccucauugaaaucaaaggccuuggggaagggcucuuggaugaggcauacugcagguacuagauaagugcucacaagauccauuagaggacaaggccuauggggcaaggguuggggaggguaggaaggacacguucgguuuucgaaggcucauaggauauauugaagccaaagacuuuugggggagggguaguagggaacagguacgcagcaggugccugauaauugcucccuggauccaucaagguuuaaggggcggaggggggcgacaagggcggggcacagaggaagcauccagcuuaauaauuuaaaggaaaaagauuuaggugagagggccaggugucaggcacacaagcggcgcucgauaauugcucauucgcagaagaacgaucuggggacccaggcccacgggagacguccgcggcaguggcuuaccagucggugugcggcucgucgaugaccagcagcacccuggaggcggcucccccgcggccugcgcccccagagccgccgcccaccugcucgcugaagguggcagcugccgccgccguggucugcuugaccgcguuggacagcgacgagaagaagccaccgccccccgaggacccggggcuaggggcggccggagaggccgcuggggcgaccccggaggaccucucggcaguggcggucccgggaccgggcguggcuccggggcugugggcaccgggcggcggugggggcggcugcggacgcugcaggucugucauguacccauuuggcagauuggccauaaaguugcuguccgacaggcggcgccgcagguaguucauggcugcgacuuggggcaggggguccuagggguggucuggccaggagccgcgggggcggacugcgcggugcccaggagcacagcugcgcucucaggcacgacacgacuccuccgcugcccaccgcagacu

SEQ ID NO: 192815 - RNA, 47957 nt, Homo sapiens
agucugcggugggcagcggaggagucgugucgugccugagagcgcagcugugcuccugggcaccgcgcaguccgcccccgcggcuccuggccagaccaccccuaggacccccugccccaagucgcagccaugaacuaccugcggcgccgccugucggacagcaacuuuauggccaaucugccaaauggguacaugacagaccugcagcguccgcagccgcccccaccgccgcccggugcccacagccccggagccacgcccggucccgggaccgccacugccgagagguccuccggggucgccccagcggccucuccggccgccccuagccccggguccucggggggcgguggcuucuucucgucgcuguccaacgcggucaagcagaccacggcggcggcagcugccaccuucagcgagcaggugggcggcggcucugggggcgcaggccgcgggggagccgccuccagggugcugcuggucaucgacgagccgcacaccgacugguaagccacugccgcggacgucucccgugggccuggguccccagaucguucuucugcgaaugagcaauuaucgagcgccgcuugugugccugacaccuggcccucucaccuaaaucuuuuuccuuuaaauuauuaagcuggaugcuuccucugugccccgcccuugucgccccccuccgccccuuaaaccuugauggauccagggagcaauuaucaggcaccugcugcguaccuguucccuacuaccccucccccaaaagucuuuggcuucaauauauccuaugagccuucgaaaaccgaacguguccuuccuacccuccccaacccuugccccauaggccuuguccucuaauggaucuugugagcacuuaucuaguaccugcaguaugccucauccaagagcccuuccccaaggccuuugauuucaaugagguuugugagcauucuuugagagccugauacuguccuguucuccucaacccuugcccugaggccuucucuaaugggucuugugagcauguguccagucuaugcuaugugucccaccccagcuccguccuuaaagcccuuuuaaacuauuuaguaaacauugaguaccugcuguguaucccaccccagcuucucuccaaaagcuuugccuuucauggauccugugaguuuugauuggaugccuucucugugccccaacuccaagcccucucucugagggccuuuucuccaaaggaucuaggaagcauuuguuaagugccugauacgugccgcacccccaaaccccuucucaaacaaaucauuuuccuccagugaguuccaugagcaguuuugaaccuucuuugugugacucaucuucagaccgucuccucaaagaccuuucccuacaguggaucuagaaaacauuuauugagugccucuuguaucccccguucuccagcuacuucuucaaagaccuuuccuuugguggauccaucuagcauuuaucaacugccugcagugugagccuucucuaaaaguucuuuccuccaguguauucagcaagcaugcauugacuggugccugcuguauaccccacccucaaacccuuucugcaauacccuuuccuccaguggcuucagucugcauguauugagcacuuucugcaugacccaaccuuagaccucuccauaaaggccugugccuccaguuaauacagugcucagauaucuggcacuugcuguguguaccauuccagucacucuuuccaaagaccuuuucuuuuaaucacuccuuggaguauuuauggagcaccugcuguguaccugauugugugccuucuucacaaaagccuuuucuccuauggaugaagaaucgagcucccauagaucaacuuucugcacucccauuuccccuccccauaggacuuuuccuucagggaugcagugagccuugaucaggugacuauauguccauccccagccccacuccccaaaggccuuuucuucuaauggauccagugagcauuuauuccuugucugucaugugcuccauuuuaaucauccucccccaaagaccuuuucuuccaauggcuccccugagcauuuauggagugucuucuguguguucuguauauucacaccuccuccccagaauuguuuucuuaacaguagauccagugagcacauaugcaggaccuguuguuuuggggaguacauucuucuuccuuaccccuaggagagccuguuccaaucacaaggccucucccaagguccuuuccugugauaaauccagagcugaguuuauaaugaucaccccuuucccacucccuucaguaccccuaggauucccucuaccaacuuuaauucauacccccaaagggcuuuuagucuauuuaaguaacacuuacuuaaguaaacacuuuuacuuaauaguuuuacuauugacuuaauuuacuaaauaaauuuaguaaauuuacuaaauuuacuauuuacuuaauaguuuuacuauuuaaguaaacacuuauugagcacuuacuguauaagucacuuucaacuuccucuuuccaagucucuggaaaucccugacccugccucaagagcucucucucuaggggucuacuucagccuaaauguauugaguaccagcuguuuacugguuagauuaccucucccccaggagccuuuaccgaguagccuuucucuccauucagagcaauuuauucauucugcagauauuuauugcauccuuuccaugaaagugugggaggcauuuauuaugcaccauuauauacuaggaauaacccuucuucagcuccccuuccuucuuuuuuuucuaaaugcaggugugcuugaaauccucaccugccagcuggccuugcuauaccuuuuccuccaugcaaccccacaaucauuuaaugagcauuuaucguauacuacugagaacccugcguuaaaugccucuucuccccuuuuuguagucccaauucccccuucaacaaucuccauccugccuuuuacacaacacaauccugaaagcucacaaugugcacuguuuuccauuuauucuagcuaggccucuuccuccacuuaguagccaucuccccagcugccuuuuucuccccgaauuaguccagaaaacacuuauuaaucucuuacuguauuauuuucaaacagccacauuaucaucccugcagcaggcuucuccgcuuuuuucucuaucaaucuguaaagcauuuauggagcacgugcuguaauuccuucaccaacguccacucaccaacguguuaucuuccugguuaaguuugcuccauugaagucagcaaacaucaaugaggccucugcuggauauagguaaucacccuccuuuagacuuccggucuccacuccagcccuccaugcagguccuuugcgucugcuuccuucuuuccaucaagcauuuauuaucuauggaauacugacaagucccuuccccuuuccauaaucacaaauucaauguuuuccauuuuuucuuuguccagaaaacauuuauugagcaccugcugaauucagugaaagauccaucccuuccccuucugcaucucagaagccccccuuuaucccagcauccccuccagucuuuucuuccaggcaaucuagcaaauauuuauuuagugucuacuauauguggggugggguggacaaagggacagagccuauguauguacgccaggcucaguguggggaacagagaccuguuuuaccaacuugcagacacucagaaccacacuagcuucagggauuucagccccaaauaaagcaggaguugugcaaacucugugauggaauguacaccgaaauacagucugacgccuuuuccaccaaaccucaccacccucauuccuuccugggucucaauuccucugugguuuaaaguugaaaacucuaaguugagacucaucucccccauuuuguggguaauuuuguccuguguuuuucuuucuuuuuuuuuuuuugagacggagucuugcucugucgcccaggcuggagugcaauggcacgaucucggcucacugcaaccuccgucuccuggguucaagcgagccuccugaguagcugggacuacaggcacaugccacuaugccuggcuaauuuuuguauuuuucguagagaugggguuucaccauguuggucaggcuggucucaaacuucugaccucgugauccacccaccucggccucccagagugcugggauuacaggcuugagccaccgugcccggcucucugguguuucucaaacuaugggucaccuauuggcuuaugaccagcauuucacuuucuucuugaaguaggauaaauaaaaauagagaauaacagagcauauugcacauaguaaauggaguuguuguuuagcaaaacauauaauguuauuccauuaagauauacaaucuguaauguauauuauauaugacauacgguauguaauacauguguuauacaauggcuuuacaguacauaauacaucuauauguauauguucuucuucaugaaaugaaauaaaauagcauagaaaaaucagacugcauuacacauaguaaagguaauuaucuauugaaacuuuaauuccaguuaugcauauguauuuauauacauucuaaauacauauacacauaauauguaauauacaacauuuuauauguuacauaauauauaagacauucuauauucucauauuugcuguacaacauaugugucuuauauaauacauauauaggaugaguuauuaugcaaauacauauauaguggguuauauaagcuuuauuucuuacuguggcuucuuuucucagauauauuucccuggaagcagaccccgagacucugagauuugcaugcagauuuacuggggagagcgcuugggaauaacaccugugggggagguugugagggaagcaggauugugcagagggaaaaguugagcugugaugcaaccacaaaagaggccucggccaauccucuggggagcucuggcacuggaaugacccuucagaguugucccaguugaagcgggguggccaggcuuugaauuccuaugucagucauuggcuguaggcugcccccugggaggaggcguaaucuugggugaggcaaaucccuguugcagaggccaaugcccagugagggacaccuaugagccaucagcagcggauaauuccagaagcugaggauagaugcaaaggucuggaacaaggagguaaggaucuggggggagcauauaguccacaccuugcacugcuccgauccacuuccuucuuauaguaaguucaccccauuggggaacggcauuuccagaauucuaaucggucuuguuuucucagggacacuugaaagagcacgguagugagaugagccauagucucugcugcugcaguugauuucaacgucauaaaugauauucauccucuccuucuuuuguuacccauucuagauuccccccacccucagcuagcaccacucuuggucuggguggcucccauccugcagagaucccugagccuuugguccccaugcccuucucaggcuguagcugcuguacaaacaaccacauuucccauuuacuaucaaaguugagcaaggaguaccaacagaugcccaaguggauccccugggugccagacauacuccucccugccuccacuguguaccagcagcucuaccuccuccugaggagcaagguuggucacguccccugccaagacaauggcuccuuuuuaugucccuuggcaugagaaacacgaagugcccugagggcaaucauagcuuacaguuuaaugggauucuugcuguguccccugguagcaguguucccccuuggagaaccaggaccucuaaccuugcagagcccugagggaacaggaagcacaauuucaaaaguggaucacugggauugcugguaagcugggccacuccuuccuaaccucuguguccccaaaccgguguauucuaccuguuaggaacacagcaccuacaauggccauugauuuaggguugacacuguuuuggaggauggugcccauucuugcaugaucucaccuucaaccugggaucuuagcuguggcugcaccaaauuguuccaucauuccaucaggccagcagcucccggguggcgugguguguaauaccaucaguuaauuccauggucaugggcccacuuuugcaccuccuuugcuuugcauuccuuuacuuugcuauaaaguguguccuuugguuugacgcaguguuaugcagggucucgugcugguggaucaaacguuauguaagcccuuagacagugagcuggcugagguccugcaguaagaaaaggcaaacucaaauauggaauauuccagucaaaaucgauuacuguucuuugcaggauggaaggggcccaaucuaaucagcuugccacaaagugguugguuggccuucuggagggaugguggcgugucagggauucaauguuagucucuguugcuggcagauuggacauucagcaguaacacugcugcccccacacauagcuucucucucugcugcuauugccacuuauucaugugcccaucugcuaacacugggguggcugauuagagccuggcugacaucaucgggcugacucaugcugucuaccugguugccuagugucacuuccauggcgccauggcagaugcugucugguggguguuaacacacgauccaaagauccucgcuccucccuuuuuuuuuuuuuuuuuuuuuuuuuggagacggagucucgcucuauugcccaggcuggugcuguggcacgaucuuggcucagugcaaccuccaccucccagguugaagcaauuccccugccucagccucccgaguagcugggauuacaggcgugcgccaccacgcccggcuaauuuuuguauuuuuaguagagaugggguuucaccacauuggcuaagcuggucuugaacuccugaccucagguaauccgcccaccucggccucccaaagugcugggauuacaggcgugagccaccgcgcccagucucacuccucauuucuugcccacuccuaggugucugcccacauuucuguaucccagaccucuuugucuggaucuuccagucuuuuuauuuccaggccccugaccaaccagccaaaccauuuaccacugcccauaaguggauauauguauucuaaucuugaggcacuucucuuucugcacaaaggagaugagcaggugcacagccugaagcucugcccacugggagcucugccacugucuuucaaggccauuccaguuggguuauagugcaaccacugcccauuuuuggcuuccacccacauacuaagacaaccaauuugugaaccaagcuuagaccuuucccucuuucaucagcuaguuuuaaggaguccccuuagugagacaggcacuagcacaacaguguggaagacauggggaucaggguuacuuaccugcucaugcaccuugcuugguucugcuugggcucaauccugacugcugggcccaccugacuuuauuauuuggcgggcccagcaggacccagcuuauaaugggaacuucuggaugcacaaucauuuggugccuggucaagcauucugucucuaucagggcccagcaccucaauggggugucuuucucaaaaggcguaaaauucucugcugcagauggcauggcuuugcuccagaaccccaagggccucccacucaggcuucccauaagcuccucacugcaucuuuccccacuacugacaccuccaguaucauaagaucugccagaucaucuggccuaaauggcaggacugcuuguaccacagccuggaccugcugcagagcccuuuucugcucuggcccucacacaaagcugguagcuuuacaugucgccuggaauaugggucagagcauuauuugugugugggggacaugcugccuccagaaugggaagaggccuccuagguauugugcuuuccucuucaugguggaaggugcgugauucaaugcuuugcucuauucuuuggaggggcuguccugguuuacugcccuggaccacuggauuccuaaaaauuuuacuaaugcaucgguccccugagucuuuguggaguuuauccuccacccucuguaguggaugugucuuaccagggcaauaugcucacccucucuugcucaucuugcacaaucaguaugauguaauccauguggugguccagugugcuauuccaugggauguccagauaguccagguuucucuggacuauauuaugacaccaggugagagagauagcauagcccuacagcaagaccaucuaugaauauuaucaucagucucaugugaguguaaacuguuucugauccuuuuuucuaaucagaauaaaaaagaaugcauuugccaagucagcagccaccugcuguaccugaggucuuauuaaucugcucuggcaaugacagcguguccaguauggcagguauaacuaaggguacuacuugauugugcuugcaguaaucugcaagcauucuccaggacccaucugaccucuccaggggccagacugcucaacucgauggagauaagaugagaccaacaccccugcauccuuuagaucuuucaauguggcauugauuuccaucaucacccauaggaugcacacaauauuguuugugguuuauuguuuuguucagggcaugggggugugcgccauuuuagaagcuucuauuuggacuucccuacugaaacagcucuuaucccacaggcugaggagcccauguagggguucugacaacuacaaaguaugccauugcaauuacgcauuugugaacugaggaagugaccacugggugggucucuagacccaccagacccacuguaagcaggaccugggccaggacucauuuaucaccuuaccacuacugugcuucucagcgugacugguaccacccucaccagcauguuucuuauuaauuucauaaguugaguguauccuccaggccuuaaucagcugguggguuuuccagacuucaguaguauaucuacuccaacaugucugcuucuuugagcccuuuaauccuucccugugcaaucugccauggaaguucugcuucacuuagugugggccauuguuuacuccagguuuccaaauaccaguguguuaguaacacuuccuagaguccucgccaggguuuuaaguuccguauccugggagagcacaccaacuuccuguucuaccuccuucgcccauuguccucaggauccagucucaugcauaccuucccagcuccugccaauacguacuagccagauucuuuagguucuucuacagaucauuucucucccuuugcaagccuagaaccuguccagucagguuucacuaggauuucacccuaauuuuuggucugguuuccaggaggguaggugggggguagacucugaggggggcaggcauugucuuacaaagcaccugcaucauccgaggccucugcauuaucuucaagcagaaggucuauauucuaacucaggggaguagucuacuucagcaggcccaguggaugcaggugagucuguaaguucaagguguuuaacugcaucugcccagauauccccaucucagaguccuacuccuguccuauuagggacaugagcauggcccaggagaugugcugggccugagaagucaacuuucuccgaagcuccgccaccacguagaauuaaauucugagccuggcccucccuucugucugcccucugacugcaggagaugaggguuuccuuaaaugcagucagggagauccucuggcuuucacauuuugccuugaauucacccugagcaugucaggucuuucuucagcuacucaauggcguuuagggaauagucacccaagucugguuaccauuucccugacaucacucaaguuccagggauauuucaccauccaguacauucccuuccaccagaaucccauuacagcccaccaucaggaaaagucaccgcuacuccaaaacccugggggccugcgcuguauucucccaccugggagaagaaauuccacacagcaucuuuuccuacuacugacaccuccagugucauaggaucugcuggaucauauggccuaagucacauccugcuugcaccacagcccggaccugcugcagagcacuuugcguugcuacagcauaucggaggcuaucuaugccccaccucccacuacugauggguccucacugccaucuggcugcuggguaacccagcuccagaauugcauuagaccacccuuguaguuugacuuccauggcccacuguuuuagguuggguucccuggaaaaagacuuugagguggagauuugcaugcaggaggcuuacuggagugugccauugggaucaacacuugugaggaggguuggguugagcagaggaagaggcuggcucaagauguaguugccuuaggggccuccgcugcucuuagggggagcccuggggcugggaggguccuucagagucagcccagauugaggcaaggaggcuggccuuucuuucccuucauagaccagaccauggggaugcccucaugaaguagguguaaccuuggacaaggcaguucccugugacaagacaauucccaguggggacacagccaugagcugucaguagcugccauucaagguacauugucccugaagaggaggccugagcagaccaccacaguauccaacuacacuuauggucagaaaaguuuuagaaacagugauacacccucaucauccccacucaucaguuuauagaugaaaaaugugcagggcugagagagauucucucucaacacuucugaggggauagugucagcgauggugugugugugugugugugugugugugugugugucagagagagagcaaggaaaaagaaguagcuguacuuggggucucuugcauaugucagucaagucaccaggguccauuugugccgugugugugugugugugugugugugugugugugugucuguccaagacccugauuguaugugugucagugaccaguagcccugaaagugucucucccccucaucccccuuccaugauaaaccugauugaggaugagcuuccaucccuggagcaagcagccuguuggcuagaaaucuugagccugggggaggaggccaccggaaaccaagcccagcuggggacgggcccggggacaaugacauagcaguucgugauguuccuacugcugcucccacucccccucccuccuguugcucccucuccuccucagcugcauuccucccugccccccaucauugccagcuacacuggcuucucuagagccacccagccugcaccacucaauccacuccuccuuaucggaugcagcugcccaccuauggccauuguguuucucacagcacacaaccacacauggugaaugugcuccuccuugcgaaagggccagagagcagagagaugcuucaggccacacagccagacacaggcacugacauauacacaggcacuaaaaaauacacaaaaacaggcacgcuucagagaaauguaguuucuuucucuccuuccuuccuuccuuccccuuccuuccuuccccuuccuuccuuccuuccuuccuuccuuccuuccuuccuuccuuccuuccuuccuuccuuccuuccuuucucuuuauuucuuucucuuuuuugccuaggucuugcucuguuccccaagcuggagugcaguggugcaaucacggcucacuacagccucgaccuccugggcucaagccauucuccugccucagccuccccaguagcugggacuacaggcaugcaccacuaugccuggcuaguuuuuguuuuuuggguuuuuuggagauggagucucgcucuuguugcccaggcuggaguguaauagcaccauuuuggcucacugcaacuuccgccuccuggguccaagugauucuccugccucagccucccaaguagcugggaauacaggcaugcaccacuacaccuggcuaauuuuguauuuuaguagagaagggguuucaccauguuggucaggcuggucucgaacucuugaccucaggugauccacccgccuuggccucucaaaguugugggauuauagacgugagccacagcccucggcuuuuguuuuuuuuuuuuuuuuuucaauuuuuuuuguagagaugggggucucucuauauuguccaggguggucuccaacccuuggccugaagcaauccuccuaccuccagccucccaaagugcugagauuacaggcguaagccaccguaccuggccagauagguguuuucuaagguucuuugcuguuuaccggucuccaugcaauuucaaaguauguucuaauuuacauagugcugcuaauuuugugaaguuuuuuuaaaaaauuuacaaugacaaugugaugagcagacuaaauuuugggaaauaccugcucucugcaguguaaggccacauuuuacaguuugcaauguccuuuaauauuuuugcaacuccaugaggauuacaacagacauuauucacaaagcacucuugauuuuuucaaaauauuucaauaauuauaaggcacuuugugguuucuuuaguagcauugaaggggcaaaagggucaagggccuguguuuugucuucccuucugagauuucaucauugacagauguguuguuuuuccucuccagggcaaaauacuucaaagggaaaaagauccauggagaaauugacauuaaaguagaacagguaaguugggacauuuggaccugggggucaguuguccauacugcaaacugaguggccauuuuugugugauguaggugaaucaccaguuuuuuucuccuucccaggccgaauucucugaucucaaccuuguggcccaugccaaugguggauucucuguggauauggaaguucuucggaauggggugaaggucgugcggugaguauaagaaggguaccuugguguuaugagcaaggcauaagaacucucccuuagagcugggggaaaguuccuaccuccccacccauccuucugugggcaagaacuuaggcauggaauguggggagacaacuuuucuucagaaaaagagccagggaccccaggaugccacaagucagacuuuaaaaaaaaauauauauauauauauauauauuucagacagggucuugcucugucucccaggcuggagugcacuggcacaaucauggcucucugcagcugcaaccucucaggcucaagugauccucccaccucagccucccaaguagcugagacuacaggugcgcaccaccaugccuagcuaauuuuuauguuuuuuguagagaugggggggguccucacuauguugcccagguuugucucaaacuucugggcucaaacaaucuaccugccuuguccucucaaagugcugggauuacaggcaugagccgccacacccagccuucaauuauuaauuaaauaaacauuugcuagacaucugcugcaugccagaugcugcucucaggacuucauauucaauaaauauuuauuguacaccuacugugugccaggagauauucuacaugcugaaaggccaaaaaaaaaaaaagaaaaagaaccugggccuuaugaaacuuacauucuacugugagauacacacaauacacaaauaaauaagaaaauguaaaagugcuaagaaaaaacauaacaguggccggaugugguggcucaugccuauaaucccagcacuuugggaggccaagguggguggauugcuugagcccaggaguucaaaaucagccuggccaacauggugaaaccccgucucuacuaaaaauaaaaaaauuagccaggcgugguggcaggugccuguaaucccagcuacucgggaggcugaggcagggaaaucgcuugaacccgagaggcggagauuacagugagccaugauugcuccagcgccuggacaacagagcaacaguccgucucaacagaaaaaaaaaaaagaaaaaaauauauauauagcacuaaagcagauguagcaauuguuggaugaugguggggucugcaguugggauaggguggccugguugcaggagagacauuugaggaaagaccugauggaggugaaggagugauccaugcagauaucuaggggggaagugcuuuaggcagauggaacagccuugguaaaggucccaagguuagaauuuauucugggcagaacacugaagacagcuugcagucugagagauggugaccagggaguugucagagcugugucgguaagcugcaagcugaccuugcugagaagggaacagguaggagaggcuuaaaggggaucaccaggugggcagaggguagaaagggugcacuaggcagagggaacagcucacacaugugugcagaggugagaaaccacuuugcaauuucugggagcuauggagauuuaaaaacuuggucuuuguuucgagagugauugggagcuucugggggaacucucaacacuccuaccccugccacacuaggucucugaagccggauuuugugcugauccgccagcacgccuucagcauggcacgcaacggagacuaccgcaguuuggucauugggcugcaguaugcuggaauccccaguguuaacuccuugcauucugucuacaacuucugugacaagcccugggugguaaguaacaggaagggugccacuggcagagggaacagcucaugcauguaugugggagcuugaaaccagucugcgauuuggggaagugaggguguucagaaacuuacagauucguggugaaggacucacugacccagcucuccugguucucauaguuugcccagaugguucgacugcauaagaaacuggggacagaagaauucccucuaauugaucagaccuucuaccccaaucacaaagaaauggugaguuuggggaaaauagagugggcaggagggaagagucauaacuacugcaauaauauuaaauauugguauauuaucagcagugcgauaucaagaguguggcugcugugugcacguggagucaugaaguugcuuugugauagggucuaccgugaauuuccuuaugcuuacaaggaaaacuaaaucaugauccauucuaauauguaucagauccuguuacucauguugucuauuuuugccaguauuaaaaaccuauuucuaaugugaauugacagaauuaauguaaugaaucagaauauauuacauauagaaauuaagucauuauuacuaacauuaucaaauauuccuucugauagaaauuuuaccuauauucaaauuaggauugccaauaacauuuaucaauaauaauguuauaaauuaaauuguuggcaaggcacgguggcucaugccuguaaucccagcacuuugagaggcugaggugagcagaucaugaggucaggagaucaagaccagccuggucaacauaaugagaccccgucucuacuaaaaauacaaaaauuagcugggcaugguggugcgugccuguagucccagcuacuugggaggcugaggcaggagaaucacuugaacccgggaguuggagguugcagugaccagagaucacgccacugcacuccagcuugggcaacagagucccaccucagccucccuccuauuaauuaauuaauagaaauugaacuuuugguuacuauuaugaaauauaaucacuggccgggcgcgguggcucaugccuguaaucccaacacuucgggaggccgaagugggcggaucaccugaggucgggaguuugagaccagccugaccaacauggagaaacccugucucuacuaaaaaaauacaaaauuagcccggcgugguggugcaugccuguaaucccagcuaccugggaaguugaggcaggggaaucgcuggaacccgggaggcggagguuguggugagccaagaucacgcuauuacacuccagcuugggcaacaagagcgaaacuccaucucaaaaaaaaaaaaaaaaaauauauauauauauauaaucacuaauauuacaaauuaucacuaauauuauaaauuauuuuuacuguuguaaauuaugaguaccuaugucaugaauuaaauuauaguuucuaguagaaauugaauaaucauuacuaauagcaucaaagauuauugcuguuauuacaaaugauuauugcuauuacaaauuaugcucuaauauaaauuauaaguaccuguuuugacuuacauaaacauggcaugcaguggagacuaccacaguugggucauugggcuacaaugugccagaauaaaauaugcugaacguuuaaauaauagaaauugaauuaucauugcuaauaucaucaaauauaacaacuaauauuacaaugcauuacaguguuacaaauuaaguuuauuacuauaaaugauuaguacuuauguuguaaauuguuauaauuauuuuuuaaaaauuuaaacccaaagugggaggaucucgugagcccaggaguuugagaccagccugggcaacauagcgagaccccauuucuacaaaaaauuuaaaaaucagcccggcaugguggcauacaccuguagucccagcuacuugggaagcugaggugggaagauugcuugagcccuggagguugaggcugcagugagccaugauagcaccaccgcaucccaaccugggcaacagagugagacccugucucaaaacauuaaauaaauaaguaaauaaaauuaaaccauuaguacaaacaguguaaaaauuuuuacagauauaacuauuaccaguguuacaaauuaagauuacuaauauaacccaugaguaccuguguuuugaauuaucuuguaguuccuaauagaaauaauuacuaauaugguuaacauucuaacugcuauuauaaaaaaaaucacuaauauuaaaauuuugauuacuaauauaaauuaugaguaccacaguuaugaaucaaauuuuaguuacaaauagaaauuaaauaauuguuacuaaugcaaucaaauuguauaaguaauuuugucaauuuuuaccaauauuacaaauuauguuuacucauauaaaugaucaucaccaauuuuaugacuaaaauuacaauuaaauauaaauauugacccaacacuaucaacuugauuaaauaaacauugcuacuaauauuagcaauucuuaccaguacuacaaauuaugaucacugauauacgucaacaguguuguaaguuaaguuuacuuacagauaaagauugaaucauuaguuuuucuuuuuuuuuuuugaggaggagucucgcucugucgccaggcuggagugcaguggcacaaucucagcucacugcagccuccgccuccuggguucaagcgaaucuccugacucagccucccgaguagcugggacuacaggugcgugccaccacgcccagcuacuuuuuguauuuuuaguagaaaagggguuucaccauguuggccagcauggucucaaucugcccgccucggccucccaaagugcugggauuacaggcaugaaccaccaugcccggcuugaaucauuaguuuuaaggaaacccaauuuguuuaucauuauuauuagucuacauucuuugagagacaguagagcagaaugugauuaagagcauggacucuguagccagaauuucuguauaagaaucuuaccuccacaacuuauuaguugcuuaacacaggaaaaguuacuuaaacgcccuguaccucaguuuauucaucugcaaaauguagguaauaauaguucccgccucauauaguuggugugagaaugaaauuacuuaguaaauguaaggugucuagaacaaugcaucuggcauauauuaacugcuaccucaguguugacaaauuucuccuucuauucuuaguugguugaguauuuuugucgugaaaggauguuggacauugucaaaugcuucuucuguguuuauugacaugauugugugaauuuuguccuuuauucuaugaauaugguauguaguacauuaauugauuuucaugcaaguugauacguucauaaguuuguuuaugaugugucuagguguagacauuugcauuccuaggcuaaaucucacuuggccuugguauaaauccuuuuuguauguuguaggauuuaguuugugauuauuuuguuaaggauuauuguaucuauauucguaagagacauugcucuguaguuuucuuaugaugucuuuuucugguuuugguaucaggauaauacuggccucauagaauaaguuggacaguguuccuucuucuauuuuugggaagauuuugugaagauuggcauuaauuuuuuuucuuuuuuugagacagggucuugcuguguugcucaggcuggucuugaaccccugggcucaagcgauccuccugcuuuggccuaccaaaaugcuaggauuacaggugugagccaccaugccuggucgguauuaauucuuuuuaaauguuuaguagaauucaccagugaagacaucugguccuggguaugucuuuguaggaaguuuuacuuauuccuaaaucaaucucuucacuuguuauaggucuauugagauuuuccauuucuuacugagucaguuuuuguaguuugugucuuucuaggaauuuguccauuucaucuagguuuucuaacuuacuggcacauaauuguucacaguacucucuuauacucucuuauaauacuuuuuauuucuguaaggucaguaguauguccacucuuucauuccugauuuuaguaauuagaauuuucugcccuuuuuuauucuuagucuaaagguuuaucaauuuuauugaucuuuucaaagaaccaaauuuuuguuuuauuaguucucuauuuuuaaaauucuuuaugucauuuauuucuacucuuauuauguuuuuccuugugcuugcuuuggacuuaguuugcucuuuucuuucuaauuuccuagaaaaaaauggaagauuagguuacugauuuugauaucuuucuucuuuuuagauauaggcaguuacaacuaugaauucuccuuuaagcaccacuuuaacugcaucccuuacauuuugauauguuguguguucauuuucauucaucucaaaguaucuucuaauuucacuugugauuucuucuuugaccuauugguuauuuaggaguguguuacuuuccacauauuuguaaauuuuucaaauuuucuucuguuuuugaugucuaauuucauuccauuguggucagagaacauauuuuguauaauuucaguccuuuucaauuuacugagauuuguuuucuggcuuaacauauagucuguccugaagaauguuccaugugcacugaagaagaauguguauucugccauuguagggugaaguguucuauagauguuuaugaggucuaauugguuuauagcauuuuucaaaucuuccuuauuggccaugcacaguagcucacaccucuaauuccagcaccuugggagucugaggcggguggauugcuugagugcaggaguucaagaccauccugggcuacauggcaaaaccccaacucugcaaaaaauacacaugcacacacaaaaagccacaugguggcacacgccuauagucccagcuacucaggaggcugaagugggaggaucacuugagcccagaaaguggagguugcagugagcugagauugcaccacugcacuccagucugagugagaccacgucuccaaaaaaaaaaaaaacuuccuuuuugguucccugucuaguuguuuuacccauuucuuuaaaugagauauugaagucuucagcuauaauuguugaauugucuauuucugucuccaauucugccuguuuuuauuucauauauuuugugcuguguuguuaggugcacauauacuuauuauuguuaaaucuucuugauggauugaccauuuaugcuuauaaaauauuuuucuuuaucucaaguaacaauugcuguuuuaaauucuauuuuaccucauauuaguauagcuauuccagcucucuuuuggcuauuguuugcaugguaaaucuuuuuccauccauuuacuuucaacuuauuugggucuuugaaucuaaaaugugccucuuacagauagcauauaauuaagucacguuuuucauccacugugccuauuaacccuuuaccguuugugcugagaacacucucugauggcacuugcggcugcaguguuuacccugagauaacuuugccacaaacugucucauuuuuauuauuauuuucacaucacucuaguauaucgacuuuggaaacaaaagacaucauucuauuuauagcauucuguuuuuaggagugguauuuccacuuacaaaauauaguaauucucaaucauugaaaaugucaaauccuagaaaauguaacaucccuacaaaugauguuaacaucguucuugaacagucguuggaugaagaaucauuugaugaaucugauuuuuccaaaauagaugguucugaugauucagaugauucugaugauucagaugauucugauguuaguucagcuuagaaauaacuccaagaauaguuuuuauauuuuguuuugacauugaaaaucaguuagcuuugcuucagccucaaagagcauguuuauauaaaaucuagugagcacaggcagcaagcugcacguuuuuuuuuccuaaacaggaaaaggguuaaucgcaguguuuaauuaacuuauguuauuguaauuccugauaagguaggguuuauguuugcaauuuugcuauuuguuuucuauaucuuauuuuuuguuccuguauuccucuaguaaugccuucuuuuaaguuaaacagauauuuucuaguguaccauuuuuaauuuuucuguuauuucuucccuaugucuuuuauucauuuuuuuaauuuaaaaaauuuuuauuuuuuuuugauacagggucuugcucugucacccaggccagagugccaugguaggaacauggcucauugcagccucaaccuccugggcucaagcuacccuccugccucagccuccugaauagcugggaccacaggcaugugcuaucaugcucagcuaauuuuuaguuuuuuauuuuuuauuuauuuauuuauuuauuuauuuugagacaaagucucacucugucacccaggcuggagugcaguggcacgaucucggcucacugcaaccuccaccuccuggguucaagcaauucuccugccucagccuucuuaguagcugggacuacaggugccugccaccacacccagcuaauuuuuuuguauuuuaauugaggcgggguuucaccauguuggccaggcuggucucgaacuccugaccuugugaucugcccaccuuggcuucccaaaguacugggauuacaggcgugugccaccgcaccuggccaauuuuuaauuuuuuuguagagacaggaccuugccauguugcccaugcuggucucaaacuccugagcucaaguuacccaccuuggccucccaaaguguugugauuacaggcaugagccacugcacuuagccuguuuuuuuuuuuucuuaguuguuuccuuggguauuacaauuaacaucauuauuuauauuacuccaauuagaauuaauaccaaauuaagcucaguaauacaaagaaauugccucuauauaacuuuauuccuucaucccuccuuugugcuauuauugucaaacaaauuacaucuuuacacauugugugcccaugaacauaguuauaguuauugcuuuaugcaguugucuuuuaaaucaggaguaaaaaaguguuacacgcaaaaaaaugcauuuauacugucuuuuauauuuaccuauguaguuaacuuuacaggugcuauuuauuucuuuauguagauuuacauuacuagcuaguaucauuuuauuucacccugaaggacuccguuuagcauuuuuuguagaaguuuguuagugaugaacuaucucaguuuuuguuuaucugugaaugucuuaauuucuccuucauuuuugaaagauaauuuugcuggauguagaauucuuguuuggcagucuuuuucuuucaguacuuugaauauguuguccuacugcccucugacuucaagauuucuaaugagaaauuagcugcuaauccuauugaggauuccuuguauaugaugaguuacuucucucuuacuuucaagauucucucugucuuuagcuuuuauaaguuuaugaugugucugggugccuaucucuuugaauuuaucuuaguuggaguucagugcacuucuugaaugcauagauuaaugcuuuaaaucaaauuggggggauuuuuagccauuauuccuucaaauagucuuucuugcaccuuuuuuucucucuuuucucucuccuuuugggacuuccauuauguggguguucauaugcuucaugguguuccacagaccucuaggacuguguucauuuuguuuacuuuucuucuuccuguuccucagauuggaucaucucaccugaccugucuucaaauucacugauucuuuacccugccagcucaaagcuacuguugauccccucuagugaauuuuucauuucaguuauuaugcuuuuuaucuccagaauuucuuuuuuuuuuuuuuuuugagauggaguuucacuccugucacccaggcuagagugcaauggcacaaucucggcucacugcaaccuccaccucccagguucaagcaauucucgugccucagccucccgaguagcugggauuacaggcacacgccaccaugccuggauaauuuuuguauuuuuaguugagagggggguuucaccguauuggccaggcuggucucaaacuccugaccucaggugauccacccgccucagucucccaaagugcugggauuacaggcaugagccaccaugcccggcccagaauuucuuuuucauguaauuucucuuuauugauacucucuacuuauuaggauaucauuuuauccuuuccuuuaaguucuuuaaacauaguuuccuuuaguucuuugaaaauauuaaaaaucacugauuuacaguuuuugccuauuaagucuaacaucuggguuuccucagggauaguguuugacugcuuuuuucccuguguuugggccacacuuaauuuuguuucuuugcaucucucauacauuuuuguugaaaacuggacauuuaaauaauauaauguggcaacucugggaaucagguucucuccccuccucaggauuuguuuuuauugcuuuguuuuguuuuuagugaccuuccugaacuaauucuguaaagccuguguucuuugucauauguggcuacccaagucucugcuccguuagcuuaguggucagcuaaugauuggacagauauuucuuuaaaucaccugaaaccaguaagucucccagacuuugcugaugggcucuaugugcaugucagggugugccuuuaaugcaaaggcaggcuguuuacaacuuugccuuauccuucauuuccugcuugugcagaguuuugaggucagccagagauccuaggcauacauacagccuuaugcguauuugugguuuucuagauucccaggcauaugucagagcuuuuuaaagccuaauaauggacugauaauggauauauaauuaccuagauuuuccuuuuaaguuuucuugaaaagcuuguuguuuuuuccuaaauguuaucacugcuguguuaaacaguugcugcuaauuguuucugaaaagcacccccagagaaagcuguuuauaccagaugagccccaugaguggaguauucaggauagugccagacagaucaaauaaagacaguucucuggaaaugagauuuuggaggaacuccaacccuguucugccuccuccaaugguugcuagucugcugguuuucacuggaauugcagggcuguugauuuucaaggcucuuguggaggugaggagaaggggauguguacaagagaaguucaaaugccacagcuuccuguuguuaccaagauucagccauuuucuugaaaaaaugcuuucugaauuguaaaccuuggucaauuuccagaguucugauaaguuuguuuugacaauuuuugccaguguucucauugcuuuuaagcaauuuuaaggaggagaagacaggcucuuacauuucugcugacaucaccuccaggcauaucuuguucuuucccggccccagcccaaagauaauaguauuucaaagccaagaucugggaacuagauuuacucauugcuacuggaauguucuugcuucaaggcccucucauuguacacagcuaggacauuucauuucuuuauguauauauauauaauuucauauauguguauauauaaaauuguuauaugugugugaguagaagaaucaaacuguuuuuucuucugcucucacaauaccauguguggaggcuuuuacacacacaccaagaagcaauuaauucugcagcaaauuaauauaccagcuggauguccugcaauucaauucugacacuaucuaccuggaggauagcaucagaucacacagguuaaggguguagucccacaggacuaagcccuacuucuaaugcugauggcaagccccagguuauuuuaccugugcuucugaccaacuagcuauaaaucgggguccacaaccccuuccucagguucaauuaguuugcuaguguggcucauggaacucagggaaacacuuauuuacaugaucgguuuauuguaaagaguauuacauuacaaaggauacagaugaagagaugcagaggacgaagcaugugggaaagagcacagagcuuccaugccccacccccagguagccacccuccaggaaccccacauguucggcuauccagaagcucuccaacuccauccucuucagcccuucauggagacuucauugcauaggcaggauuuauaacuguauagaaaugugaugggacagccaggcgcaguggcucacaccuguaaucccagcacuuugggaggcugaggcaggcggaucaccugaggucgggaguucuagaccagccugaccaacauggagaaaccccguaccuacuaaaaauacaaaauuagccaggggcaguggcgcaugccuguaaucccagcuacucgagcggcugaggcaggagaauugcuugaaccaaggagacggagguugcggugagcugagaucacaccauugcacuccagccugggcaacaagagcgaaacucugucucaaaaaaaaaaaaaaagaaaagaaaagaaagaaagaaaugugaugggacaaaaagggugugaucuuguacuaacagacugaguggggaaacccagcaaggccugucuguucagagccuuagacucucucugcaacaucccuuccuucuggguauugggcaggaccccuucuaaaagggaggucuuuuuuuuucuuuuucuuuuuuuuuuuuuugagacagagucucacuuugucacccaacuggaguguggugguguggucuuggcucacugcagccucugccucccggguucaagcaauucucuugcaucagccucccaaguagcugggacuacaggugugugccaccacacccagcuaauuauuuuuguauuuuuaguagagaugggguucaccauguuagccaggcuggucuugaacuccuggccucaggugauccacuugccucugccucccaaaguucugggauuacagacgugagccacugcacccagccuuuuuuuuuuuuuugagauagaguccgugacucugucgcccaggcuggagugcaguggcgcaaucuuggcucacugcaaccuccgccuccuggacucaagcaaccuucccaccucagccuccugaguagcuggggccacaggugcgugccaccaugccuagcuaauucuuuuguauuuuuuauaagagauuggguuucaccauguugcucaggcuacucucaaacuccugagccugagcgaucuaccugccuuggccucccaaagugcuaggauuacaggcaugagccaccacgccugguaaugcugauuuaauuuuauauuuuuaaauguaagacguuagcgugguucuaaaagucaaaauauaaaaaaggcauccacagauaaaauagaaaaccuagaugaaaauaaguaauuuccuggggaaacacaguuuaccaaaaucgaccccauuagagguuaacaaaccaauuuccauaaaagaaauagagaaaguuuuuaaggaacuuccccauaaaaaaucaucaggcccagaugauuucacaggggaauuccacugaaaugcuagagacuaguuaaucccaauggccacauaaauuguuccacagaauggaaaaugaagacaaacuuccauauuaccuuucuaaagcaauuauaacauuaauagcacaaagaaaagcauagaccuggugcaguggcucacggcuauaaucacagcauguugggaggccagggcagguggaucacuugagaucaggaguucgagaccagccugaccaacaugguaaaaccccaucucuacuaaaaauauaaaaauuagcugggcgugguggugugcgccuguagucccagcuacuccggaggcugaggcaggagaauaacuugaacccaggaggcagagguugagugagcugagaucaugccacugcacuccagccugggugauagagcgagacuuugucucaaaaaaaaaaaaaaagcauagaccauuuuuacuauaaauaucaaugcaaaaauccuaaauaaaauauuagcaaacaaauucaaaaccacauuaagggugagcacgguggcuuacaucguaaucccaacacuuugggaggccaaggcagaaggaucacuugagcccaggaguucaagaccagccuggucaacauggugaaaccccaucucuaucaaaaaaacaaaacaaaacaaaaaaaacacaaaauuagccagacaugguggugcacccuuguagucccagcuacucgggaggcugaggcgggaggaucacuuaaguccaggaguuugaggcugcagugagcuaugaucccaccacugcacuccagccugggugacagagcgagaccuugucucaaaaaauaaaaauaaaaaagaaugcaguaacagcagcauaugaaaucaacaugcagaaaucaguaguuuuuauauacacaaauaaccagauagaagguauaauagaagagaaaacauauacaauaacaacaaaaaaaauaagauauuuugggauaagaucaacaagggaugugcaaagugauaugaggaaaaguuuaaaacacuccugaaagacacaaagguagacuuaggcagauggaaagacauuccuuguucucggguagaaugaauuaacaucaugaaaauggcaguucaccuucucacguccuuauuuaauuuauauauuuaaugugguucccaaaaauauaccuacaaacuuauaucuagagcuaaaugaguugauaguaaaguucauauggaaaagcgaacaugcaagaaaaacuaggaaaacccugaaaaagaaaagugauaauaaggacucauacucccagcccacagggagucugaugccucugccaccagacauuuuacgaagauuucauuuauuuauuuauuuauuuauuuauuuauuuauuugagacaaaaucuugcuguauugcccaggccggagugcaguggcaugauuguagcucacugcagccccaaccuccuggguuccagcaauccuucuaccucagccuccugaguagcuauaauuacaggugcauguauagcuaauuuuuuuauuguuuauuuuguagaggcacggucuugcuauguugccuagguuggucucaaacuccuggccucaaguaauccuccugcuuuggccuccccaaaacucugggauuauaggcaugagccgccauguccagccugaaacuuuuauaauuuaaauagugugaugcugacccaugaauagacaggcugacagauuaaaggaagaaaaacaaaaguccaguuauagauccauguacauauggaacuuuaguguaugaucaaaguagugacucaagucacuagagcaaagagggacuuuuuaguaaaguuucguuuuugccaucuaaauucuucauucuucugaaauuccuuuucauauacagugugaaggagguagggauugaguucaucuuuuuccuuauagguaagcccuugucccccacugagcuuguaugccaccucugucauauauauacuaacuuuuuuuuuuuuuugagacagggugucucucuguugcccaggcuggagugcaguggcgcgaucuuggcucacugcagccuccgccuccugaguucaagcaauucucccaccucagccucccaaguagcugggauuacaggggcaucccaccacacccagcuaauuuuugcauuuguaguagagacgggguuucaccauguuggccaggcuggucucgaacuccugacuucaggugauccacccgccucggccucccaaagugcugggauuauaggugugagccaccgcgcccggccuauacuaacauuucauaucucuguccugcagguucagaacucuauucuguuccauuggccacuuucuguaaaccuguaccaaagccauacuaccuuaacagcaacuuuucucauuaauuccuggugccugguagggcagcagcaccuccuggcuguuuuguaacuauguaguucugacaagaguagaaacagaaagggaaccacgaagagugggaacaggagcuggagcagggcuugauagcagggaacaugcaggcagagccugauggcccacgccuguaaucccagcacuuugggaggcugagcugggaggaucgcuugagccuaggaguuccggaccagccugggcaacaugaugaaaccccgucucuacaaaaaauuagcugagcaugguggcaugugccuguagucccagcuacuuagcuggcugaggugggaggaucacuugagcccaggagguugagguugcaaugaaccaugauugcaccacugcacuccagcuggggcaacagagugagacucugucucaaaaauaaaauaaaauaaaauaaaacauuuuacaaaagaguagggaauauguagaaggaccaagggauaggaaguaggcaacggggacaaggagcagggaauaggaagaagaaguaggggagcaagaggcaggaagaacaggggugagccacaacacaaaggggacgccuguggcugcgggagucccugagggacucacucaaggccccaucgcauccuuuccuauagaaagucaggaagcccuuucugggcuccucccugagccccuuccaaggaugcaccccccaucucgcagagugcagacuucuaucccucaaaggaccuggagggacagaggccaugucccaaggaccaguguagcaugaccauaugucccuuggcuaggacaugcuaugauccccaagucucaaagacucagaacacuacggacuggggacagaauuugcugugacgggcugaaguugggaacauaguauugugaggcggggguucuucguggggagaaugcuccagggauggggacuuuuuguuccaggguggugcagagggagaccugagggugaggaguccacacaggguggggacagguuggcuggccugccguuaggaaucccuaaaggggaaccucuccucauggugucgccacaguuguugugggugggcguguagaaggaucuaaccacauugcucuuuauuuucaggugcuucugugagccacagguucaggacuccacuaggaaacuggauugucugugagggggaaaagagagagggacacugggacugaggaacauuuauggcguaaagagcugggaucuuaguaucacaucaggagcuuuugggucucggagaccuaccccauuccuucaggcagagcagggucaggagcuuguauuuuggugaggagacuggugugggggagaaauggacauuaaauuauugguacuaaucauacacauuauuuccaauaucguauauuaucaugccuaauaucaaacauuguuugcaauauuauaaauaaucacuacuaaaguuauaaguuauaguuaucauaacuacuucuaguaacuaaugcuuguaagugcuauaugccuagcacuguuccaaguacuucacauauacaaccucauuuaauauggacauugucucuaugaguuaggccuucuuuuuaucccugucuuacagaugcaggaacugaggcucaaagaggcaauaugauuuauucaaggacacagagcuaagacauggcaggggcaagauuugaaugcagaugaucuggcuccaggguuccugcuuuuuuuuuuuuuuuuuuuuugagacggagucuggcucuguugcccaggcuggagugcaguggcuugaucucagcucacugcaagcuccgccucccagguucaugccauucuccugccucucgaguagcugggacuacaggcgcccaccaccauacucggcuaauuuuuuuuuuuuuugguauuuuuaguagagacaggguuucaccuuguuagccaggauggucucgaucuccugaccucgugaucugcccaccuuggccucccaaauugcugggauuacaggcguaagccaccaugcccggccuuuuuuuuuuuuuuuuugagacagucuugcucuaucccccagccuggggugcaguggcaugaucucagcucccugcaacuuccgccuccuggguucaaacgauucuugugccucagccucccaaguaacugggaccacagggcaugcgccaccacagcuggcuaaauuuuguauauuuaguagagauggaaaccauguuggccaggcucgucuugaacuccugaccucgugaucugcccaccuuggccucccaaagugcuaguauuacaggcgucagccaccaugacugucccauuuccuguguuuugacccccccaaaaauauccaaggggcaaagacaccccguaaacauccuccaaccccaccacagaccucugaaggauucugggccaggacugugacguccauguuuaaacauggcgagaaggacugaggcucaggugagagaaggacuggccccccaggcuccccacugagcugggucccaugcugaauaccacauggcugugaccccuacaagcuuccucucagcugucacagagucucucccagagauucacccacagacaccccgaaugcuggggauggaggaugcucacuugaccuauuuuaacagauguucuacaagagcaaugggggauguaaugagcccaggguuacagauccugccaggagcucaugccaggucucugguggagguagccucgucugcuguucugggcucuguguccccugagaccuguucuggucuccgguccucccuguccauucugcauugcacuuggcgaagggcugaccugcaggguagacaggucggcaggagaacgaccuccacgcuggguuccauccuuccccugcuacuucaccuucccccuagggcuuggaagagcugaggacuuaggaaaugggcccugaggccagggagcagcuuaagagugcagguagcugacacuaagguuuggcgaauugccaggagcggucagccucuugcaggcagcugagggaacauugacaaggucaccagggaugaaccagggcucgggcccuuaccuuacaguugugcccaucagcaaaggcugcgguuggccccuucgguggacaagguucagacccuccgagggcguaaccaagguguagauguugauguagaaauuguugcugcaugcgcauucccugcuuaaguggcugaguacuguguguucaaaaucugcccauucccauccgggacauaauuugggccgugggguaaccucccaggaguguaaaaggcucugggacaggaccacagaagauccagggggcugugcuuggugaccuagaaugcccuggaggagaccuggguucuuacugguaagagcaguggguacucugaugagagggaauuuggggguccuuuucuuuaccaaaggagauauauuggggcccuuuucaagcacguucaggucaggaggacacaggugcuccauugaauguuugcaccagucugaaauucuaguucccaagggccucacuugagucaagaccuuuggaguaugaggggcaggagccagggacuggaccccgcuguggaagcaggaaggccucagaggggaguauuuggagguucucucacucaguuuuucuagagaaaggaugauucauaaaggugagggucgagucuagagacccuaguuugggugaggggacaguuggguugagggagguguguggaggguaugggccagcauaucuggcuggucuuaauuuugaacccuaccugcauuucauugcugucaguauuuccuuccaaguuggucagaggagugaggggagaaguaggggagggaggauggcagagcuuggggauuuuuagcucauaccuucucuccaucccaccucuccucugccccaaacagucccuuccaaggaauguccugcagccauggcuggggagccagggccaccccuucuucccaaguccccagcuggguuacugugggacucugggugcccuggguccccuuucacucaagucagacucaugguacaaaaccugaggaugaggacaguaacacccacguguuuggauggggcauccucacuggacaacaucaggacugugcuugaggcaaugauagucauuugccaauugguagggcauuugucaaugacucugucagcuggcaagaugugugaauggggaauuuccaguaaggcagugauuugucagcugugggauaauuuauaacuagaaagcccugggcaaauagcaauuaggaaucaguauaggaaaauguuuuaaaguauuggcuggagaaauuauucagagguuacgguugauaaugcagguucagugaccauugcugcuguugcagaucaucagugcuaaugccaauguugagaauuacuaccaguacaucagaauuuaaguaaaauauaaaaacccaacauuuggcaucccucauccccacuggucccagggugcucacaccaggucaucagcaacauggguuuguucccaggcacuacacagaaacagugucugcugggugguaacucuuuauuucauuguccggaagaaagaugggagugggaacaggguggacacugugcaggcuucagcuuccacuccgggcaggauucaggcuaucugggaccgcagggacugccaggugcacagcccuggcucccgaggcaggcaggcaaggugacgggacuggaagcccuuuucagagccuuggaggagcugguccguccacaagcaaugagugccacucugcaguuugcaggggauggauaaacagggaaacaccuggaagggaggagggaaacaucucugagggcuucucccugccucccccguggagcagaacuuccucuccucagcuuucaacacugagccgcuggggagacuugcucucaccccaccuaaguacauaccccaggacagccccucccauugagggaaaugucacuggguccugaaagguaacaguaagccaguaaaucaguguccuggaaugguggcuggggaauaggcccugggggucagucaggcaggucgccuguggaauugucccaaaggacagggaaaaacuggcaguaguaaggggccccacccgguuggcggcuaaggaguuuaagcacaggaauagccaguggggcuucaagauagucacugggcucagaggccaucaggagccaucagggaacaggcuuggacuagccaggaggucaguguaacacccucuggugucuggaauagucagagcugcagagcaacaagcagaugugcugaggaagggucagugggauuagggaacagcacuuuggguucuuggagaacauucuggggaaccaagaaacaaucccgggggcucaggaacggggagugggauuacagaauagucacaagggagaauuagagggaccagggagggacaggugaucacacgguauuggacacagggaaagggagcagccagaauuuguaagggagcagucucgggcuuggggaaauagcaagagagaucagggacagcccuuaggguuggggagcagccacagggacacagaauagccagagggagcaagaaacaagcccacgauuuagggaauggccccgggaaggaucucccguuggaggucaggguccaggcacucacugugcauuccucacagccaacaguguaggucuuggugaagccccggcgcugagcuaagcucaggcuguuccagggagccacaaaacugcagguagugaugugcaagaguccauccugcaguuuuccuaaggagaaaggcggggcggggaccgacaagcagcuugugauuggcugagcugccaagcugccaaaggcccggccuucugauagacugaaauuggggugguccccauuuccagugggaccauucccaucagagccucgcccccucgugguugcuaggccgcgccccagggacugguugguguggcacagggcgcggggacggugccucaccagcaaugagaaacuccucgcugcgguugugggaccuguggaaguauccgcagacacucuccauggcggggguguagacgaaccggaugucagcggcauccccuaaggcuuggaacccuuuauacaucuguugauggaugaggggaagugucucuuuuacugacauaauccucccacuccagguucuucccugaagucauauagcaucccaagaucacagccaacuuucucgcaccaaccaguggccagaaguuucuguuuugaccaggaggaagauguuagaaaaugcugggaaagaggcgggggcaggggauaccuuggucaucuugaucucauaacgcugguauaagguggucugguugacuucugguguccccacgaacuuggcccugaugacugcaggagaggagggaaauaugagucaaauggacugcaugagccaauaaaaauaagaucaucaucaucaucaucaucauaccagcaaagcgcauacauaaauagggguuauuggaugccagacagcacacaaagugauuuacacauuuguucauugauucaucuguauguugagugucucucuuugccgggcacugcuuaagccauuuucauacauugauuuguucauuuacuccucaaauauuugggagugcccacugugugccagacauuguucuggguguuagggacacaacagugaacaaaacacagaaaucccuuuccuuguggaguucacauucuagccaggaggagacaggcuaagaacaaacaaaauaaggauauggaauguuagacauuaaguauaauggggaauuacagaccuggguaaggggcugacaaagauucuuugcuugaccaaacuuuacucaggcuccugaaccuccuccuaggcccaucugugcacuuccuuguaaaauccaguuuuagccgagagccuugcuaagucaguuuagcaagaaccccuauauucuauaucugaucauccucaaucucugaucauccucaauaccugaucauccucaaucucugaucauccucaauaccugaucauccucaaucucugaucauccucaauaccugaucauccucaaucucugaucauccucaaucucugaucauccucaauaccugaucauccuugcuaucugacuggguucuucaucuuccaccaucccccaggugaugucugauuccccuuggccugccuucagcaagaauccuguuacgucgguuuagccagaaucccccuuaccccugauguuucuucuuaguaauuuccacccacagacccucacacugcuccuuagcuacacauucccacuggcccaugcuauauucaguguugagcccaaucucucccaccgacugcaagaucccauugcagugguuccuauacccaucaccaugguccugaauauggucuuccuuacuguguuauaacaaguaucacugaauauuuuucuguuuaacaggagaucaggaguacuaaggggcagggguuaaaauuuuaaacaggauggccagggaaggccauccugagaaggugacguuugaggcagccacccauguggauaccuggggggaaaguguaccaggcagagggagcagccagcaugcagauccuguggugggcuugggcacagaguacucaaggaagugugaggaugccaguguggcuaaagcagaggaagugcaggggcgaguggaaucauucuagagguaagugccauggugagccccacuggacugaaagggaaaccaaggcagagugugugggcugaguggggugaggacucaccgaggucggaauugcagaaggccgucuguggguggggugggacacaggugcaggcccugcugggggcuaucagccacagcaacaacaggaugccagaagccaggggcucaaagggggccaugguggguucuguggggaagggggaugucaggcaggccccggcccagcugaucugcugaccugggcaggucauccaccccaucuugccccggggcagccuaugggggggauuagggggcuggauuugggcuugagggguugguaagcuuagggauuuuaaggggauuggggagcgcagaggaauuuaggguuuagagaguugggagaguuuaaauuauugagggacugagugaguugcgggguuaugggguuguggcacuugggggagaagggggcugaggaaguuugaggaaugaggggauuggggaauucuggagguugaggaguuugggggugaggaauuugggauugggggcuggaggaguuuggagacggcagaguuuagggguuguguauauuaagagauauaagaggcugggggaauuuagggagguugaggaauuuggaggagguuggggguuuagggagcugggggaguuuggagguugaagggguugggggaauuugggggcuuaaggcaauggggauacuugaggaauuugagggcaaaagaaguuugggagcuggggaacuggggauuggggagcugggggaguuuagggagcugcagggguuagcgguggguauuuagggggcgaugagggaaauuucgggaugaaggaauuugcggggggauuuggaaagcauuugugauauuagggggucauggguuugggggaauugggggcggaugucagggguucuagggaguuuggagccucgggguugggaaagcaguuccagccuccgacccucuucccccuagacuagcccaggguccugguacccgcaggccaagcugaguagacaggcaucuggcacgggagugcacgggccugguggccagcacccaagcugcagcccagcuccggucccugcugggccaccccgggcccugcuuaccucuggugucucucugggcgcuggaucugcggcgauggcggcagggccugagcgcuagaggauaaauguccacgcuaggggcggggguggcagcgggugcggaaaccacaggccuccaggcuuccuggaugcauuacucauccacccaccaucagugcagaagccaaggggcgggccgacgaaaggagauacacccuccuccucucccacccgccuccucucccucucccugggccucgcccgggccagccaccucccccaccuccacgucagucacuauuccuuccaagccgccucagcggagagcuuagaggccgcauuucccccggcccaguccccuaaagucuccagaaucuauccaaucacccacaucccccaagcucccuaugacucaaacccaaauuaguucagcccuucaacauuuauugugcaucuacugugugccaagcacacaaaaaucccuuguuuuguaugucugacaugcuggugagggguggcagagaggaaacaaauuaaguagcagcaguggagggagauaaggcaggugaaaggggaggaauacaaaauggggaaacugaggcacggagugguuaagugacuuacccaggaucacagagucaauacauggcagaacugagacuggaacucagguggccaggagccaaagccagggucucaaauaacacaggcaaauagccggcauuuauacagcaccuacuguauaccaggcacucagcauaguuuaucucacucaaagcucacaacaaaucucugagauggguaccgguucuuauucccguuuuacggaugaggaaauauggggcguagaggaacuguagaauuuuccuaagaucacagggcauggccgggauucaaacagaggcuaccuggcaccaggguuguaacucaggaguggcaccguccuagcaagcagggaauggugcgggugaaugaaugagcauugggaaggggguggccaugaaugauggugaaagaagcaagugagugggucaguagaaaacuaauccccaccccauccugcccugcccccuccccauggaccuguaccccugguggggggugggguggggcaauccuugcccaccagcuuucugacaaugcaggaaccuucccugggguucugauuaacauccuuaauucgaggaggauagaucaauaauaauaauuguagugaugauggcagccacuuauugagcacuuucuguguacuaugugcuaaaguguuuguauaaauuaucucauucacucaccauacucccuugcuaauuaaguuugauuaacucagggaugauagcccaauaacaagaacacaacaaaaacuaccagcagcccuuauggagugcuuacugcguauccagcacuauucugggugggaggaaugugagggaugagaaauugccuaauggguacaauguacacuauuugguugauggggacacuaaaagcccagacuucaccacuauguaauauauccaugucacaaaacugcagcuguacccucuaaaucuauuuuuuuuuuuugacaagagucuugcucugucaccuaggcuggagugcaguggcgcgaucucagcucacugcaaccuccgccuccgggguucaagagauucuccugucucagccuccugaguagcugggauuacagccacaccaccaccacccccagcuaauuuuuguaguuuuaguagagacggggguuucaccauauuggucagaucucgaacuccugacuucaggugauccaccugccucgaccucccaaaguguugggauuacaggcgugagccaccacacccggccuucuaaaucuuuuuuuuuuuuuuagacagaguuucgaucuuguuucccaggcuggagugcaauggcaagaucuuggcucacugcaaccuccaccuccuggguucaagcaauucuccugccucagccuccucaguagcugggguuacaggcacacgccaccacgccuggcuaauuuuuguauuuuuaguagagacgggguuucaccauguuggccaggcuggucucaaacuccugaccucgggugauccgcccaccucagccucccaaagugcugcgauuacaugcgugagcuacggcacccagccuaaaucuauuuuuuaagaaagcacuuggccgggcaugguggcucacaccuguaaucccagcacuuugggaggcugaggcaggcagaucgcuugagcucaggaguucaagaccagucugggcaacauggugaaacccugucucuauuuaaaaaaaaaaaaaaaagcacuguucuaaagucuuuuuacagacauuaucucauuuaaucaaucccgauugccucuuuguucauuaauguuaguuaaggaagagauguuaagccaauaauaagaguacccaacacuucuugaggaucgaggcuuacuguaugcccgauaccauguagagcauuuuucccaaaauaacuaacuuauuucucacaauaucccugugaguuagauauagcucauguucucauuauacagaugaggaaacuuagacacaaaagggcugagugaccuacccaggaaugagaaugaagaaauggcucugcugcggggugguggggggagggugggggggcgacaaaaacagggaggaagggaaguaaaccaaaaaaaucuguaggagcugauuaugaaagugggacagugagagugaaugagacggggcugaguaaccuggugccuccgagggagaagugagggcaggggaaguccugccuuggccccucgcugacucugguucugacgccaacucuuugaaaccugagucagcacagaguguugccgacuguuuacaugaggagucguguggauccgguuauugugcaguuuugaaauggagagugggagggguguucauggaggggugugugaccaucuggggagcuggaugggugugggggcccauggggguccaggaggcaugugcaaagcggacaccugacaaugcccacagcauaccaggugcuugggccucauugugcucuuugugcagauggggaaacugaggcucagggagagguuguguccuucauggccuuaggaagaagaaaggccaaaauucagaccuagggcuuuccaggagcucccagagucagaguucaaagcacucugcaugcacacauguaugggcacacacacauauacagagcguuguguucaggcucaaguccagagaaaacaaggacaguuaacgaaaagaggcaccuagaaaccucaggguuguugggggagguauggguguguacgcacagcucucugguguguuguguguccauugcuaagagucgagcaugugccuguguguuuuguguguuacuucugggaguugucuaccagccucggcaaagcggaucuggguugcauauguaacugagugcauuaugcacuucugugugcugugcgcacaccugggugguacuguaugcauccgccucggcaucguuucccuggcccgcugcccagagaugccccaaacccccgucccaacaucgugccucucagcccaccucauaaugacgccagucauuugggaaaugaggaagggggggugugcagagggaggccuuaaggucaaucggucacccugagucugcgggcuuccugugccugucgggaacugggaaccaccaccgccccagcagccccuccgggaaugccaucucucuaccuugucagcgagagggagggccaccagaggggcacugugcagcugugcuguggggguggggguggagggagcggggagccuagggccguccaaccugguuuccucuaccccauccaggagcgggggagacuugagguaucccucucgccugaaugugugacuguauguguguuggggugggagugcccaggaauguuuucugcaaacugaguugugggugucucugguuguguguagccucucuguauuguauauguggcaaggcauguugugugugugucuagauauacuuuuuguaugcccaggaauguggcgugggucucuuacgggucccaguggugaugugaauaccuagaagugcauacaccucuguguguuguguagggccuuauuugcugugcauuugccuagggguguuuuaugugugccuguguguugaguaugugcccgguucuguggagugugccuguggaguugugugucucuugauuggacggguaaucuuuuguguuguguguguuccccugauggugauguggguuugggugaggggagggaaccugggugugugcccaaguauugauugugugccuaaggguguccagugugugcugcccuggagugcuggcugcugacccacgcuaugggcaccuggcuggcugaaugacugugugggugucugugcugcuccagagcucaugugcuuugagccuguguuggcugucagucucaaugucacuggcaucucuggguuuggcgauguacaucugaguuccaagggcucaugccucucaauaguuuaugugugcaggugaggcuuacauacaagguuuggcugagggguucagucacuacaugcucaccaccacuccccaccccccccacccccacacacacgcacuggcacacacuugccucacuaucauccauccacuguaaaaacaaacuuucuuuuuacuggaacagucccccacgcucauaccaugccucugcccgggaaagcaggggcgggacgucuggaacuuguuggugggguggagugagggacagacagacagggcucuggguucaauucugggcccggagguggagacacugugugacccccagcugcugccugccugucucugaccuguguguccugggaagugacucauaaugcaguucccacuggcugggauccccucagugccgccccaccccuggaggucacccuuucugcccugagcaugucuccucugccuuuuccccaccagcucagcaguacaacguaccccgugguugugaagauggggcacgcacacucugggaugggcaaggugagucucuggcugggcugugcauagguagauguguauuugugcaaugcacaccagucauucugugugaucgcgucuccuggggugucguuaucuaucagguuggugcaaaaguaauugcggguuuugccaguucuuaugguaaaaaccacaauuacuuuugcaccaaccuaauagauuuuuguuuucucacauucagcugaccucaucgaccccuuuuuccuccugcauucagccaauuuuguguguccuguuauuuugcuugucuccagcaucgugucuguguguacaugcaugccugugccgaacacacaugauguggugugaucuuuuauguuccaaagucuugggguccugugugcuuuacauccaucugauuuugucucuguguacguagaaaguagacuuguaauuuguguccgaguuucuguaucuuagcauguuguguguacaauugauuuugugucuggaugccuauauuaguauauuguacauacacaguuuuuucacagcuuuagugagagauaguucacacacccuacaacucacccauuuaaaguagacaauccaauacauuuugguaugcucaguguucuacacacccaacuuugugccugugugcucacauacaaaacaggagacccaugaucgugccugcuugagcgccuuggcauguccaccuaauuuuuguguacucgccucaccugugugucauguauacaugcucccccaggcacccccacuccccacagcugcccuauccugaccaggcccugauccuugcccgcacuuccacaggucaagguugacaaccagcaugacuuccaggacaucgcaagugucguggcacugaccaagacguaugccacugccgagcccuucaucgaugccaaauaugacgugcguguccagaagauugggcagaacuacaaggccuacaugugaguggagagaccaaagcccuggaagggguccccugccuugccucaugcagcugaggcaccccugagcuucuguccccuugucccccaggaggacgucagugucagggaacuggaagaccaauacuggcucugcgaugcuggagcaaauugccaugucugacaggugggcagcccgaacucagggugugaggggaagcgggggugggagcacgacagcucaggugagagacugacaggcuuccccacccuuugucuuggcagauacaagcuguggguggacacgugcucagagauuuuugggggacuggacaucugcgcaguggaagcgcuacauggcaaggacggaagggaucacaucauugagguaugagcacccagggguaggugggguagagggaggaacagaugccaggcagcagcagugcaaacugaagcacuccauggcacagagguccucagccaacagcaaugugcuuaguacacuguaaggugccugacgaacuuucgaaggggccaucccuugcaauggcagaacacuagacugaacuugcacgucccuggugacuagcaaaacccuuauuagauuguuuagugcucugcgaaucgagacaucuuggugaauggcgaggcacuuaguaaccuuuaaaguauucugcgaacuggaccgacagcaaagcauuuuggaaaggacaaagcaccuagaaaaccgugaagcagggaucggcaaacauuuucuguaaaggagcagacgguacauauuuuaggcuuuguaggccacguagccucugccguaacuacucaacucugcaaaagcagccauagacgauauguuaaaaaaauaaguguggcuguguuccaauaaaacuuuguuuauggacauugaaauuuaaauuucaugccauuuucgcauguuauaaaaucuuucgauuuuuuucaacuguuacaaaauuuaaagacccauccuuagcucugggucauacagaaccagguggucggccagguugggcccaugggcccuaauuugcugagcccugcucugaagcaccuucuaagcuguaagguaccuuggaacagacaagccuuccucaccgugcacaaucagugccucagacacuggggcucagcggcggccaugcccuuggccaacugaaagcacgguguuacugccgccucaggugcgaggccugccucuccccucacggauccuuuccuucccccaggugguggguuccuccaugccgcucauuggugaccaccaggaugaagacaaacagcucaucguagagcucguggucaacaagauggcucaggcccugccccggcagcgacagcgggaugccuccccuggcaggggcucccauggccaggucaggccccuggcgcugagcuaguggcuugagcuaguguggggaggccggcccugggucaugcugugccaugaagcugauaaucuguaggcucacagcaucaccuuugcacacauguggcugcgauugccaauuguuuaaaacauugauaagcagcugcugcccugacuucccugagcaccucccugccccgccccugggaacaggucccccaccccacaacccagaguacccucagcucagccacaaguggggcaacacccagcgcacagggaaccugugucaucacuggcugaugcuccacuggcugguaacuauuuuuaaccucuccugcuccauuccucugccgcagacuccguccccaggggcccugcccuugggccgccagaccucccagcagcccgcagggcccccggcucagcagcgacccccaccacaggguaagcgagaggcuggcggucgcaguccccucccucagcccgccaucucuuacccgcucacucucacgugugcucuuucucucccucugucccccaggcggcccuccacagccggguccaggcccccagcgccagggacccccauugcagcagcgcccgcccccgcagggccagcagcaccuuucaggccuuggacccccagcuggcagcccccugccccagcgccuuccaagucccaccucagcgccccagcagcccgcgucccaggccgcgccgccgacccagggucaaggccgccaaucccggccaguggcgggaggccccggggcgccuccagcagcccgcccgcccgccucuccgucuccccagcgccaggcgggccccccacaggcuacccgucagacauccgucucuggcccggcuccgccaaaggccucuggggccccaccgggcgggcagcagcgccagggcccgccccagaaacccccaggcccagccggccccacacgccaggccagccaggcgggucccgugccccgcacugggccacccaccacgcagcagccucggcccagcggcccgggccccgcuggacgucccaaaccacagcuggcccagaaacccagccaggacgugccgccacccgccaccgccgcugcagggggaccuccgcacccccagcucaaguaaggggaccccuacagcagccuucgccuugcugcucacaaagcgggccgcugccccaguagagcagcccuagcucccuugcuccucagacccagguccuaugcaggggucccacgaacucucuccagccugagccaagcccuucccccaagcuuucgcuccucccggcccaccagaggcuccgcacccccaccccaggaauuuggugccagaaucccagagaaacugcacucaguucgaauuccuccucaaaggcccugggaaaguuuccuccuccagggccucccaggcaccuggcugacccacccucugcaacuuccugcccagcccagagccuucccugccaaacucgcccccccgccaccaacccaucccuaaaacuccuggcccgaguccuaguccuccuaucaucuggcucuucccacuccauccucauacuuuuccuccuccuucacauccuucuggcccaucucagucuccccgcgaaucaucacccaucugccuuuucugguccauuccaacucccaucccagcucagacguccucccugccccacccagcugcucugccuuaggcugacuugcccaacagccuguccuugguccaagcccuuucuaugcccuccuagacaccucacccuuagauuggaaacuucccugcucaucuuccccuuuguaucaaacuagccaagaauucacagagaagguucugcccaggacucuugccacgaaucccacacuucacccuggauccaaguccucccagccugucccagaucucgccucccuggcccaggacuccacccacuccaccugagugcucccagccuugagaaccuguuaggguccaggcccaugguggcagguggggaggucacaggcacagccccaggaucagaggggcagggcuggggcugggccugggguaacguuguguuucucuccccuuccuccccuuccucuucccccuuccucccacgccuccaccuugucucucucuagcaaaucccagucucugaccaaugccuucaaccuuccagagccagccccgcccaggcccagccuuagccaggacgaggugaaagcugagaccauccgcagccugaggaagucuuucgccagccucuucuccgacugauaccccacucugagaaccccaaaaucccugggcaacccuucucugggcccugaauccauuucucacuuuuggagucuccaaaucccuugagaacccaucucccgguucuccaagauuccaccucucauuccucaagauccccgaguaccuugagaaaccugacuccuccuggcccuaaauccgguucucacauguggaauccccaaguccuuuuagaaccccacucguggucacuucaggaucuacuucuguuuuagaaccuccacauuccugaagaccuccgccccugguuuccccagagggcguuuuccuuccuggaagugcccaaauaccaggcaacccauugcagaaucccuuccuggagcccugaaguuccuggaaaacccuauuuuuggucccaaaucucuccagcacaccuauuucccaucauaauuuuccaaauccucaagaaaccccuacuguugagccccuucccauggaucuuccaucccucugaagauccacaucuucaaaugccacccaacaccuagccccacaaggauuucccuucaccagcuccccucaaccucauucaauaccuugggagccccucccacuuccaggaccccucgguucccccagggacccccuccccaguuuccugccucugacagcugucuuuaaauaugcaaacuccacccaucuucccagaauccuuugcacacggaaggccaguggucuccgcuuccccaccuuugcuguggugucugugucugugacugacguggccuccuuuugugccgugcuuggcauaugugguccucguucaucgugccgccuguggugaugcgugcagugacgcuguuuaugugguccgcaccucccccugaccuucacuccuugccuggacucaccccaccccucagcggcucugaaccccaagagaagagucgggaaacaaaauaaacaagcaaaggcccagca

SEQ ID NO: 192816 - RNA, 7365 nt, Homo sapiens
caaaggcauucaggcucuuuaaugucugaggauggggggaagaagucaauggugaggcuucucugggaaauucugcaggccuuguaguucucuaagccccugaaaaagaggacagaagagauugaacaaagacugggucuggguuacgcccccaggcuugcucugaccucccucccuugacuccaguuuagagggaaagaugguccuucccuucuuucgcucucuuccuucuucaggucaccacccuaaacacagagucugguaguggggugagcugcucucaccucuagcaacauguggauaugggcuuugauauucauggaguccuuggugaggcuguugcugagccuagagaaaagaaacaagaaagggcaaaaugggccccacaugauuaugaugacccuuccuuaucacuucaagaucuacuuauauccuggaugauuuccaccuggcucauuccuauguggaaaugccaagccaccaucugguuuucacugauucaaagauuauuaaaugccuacuguaugccaggcaauuuuaggcacugggagauagcagcaaacacaacaaacaaaacucccggccugauggacuucaaauucuuguaaagaaagacauaacaaaaaaccaauggaauaaaagcuaugugucagaugguucuaacuacaauaacaaaaauuaaaaaugagagacaauaaggaguacaggaguggggggcugcaauuuuaaagagggcucagggauggcuucacggagaagcauuugaguaaagacuuaaagacagugaauuuugaguaguguggcuauauggaggauguguuccacacacaaggggcagcaaacacaaaggcacugaggugggagugugccuggcauguuugaggugcagcaaagaggccacucuggcuggagaagaauaagugaagggggaauguaagaggugaggucagagagguaaugagggagacaaacugugugaagccuacaaggccaugguaaggacccuggcuuugaccuuaagugagaugggagccaagggaagguugcagcagaggaaggagguugaauuacaugaaccagucaguugacuccuuuucucuaagccaguuuggaucagaucucgcccaaaagaauccuaauugauauaaagggucaaggaaggccuuucucaagaaugaagaaugagaaggaaucgaagaaugccuaaugguuaagcaguaggaaggccuuuuccacaaaaaggacaagaggcaacaaagagcuguuugagaagcagugaggucagaguguuagaaauugaguggggagggaaaguggccuaagacaagguccaagagauaggaagagguuagaucacacagggucuuaauauaauaaggaauguggauuuuauugugcugucaauguaggagucaguuugagggguaaaugaaacuaaauacuguuggaaaagcagagagcaauaagauaggauguuaaauuggaaaaaaaaguaguaugaacccauguauauaccaauaucucccacauuuuuauuucuagcccagaacucucuccugaacuugacuaguuuuaaugacaucuucuaaaaauccacuucaguguuuaauaagugccucauacuuaacagguuccagacuaaauuccugaccuuccccuccaaaucuacuccuccccuaacuucuccaucucagauaauggcaacuccaucccuccaguugcucagccaaaaaccugggcuccucucucucacacuucacauccagucagccauucuucuuaaaaucaugacuguuccauugcagguaaugcuucugaucuccaugauaugcuuucuccauagcacugucaacaucugacauacuacaucauucauuuguuuauuguuugucuccccugacuagaaugucagcuguaugagggcagauuuuguuuuuuuuuguuuccugcucuauccccagggaccagaacaguguguggcacagaggaggcacccaacguauguugaaugaauaagugacuacuccauuaaaaggaaccugagguuggcugaguguauguuuagggacaggaaauaaaugaaguauggguguuguugccagagagcaagaauacuuucaagaauauucuggggguaaugcuuaaagaacagaagaaugaaccugaucagcuccuaagggacaauuuuaacaucaaaaaagagaacaaaauuaguuaaugguguaagcuuaccuuaugaaaaccuaugaguucaacacuuuaaaagggagaaaaauacagaguucaccaaaugcuagcuguaacacaaaagggauauguuuauuacugcugauuuauuuuuauuugcuaugugagaagcaaauuacuacugauuuaguauguaaggcagugugaauagucauaugguuaugcuuuuuuuuuuuuuuuugagauggagucucacugugucgcccaggcuggagugcaguggcgugaucucggcucacugcaaccuccacccuccgaguucaagcgauucuccugccucagccuccuaaguagcugggauuacaggcgccugccaccguucccggcuaauuuuuuguauuuuuaguagagacgggguuucacuaucuuggacaggcuggucuugaacuccugaccucgugauccacccaccucggccucccaaagugcugggauuacaggugugagccaccgcgcccggccguuaggcuguuucuucuauaauuacaugucuauucaugagauguggauguguacuccuuucugugucaucaggaaagaauauagagauuucaucccuuccacuucccaaacaaagaaauauacuaagaacaggaagaacugacacuuuugaucacauaaaaugaccagaaaguuaguucaaaguauaucccaaguaaccaaauauuuuuaaaggacagccagcuacauagacucaaaucuucaucucuuagaaaaauuaaacuucuagacaguccuacuaauuacaauaaagcaguaagacucaaccauauuuuucaucacacuaacagaccaggucaguacaucaaaaagaccaggcaagggggcaggcacugacaauuuaaauacuucauuuuggggaaguacguggagucucaaaacauuaaaaucuauuugauaggcucaggaauccugugacauaacaaggaaagccuucuuauacaaacuagacuuuagcugggcgcgguagcucacaccugcaaucccagcacuuagggaggcugaggugggcagaucaucugaggucggaguuugagaccagccuggccaacauggcaaaacccugucucuacuaaaaauacaaaaauuagucgggagugguggugggugccuguagucccagcuacuugggaggcugaggcaggagaaucccuuaagcccaggaggcagagguugcagugagccaagaucgcaccacugcacuccagccugggcgacaagagcaaaauuccgucucaaaaacaaaguggacuuggucuaaaugaccaccaguucagaauuguguugaccaugaaagcaggccguuuaauuaaacuauuugcuaauuggucugaacaccaagaaucagaaaucucagcaggucugagguucuuuuggguccacuagcaccugcuaguccuucccauggcuggaaagguuugaaaagauaaaaauuacugaaacucuaagggaggcaacucuggaaaaaaugaauguagaacagacauaaacacaaaacacaaccaacaaagaaguuuaaaucaaugguacucacacuugugagauguuguuaaucuaaguguauugcucagugcccccaugcucauuccauugaaaccaagcucaccucucuugguaguuucacuagcauaccaggcacacuauuccucuugccaggaaugcucuucgccagauagccccauggcuuugucacucagucaaaugauucaaaugucccuuccucugggaggccuucccuagcuacauuucaaaucccucaucuaugcucccaacugcccuucccugcacaaaaccguaaaucaagcuuguccaaccugcaaccagugggccacaugcgguccaggacggcuuugaaugcagcccaacacaaauucauaaacuuucuuaaaacauuaugugauuuuuuuuugcaacuuuuuuauuuuagcucaucagcuaucauuagcauuaguguauuuuauguauggcccaagacaaaucucccaauguggcccacggaaaccaaaagauuggacacuccugccuuaaacucaacuggagcccacauuuucucuccccaucacccccaacacagaucugcuucaauaaccacuuuaauaugcuuccagcauacccuuucaaauuauuucaacaaacacaaagccggguacagcagugcgccuguagucccaguuacuuggcaggcugaagcaaggggauugcuugagcccaggaguuugaggauguaguaugcuaugaucgcagcuguaaacagucacugcauuccagccugggcaacacagcgagacaccaucucuuaaaaacaaaaacacagagugucuacuauaugcuuguacuacucuagucaccuggguauaagggaauaaaccaaaucucccccuuuguaaaacuuacauucuaauuggaggagacaacaugagaaagaaauuacauaguaaauauuagggggugauaaguguuaguagaaaaaaaguagaaggaggggaaucaagcaugccaggggcuguaauuugaaaguuagguuacagagggccuuguugaggaagugacauuuaagcaagacgagugagugaggagaaaggaagccauguggguacugggggaaagagcagugcaggcagagagaacagcuacagcaauaucccuggggugggaucauucuugggguguugaaagaagcaugugaaggugaguguggcaggaacacagugaaugaauaguaaaauuagcaggaagugaaaucauagguaacuaguuuucuuguuaccaauucuaacaggcugagaccucauggaucuggucauaauuguauuuauguauaacaguauaguccuucuagauuguaagccuucaaggaacucuucugucuuguucacugcugcauucccacugcuaagcacagugccuggcauacagaagaugcccaauaaauguuugcgugaaugaacaauacaaagaucauuuuuugagugcuuauuaugugcuacacaugggcuuugcaaccccauuucuucagccccagcucugaagaggaggggagaugaguccuuaaguaucauuccaggcagccauggguaaagggagaagaguguuggaaauggugguguuuuuacacacuauccucauggaauggacuuacucugugaggagagagcucuuacgaucaaugaacuugagagcuucugccagugucaacuccaggaaaaaaccauaucccagggccacauagaugcgugaaguaucugggcugaggaaagagagguuagaggaaguggggagaaguccuuaucacuguuuagcauaguuuauguuuugcuccccacccuuccccaaauugaggcucugggaaggcagggauuuuguccuauuuuauucacugucacauccccagcaccuagcuuauauccuacugggauauaaaaccucgcauagugccugguacauagaagauacucaaaaaaauauaaguugcaugagggaagggguaagcugaacccugugggcucagaggggcggguagacacucacaccacugugucaacgaagaaguuacagcccaaauccaccugcauauauaacuccgagugcuuagcuuccuguggggccagggaaaaagagguaggggucaguggugaacucuuaggucaggugacaggguugggucuggagucucucuucccauuucccucccuugcccacacauaccaaaaaaaugguacccaaucccauagucuuuaccuggagucgcucaaugacauuucucaguugaagguauuuggccagcugcucauauaccuugucucgaugguccagcaccuuucugaugggacgaaaguacaauggugaccaauaggcagccccauuccuccuaguauaccucauaucaugacccucugagacucucaugucaccauacacugaaaaggcuuuuuagugcauaaguuaauuuucggcucugggucagacugccuggguuuggaucugggcucuauccuuuauagaugugugacuuuggcaaguaaauaaccuguuugggacucaguuuccccauuuauaaaauacagaugacaguauuaccuuguagagucauuaggauuaaaugagcguuuacuacaaagcaucuagaauaaugcuuaucaaaugguaaacucucuauauacauguuaguuauaauuacuauuauuauacucccaauacugaacuccaaucauaaugucccauccucacccuagaaaaauccuccaucccuuuuaggaugcucauaggccuaguucugaacaccuuauuuccugcuuagauuaacaaagauugcaauaauauuucuucauacucauugaaccucuacuauguuucaggcauccaugcuaaauucuugacaaagaugggacacaucaaaaacucaaaaccacugcauggggaagguuccagaaaacuccccauuucacagaagaguaaaguuuauagggcacagaaaggcgagguaggacguauucacaaggaugaagaauggccgagccaggauucgaacccgagaacuguggcuccagaaaacaagccuuaaucuguuaaacaucggaggccgcgcaugcgcugacacgccccugcuaugaacgccacgucccagccaaacugcaccccggaugucguccccacuucucgcuccaaggagcgcggggccggacucugaacgccucgcccgccaauucaaaggguuggcccuaacuuugaacgccccacccaccacguggaauguuccaaacgccccgccccccgcacugucacucaccgcaagucccgcugcagcacgucacugaugaaggucucguagcgcagcacuuucucccccguggccuccaccgcccgccgcuuagggggcgucgccaugaugggcuccuggggaguggggagggggaagaccauguugaccgauccaguuuggccucacacacaguucaucucuacccucucaacgcugggaaucggcuuguccggcucaagcuggagguucagccuuccgccccucccaacucggggacccgaccacccagggacacccaagcgcggccuuuaccucaggccgccagcaauaagaacgguugguaggaaccgcggcuuccg

SEQ ID NO: 192817 - RNA, 27261 nt, Homo sapiens
uccugucccaacaccuuuuaauacaguugaauggauaaaaacauggauacaaacacauggauauagguaucauugaagcagugugacauaaaauaacaucuauauauacaacacuccucugcaaauaacaaauguaaaguaaaagauacccaacaaaucauuuuguuuaucuugcuaucauuucuuaaucuauaacgucucccucccauguauccaugcaaggaagcaguaucagcugcccgacuagaggguagcucccucccuuggguuacuuuuuuuuuuuuuuuuuuuuguagagacagagucucacucugucgcccaggcuggagugcuggaguacaguggugcaaucucagcucacugcaaccuccaccucccgaguucaagcaauucuccugccucugccucccaaguagccgugacuacagggguaugccgccacaccuggcuaauuucuuuuguauuuuaguagagacaggguuucaccauguugcccaggcuggucucaaacuccugagcucaggcaaucugcccgccucugccucccaaacugcuaggauuacaggcgugagccaccguacccggccacccuuggguuacuugagacccuacuuucauuuggaucugagcuguccuacccacucacugcaaucuggcuuuuccuucuuugaguauaaagucgauacgggauggcucgccuacagcuucaguguuugaaguaaagaaagcuuuaugcagauucuggcuuuuaaugggucuccucugacaguagaaagauucaaaccacagccaauuccaagaacccuucuaagaacagagacagagucacuucaaaggaucugacuugcuauaccuaaauauaauucauggugcuuuuccuaugacacaccauaauauuuuguccaaaaaucuugcaacauguuauuaacuuugaagaaagaauaaaagcagccacuuuagagacuggagacacucaagcacucaucuauucauaaaguuucuacacagcugaagaaguuugcaucaaguggacaaaaaauaguacagaaaaccuaaauacagaaaaauucagaaaacuccaucuccuagaaagcagggcaaggcugggcacgguggcucacuccuguaaucccagcacuuugggaggccuagguggguggaucauuugaggucaggaguuggagaccagccuggccaacaugguggaacccgucucuacuaaaaauacaaaaauuagccaggcgugguggcacaugccuguaaucccagcuacucaggaggcugaggcaggagaacugcuugaacccgggaggcggagguugcagugagccgagaucgcaccacugcacuccauccugggcgaaagagcaagacuuuaucucaaaaaaaaaaaaaaaaaaaagaaagcaaguuaaauggacucaguuaaagaccucacugaauguaggagaaucaaugggaaacaacguaaagccuucugcuagggcauaaauaggaauccgucuauguaaucaagaaauuacuuugccuccugaucuaaaugcuugccucuagucuagggcuuagaaaaaggccugguuauuugaacugguugucaaucaagguccccuucauuuucgcuuucuuggcuuccaauucagccuagaaagaaaaaaaaagcauaugucuugauacaugacaugaaauuauuuuccuuccuuauucuaaccaacccaaacacucucccuuaauguucauuuaguguacaaacuagaaucaugguucccaaaucauuauauaccucuaacaucuacuuuccaaccuuucugauguuauagcacauacacaaaaaaugcuauuuguaggcaaaaugggcaaaaagacaaggcuguggccacaggaaaucagcgcagggauuccagcagccccagcgccccccacaggcugagggaaccaauacuguggcauaccaguaugcuauucuuggcagaacaggaagaacaucauucuacaacagugcuacuuaaaguuauauggucuaugaacuauuuguuauugguccacacaaaauauguacaaaaauggauaguaagcauuuagaagcuuuuauagcaauuugacacaauaguaauuuuuaaaaucugauaaaaauugagacaauucauuuuuauuguauuuuauaaauuacaaaucuguucauggaaauuugaaaaaaggaaagcacuggucuuucugccuuugaaagguugagaagcacuguucuaaacgacuauggcaagguaaagcagcucccaggacccaccacuucugucaccaaaaacucacuacagacacaaagagacugguauaccuuuggaugagacaccaacauagugauaucugauuuugaugaaauauuuuaaguaauugucaaaaaaaaauacauaggcaccaucauacacagauccauaugcucuaagaugagcccaugaauagugcagaaaaccaccagugcuuuaagaagcaaugaccagccccaauccugguacuaccaagguagcccuaucaugugccauuacauccugggacaacguccagaaacccugaccuuuaacuccugaucuuggaccacaagaagcagauuaaaauaucauccuggccuggcgugguggcucacgccugaaaucccaguacuuugggagcccgaggcgggcagaucaccugaggucaggaguucgagaccagccuggccaacauggugaaaccccaucucuacuaaaaauacaaaaauuagccaggugugguggcacgugccuguagucccagcuacucaggaggcugaggcaggagaaucccuugaacccgggaggcggagguugcagugagcugagaccacgccacggcacuccagccugggcgacaaagugagauuccagcuccaaaauaaauaaauaaauaaaauaaaaauaaaauacagaaaauaaaauaucauccuaguuagggcuauaacaaguaucaucauuuaaggccuagauccuggggucacuacuacagaguaggguauacugacagucacagaccaggguuauaaaacuggcagccaacuacucuaaaaccucccaacagauuuccuaaaagauuucccugccugcugaaaggucuuucagaccaagacauccaaaugauagggccccagcaccuugcuaccccuugcuacucaccagcucuugcagucgccucuugcucaugccuuugcgcuccagcuguuuuucaaucacuuuggcauucugugcauaugagucagcaacuucccucugaaggaaaaaaggagcauccuuaaaccggaagucucaccaaggaauaacaacaaagacguuaagucauaauguauacuacucaaaucaugaaaucaugacuaaaauggcaggacucuguuccuuuuccauucuccaucuuuucaguaauccaggagcacuuaggguauuuuguuugauugcuuguuuguuuguuuguuuugagacagagacugacucuguugcccaggcuggagugcaguagcacaaucuuggcucacugcaaccuccaccucccggguucaagugauucuucaguagcauuuacguuuuaaccaaaacauauguaaaacagcagaugacaucuugccaucaauaucguuauacugaagaaccauaaagguaauugcuacuacuacugaggacagacucacaaaccacgaguugggcuggaaggaaacugaaaucuuucaguccaguaguuucucaaauuaagagggaugagcacuuugcccucuaaggcaucucuaaaaauagcauggaggaaaaaaucacugaucucauucaacauccaacuccuucguuuucauuuuacagaugucccugagauucaaggaaacaggaacuggcucacugucagaguuucuuuucuuuucuuuuuuuuuuuuuuuuuuuuuuuuuuuuuugagacagagacccgcucuguccccaggcuggagugcacuggcgcaaucucgguucacugaagccuccaccucccggguucaagcgauucucaugccucagccucccgaguagcugggauuacaggcgcgcaccaacacgcccggcuaauuuuuuguauuuuuaguagaaacgggguuucaccauguuggccaggcuggucuugaucuccugaccuuaugauccgcccgucucggucucccaaacugcugggauuacaggcgugagccaccacacccagcccauaguuucuuaucagcagagcagggucuaaaagugaagucucuaauauuuccacuacuccaaggcucccgcucuagaguccccuuuccucguacccuucuccccaaauuccaguuuccuuaagaccagagacacuuacagccucaaucuccucuuccucuucaucaaugguagacacggugacagaacugaacuugcccaugucuuugguccguuuggucaucaucaccuggaguggcaggcaagaagaagucaguccgguucaccaaaacaggauccaugagccgugagugugugcgcacacgccugugugaggggcuguggguauugggggaaacacuaccucuuugggacaggaugaccuauuuaaaagugccaauguuuuuauuuacauauuuuucuaacauuugccaucaaaggcucuuauuuuuuuuuaauuuacuuuauuuuuuugaaauagcaucucacucugcugcccaggcuggaauacaguggcacaaucauagcucacugcaaccucaaacuccugggcucaagugaucuuccugccucaaccucccacguagcuaggauuacaggcauaugcccccacgccuggcuaauuuuacauuuuuguagagacugggucucgcaaaaaaaaaaaaaaaaaaaaaaaaaaaagaaggacagaagguauaaaaaagcauccuuaacgcuuaaugucucaggcuuguauccaacuccuggccucaggcaauccuccugccuuggccucccaaagugcuaggauuacaggcgagagacacuaugcaugguccaucauggguucuuaaaauuuauuuuuaauuacuuuuuuuuuuuugagauggagucucacuauuguugcccagccugaagugcaauggugcaaucuuggcuccguaaccucugccuccuggguucaagcgauucuccugccucagccuccugaguagcugggauuacaggcaugcaccaccaugcccagcuaauuuuguauuuuuaguagagacgggguuucuccauguuugucgggccggucucgaacuccugaccucaggugauccgcccaccucggccucccaaagugcugggauuacaggagugagccacugcacccggccaauuaauuuuuuuuaagagacagggucuuacugucacccaggcuggagugcaguggcacaaucauagcugacuguaaccucaaacuccugggcuaaagugauccucccgccucagucuccugaauagcuagaacuauaggugaauaccaucacacccagccaauuuacuuuuuuuuguagagauagggucucgccgugcugcccaggcuggucucaaacuccuggccucaagugauccucccacuucugccucccaaagugcugggauuacaggcaugagccaccaugcccagcuuggaauauauuuuuuaauuagccuaauucauuguuuuuaauuguucaaaaaaaaauuuguaaaauaacacaugauaucucuccauaaaaagaagaaaauuugaaggaaauuaaugugaguaaaaaccauacaauuucuaaccuuagucaugaggcaacuguaggaaagagagaacacauaacagguguuacaauuacauagcaucuguuuauacacaaaaauggcacccgauuaauaaagaaugcauccauacacaugcuugaggggaugaauaccccauuuuccaugaugugauuacacauugcauaccuguaucaaaauaucucauguaccccauaaauaugugcaucuauauaccccccaaaucguuuuuaacuuuuaaaaaauaaaaauaaaguauaagaauauauccauaaagaaaaaagaaauaaaauaagaaaaagacaaaaaaagaaaaagaaauaaaaagaauacauccauaaagagcaguuucucaucacuauaaucuuauuucaaaacaugagcuaaaucuagagcuauauuaagcagucucuccuucaaugguaauuaccuucuuaggaggcucuuguuucugaguauauauguucguuuucccaaagcccuggccaaacuugacuacugcuccauccacaaugaagguaacaggagcauucuuuggcugggauugguagaagagcggcaguccacaccugcaaugacacagugaauuucugcgaggucucauaauccaaauucccaaaacagcaauuugcaaagugugcuuagacucugggaauauuucuguuuguggcauaaacuaaugacuggcucuucucagugucucccaaaacuaccucuaccugauaagaaucacuuaggccgggcgugguggcucacgccuguaaucucagcacuuugggaggccgaggcagguggaucaccugagaucaggaguucaagaccagccuggccaacauggcaaaaccccaucucuacucaaaauacaaaaauuagccaggcaugguggcaggugccuguaaucccagcuacucgggagguugacacaggagaacugcuugaacccgggagguggagguugcagugaguggagaucaugccacugcacuccagccugggcaacaagagcaagacucugucucaaaaaaaaaaauucauuuuucuggccagcuggucaaagauacaacuuugacuagccucuuuggggaacauauugguauuugugcauaguugaagucugaaggcaguugauaaggauaaagacauaaugggggucggacgagguggcucaggccuguaaucccagcaguuuuggaggcugaggugggcggaugaacucaggucaggaguucgagaccagccugaccaacauguugaaacccugucucuacuaaaauacaaaaauuagccaggcaugguggcaugugccuguaaucccagcuacuagagaggcugaggcaggagaaucgcuuaaacccaggaggcagagguuaaggugaccugagauugcaccacugcacuccagccugggcgacagagcaagacucugucucaaaaaaaaaaaaaaagacauaauggagaguuguauccaaauaauuauuuuccuaacacauuaugccucuacuugccuaugcuuggagaaacccacauuguuaauacuuacuuugcacauuucuuccuguacugucguucaaugccuucaggucugcacagaaaauggaaguuaaaaagauaugaacaaaucucauuauguaucaaccuuacuaucccauuucuucaaacgcuaagaggcccuuucaaaaguuuucauuugggggccgggcacgguggcucacgccuguaaucccagcacucugggaggcugaggcgggcggaucaccugaggucaggaguucgagaccagccucaacauggggaaaccccgucucuacuaaaaauacaaaauuagccgggcgcaguggugcaugccuauaaucucagcuacucgggaggcugaggcaggagaauugcuugaaccugggaggcggagguugcggugagccgagagcgagccauugcacuccagccugggcaacaagagugaaacuccgucucaaaaaaaaaaaaaaaaaaaaguuuucauuucauaggucaacucauugguucaacauuccucccuuccugcaacaaacauuuauggagccccugauacaggucagguaucucccugacaaaggaagaggaagaggaggagcaguguagucauaaucauagguagcaauaguaguuguaguaauaacaacaacaauaauagcggcaaccacuuauaaacccuuuacuaugugccaagagcuauucuaaaguauacauguauuaacucggcugggcacgguggcucacgccugcaauccuagcacuuugggaggcccagguggguggaucauuugagguaaggaguucgagacuauccuggccaacauggggaaacuccgucucuacuaaaaauauaaaaauuagcugggcgugguggcggaugccuguaaucccagcuacucaggaggcugaggcaggagaaucaccugaaccuggaaggcagaggcugcagugagccgaguucacgccacugcacuccagccugggugacggaacgagacuccaucucaaaaaaaaaaaaaaaaaguauacauguauuaacucauuuaauccuuacaacaacucugugagguaugucauauuauuauucccacuuuaugaaugaagaaccuaggcccacagaguauuacauggcuugcccaaagucguggagcuaggaagcagagguugaauuuaagcccaggcagucaagcucaagagcccacacaauaccaccuuagacaccaagucauauacacaaggacucaauuccacccacacggcuguuuaacagaaaccugggacucauccuugauucuucucuuccccucaucucccacacuuacuucaucagcaaauucuauggauuuuuaucuccaagaaaagaccuugaaucugucugcuugucuccacguuccugccacuaucuuagccuacaccaccauuaucaacucccuggacgacuguaacaaacgguccugacuggucucuucacuuccccuccccuuguuucaacuuuguaauaggcaauauaugcauaugguauacauaagaguauaaaacaaaaaauaucuucccuacucauccuccacccacccaguucccuuccccagaggcaaauacuguuucugguuucuucuguucauccuagagauagcugaugcauauauaagcaaagaacucugacugguacauaaagaaaauauuuuuuuccuuuuuuagacaaauguacgcuguucucuacuuuuguucacuuaaaaauauaacuugguuaaauauauauauauauuccauaucaauagauaaagaguuacuucauucuuuacaaggaccgcauuguauuccuuuguauagauaaaccaaaaugucuuuuacguguuggacaaauuccuagaaguguguacauuuuaaauucugguagaugcugccaaauuucucucuauagaaguugaaccaauuuagacucacacuaccaauauacugagaguuccuguuucccuacagucucaccaacacuggaugccguuaaauugcaucacugccauucucacaugugaaaaauggaaucuuuuaauuugaauuucuuuuuuuaggaguaaaguuacacaucuuuucauauauuuaauagucauuugcauuuucuuuguuuugaacuguuaguucauguccuuuguuuauucaguuaccuuuuaauuuuauauuaaggaaacuugcaauaauuaaggggccuuguuuauucucuaguuugucauuugucuuugacuuuuuccaccauguggaaauuuuagguuuuucuguggucaaaccaaucuucuuuucucacauaauaauucauacaauucaauagcaaauaaauaaauaaccugauuuuuuaaaugggcaauggaccugaacagacauuucuccaagacauacaaauggccaacagguauaugaaaagacuaaucaucagggaaaugcaaaucaauaccauaaugagggccggacgugguagcucauaccuguaaugccagcacuuugggaggccgaggcgggcagauuacuugaggccagcaguucaagaccagccuggccaacaugguaaaaccccaucucuacuaaaaauacaaaaauuagcuggguguugugacacaugccuguaaucccagcuacuugggaggcugacacaggagaaucgcuugaaccugggaggcagagguugcagugagccaagauugcgucacugcacuccagccuggacaacagagcaagacccugucucaaacaaacaaacaaacaaacaaaaaaaccauaaugagauauccucucauuccaguuagaauggcuguuaucaaaaagacaaggcuaggugcaguggcucacgccuguaaucccagcacugugggaggccgaggcaggcggaucacgaaggucaggagaucgagaccauccuggccaacauggugaaaccccaucucuacuaagauacaaaaaauuagccaggcaugguggcaugcgccuguagucccagcuacuagggaggaugaggcaggggaaucacuugaacccgggagguagagguugcagugaaccgagauugcaccacugcacuccagccuggugacagaguaagacucugucucaaaaaaaaaaaaaaaaaaaaaaaagacaaaaauuaaauguuagggaggauguggagaaaagggaacccuuauauacugcuagugaaaauguaaauuaguacagccauuauggaacacaguaugggagauuccucagaaaauuauagaacuacccuaugauccagcaaucccacuucuugguauauauccaaaggaaaugaguucaguaucucaaagagauaugugcacucucaugcucauugcagcauuauucacaacagccaagauauggaagcaaccuaaaugucuaucaauggcuaaauggauaaagaaaagguggcacgcacgcacacaugcacacacaacagaacauuauucagccuuaugaaaagaaggaaauccugccauuugugauaauauggauggacuuggaggacauuaugcuaaaugaaauaagccaaacacagaaagacaaauacuacaugaucucacuuguuuguggaauccaaaauagucaaacucauagaagcagagaguagaauggugauugccaggggcugaagguggaggaaaugggagguuguuguccaauggauauaaaguuucuguugcgcaagaugaguaaguuuuggagaucuaauguacagcaucauaacuauaguuaacaauacuguauuguacauucuaaauuuguuaaguauccucacuaccuacacacacaaagaaaaugguaacugugaggugauagauacauuaaugagcuuaauuguggugaucauuucacaguguauauguauaucaaaauaucaagcuguaucccuuaaacauauacaauuuuugucaauuauaccucaauaaagcuaaaaaaauuaacacaucauauugauagaaggaaagagaaaaacauaaucauuucaauagacacauagaaaaagcacuugacaaaagucaaaaccccuucaauauacuaagaauagaagggaacuuccucuaccuaauaaagggcaucucugaaaaacccccaucuguuuacccacgucuuagugcauuuucuguuacuguaacauaauaccacagacuggauaauuuauaaauaaaagagauugauuucucacaguucugaaagcugggaagcauaagagcauggcuccggcauugggcaagggccuucgugcugcaucauaacacggcagaagggcaaguaaguaugagaaagcucgauuuuaaaacaaagccgcuccugcaauaacagaccuacucacaugacagcaacguuaauccaugcauaagagcagagccucauuaauccauucauagggcagacagauuguuuccaacacaugaacuuuuggggaacacauucaaaucauagcaccacauaaacuaacaucauacuuaauagugaaagacugaaagcuuucccccuaaaaucaggaacaagauaaagaugccacucucacuacuucuauucaacaccuagaauaaauuuaacaaaagaagugcaagaaauguccacugaaaacuaaaaaguauuaccaaaagaaauuaaagaagaccuaaauaaauguaaacacauuuugauguucauggauuggaagacuuaauauuguuaagguggcaauauuccucgaaugaauuuccagauucaacacaaucccuuucaaaaucccagcuggcuuuuucacagaaauuuaagcugauccuaaaauuaauaugcaauuggaagaaauccaguagagccaaagcaaucuugaaaaaacaagaacaaaguuggagaacucacacuucccaauuucaaaauugacuaaaaagcuauaguaauaaagacagggugauacugguauaaggacagacauacaggucaauggaauagaacugagagucuaaaauaaacccauacauauaugguuaacugauuuucaacaagggugccaagaccauuaagggggaaaaacucagucuuuuuaacaaaagguccugggaaaacuagauagccacaugcaaaaggaugaauuuagcccccuaccucaugcuauauacaaaaauuaacucaaaaugaaugaaagaccuaaauguaagaaguaaaauuauaaaacucuuggaagaaaacauagcugcaaaucuucauaugcuuggauuaggcaaacauuucuucuuuuauuuuugaaacagauucgggcugugucacccagucuggaguacaguggcacgaucuuggcuggcucacuacaaacuccaccuaccagguucaagcgauucucuccuaccucagccccgagcagcugagacuacaggugugcaccaccacauaugguuaauuuuuguguuuuuaguagacaugggguuucgccauguuggccaggcuaguuucaaacuccuggccucaaaugauucacccaccucggccucccaaagugcuaggauuacaagcaugagccaccacgccuggccauuucuuagauaugaugccuaaagcacaagcaauggaagaaaaaaaucagauauaugggaugauaaaaauuuaaaacuugugugcuucaaagaauaucaucaaaaaagugagaaaacaauucacaggaugaaagaaaauauuugcaaaucauauauaugauaagggacuaguaugcauaacauagaauucuuacaacucaacaacagaaagacaaauacaccaauuuaaaaaugggggccaggugcggcggcucacaccuguaaucccagcacucugggaggccaaggcagguggaucaccugaggucaggagcucaagaccagccugaccaacauggugaaaccccaucucuacuaaauacaaaaaauuagccgggcauggugguacgugccuguaaucccagcuacuugggaggcugaggcaggagaaucgcuugaacccuggagguggagauuguagugaaccgagauugcaacacugcauuccagccugggcaacaagagcaaaacucugucucaaaaaaaaaaaaaaaagaauuucuacuuccucuguuuccccuguccuuccuaagguuccccuccaacuuaacuggccagggcagagaugagggaggaacgaggaagcgggcaggcaggcaguacaacugaggcagaugguuuauuggugaaugccagcuguuugggaaaaacucugucaaccuggguuuuuccucugaucucacaccacaacaacaaccuucaacacagaagaagacuucuguggccaaauguguguggguuuuuccccacacuccaauaaauggaugccagcuagguguccuccaauucaguucugacacugucuacucggacacagcgucagauaccacagguugacggcuugguccccaagaccggccacuaaccagauaccagucgcaaguccaggcuuccaaaacuuuuuuuuuuuuuuuuuuuaagacugagucucacucugugacccagauuggagugcaguggcacaucuuggcucauugcaaccuccgccucccagguucaagcgauucuccugccucagccuccugaggacuacaggugcgcaccaccacgcccagcuaauuuuuuguauuuuuaguaaagaugggguuucacuguguuggucaggauggucucaaucuccagaccucaugauccaccugccucaggcucccaaagugcugggauuauaggcauaagccaccgcaccuggcugcccggcuaauuuuugcaacuuuuuuguagagacaggguuucgccauguuggucaggcuggucuggaaccccuaaccucaagugaucugcccgcuucggccucccaaagugcuaggauuacaggcaugagccgccaugccuagucaggccuccagaacuucugaccaaccagcuucaaguugggguucccacgacccccucuuuggguucgauuacuuugcuagugcagcucacagaacucagggaaauaguuaauguuuaccaguuaacuacagaggauaucacaaaggauacagagaagagaugcacagggugagcuaaggggcaaggggcguggagcuuccaugcccucccuggacacgccacccuucaggaaccuccacauauucagccauccagaagccucccaaacccuguccuccuggguuguuauggaagcuuuguuacagaggcaugauugacaaccauguagaaaugugauuggacaaaaagcacauuaucuaaauccagcaaggccugucuguucagacuuuucuuggccucugugcagcauuccuuucucuagggcagagguguccaaucuuuugcacaaucuugcaaacauacuaaaaccacugaaucauacacuuuaaaauggugacuuuuaugguauguagacuauaacucaauuuaaaagaaacuaaaucucggcugggugugguggcucacaccuguaaucccagcacuuugggaggcugaggugggcagaucaccugaggucaggaguucaagaccagccuggccaacauggugaaacccugucucuacaaaaauuacccagguaugauggcgggugccuguaaucccagcuacucaggaggcugagguggaagaauuacuugaaccugggaggcggagguuacagugaacggagaucgcgccguugcacuccagccuauguaacagagugagacugucucaaaaaaaaaaaaaaaguggaaaacagaaacgaaaucucugaggguaaagcugaggcauucgcauuaaaacaaacaaacaaacaaaaaacuccuccagaugauucuggcacacagcaaagguugagaaucacuuugcuaagguguacaugaaaagcagaauuuauaaggcacacauuauaugcaccuuuagcuauacuggauguugccaaaguacuuuccaaagucauuauaacuauuuguggucuuucugguacuguaggagacuuccaguugcucuuugacaacacauggguauuauuuucccaauugaaggauaaggaaauugggggccuaaaagauuacuugcccaaagucacaaagugguacugcuugggauauaacuauacagacugugcugaccaucaucuuuaauguucugccucuccauuuacaaguauuacuuaugucaaaggugcuccaauucauugacaucacuggaccagggcacuaauaauauuuuugguucuauauacccucucuggucccacugggacuaaauucaaccccauacugaagggagagauucaccauacagagaaugaacuuccccuagaauccugaagucggccaaucccguaaguucaagcuuucaaaacacauagaaauaucaaauaaauggggccgcauauuucucaaugaguuaaucuucaaguaccaaugacaaacuggauuuugucaaguuuauaaaaauguaucuauuucuaacuaugugccaagaagcaggcaagaugucuguccuaaggguuucagaaaaauaaggcaggguuccugcucucaaaaaguucaucuuauugaaauagugagacuuuaauguaaaugagguaagaauuucaagugguaugacuuaaagaagugauuaauaugagcuagauguuugggauaauugaccuugauuuucuuuccuauccugaaucucaaggaauauaugagauagggaagacucugugaccaaaaacaaaacaaaacauucucggccgggcacgguggcucacgccuguaaucccagcacuuugggaggccaaggcggguggaucauuugaggucaggaguucgagaccagccuggccaacacagugaaaccccgucucuacuaaaaauacaaaaauuagccaggcaugguggugcaugccuguaaucccagcuacucgggaagcugaggcaggagaaucacuugaacccaggagguggagguugcagugagccaagauugcgccacugcacuccagccugggcaacagagugagacuucaucucaagaaaaaaaauucuccauucuggcugugguagcuagccucuaagguggcccccaaugauccuugucccugguacuaacacccuuguauagucaccucccacaaugaauagcgcugacuugugacaccaaaaggacaucacagaaacaacugugugugccuucugagucauagccauaaaacacauugcggcuuuugccuugcucuccugaauuacuuacauuaugggaagccagcugccaugucaugaggauacucaagcagccuuauggaaagaucccuguguugagaaacugaggcuucuugccaacaguuagcacucaacugccuaccauaugagacaccuuggaagaugacucuccagcccuaaucaagauuucaggccaggcacgguggcucacaccuguaaucccagcauuuugggaggacaaggcagggggauugcuugagccuaggaguucaagaacagccugggcaacauaggaagacccugucuuuacaaaaaaaaauuaaaaauuagccaggcaugguggcacaugccuauggucccagcuacucaggaggcugaggugggaggaucacuugagcccaggagaucgagacugcagugagcugugauugugccacugcacucuagccugcgugacagagugagacccugccucaaaaaaaaaaaaagacuucagaugacuguuuacauagucaucuucuuaaucgcagcuucaugagagaccagaaucaccuagcuaagcuugcucuugaauuccugacccacagaaaauacauaaaaugauaaauguuuguucuuuaaaaaaaaaaaaaucaagagaguaccagaagaugaagauggacagaucauagagcgcauucaggcuuauauuuuuauccagccaacuaggaguguuuuccuuguacuccacaaugaucccuaaaugaaaucagauggggaggaaggaggaguccuuaauggauugggcuagacuccuccccacucagagcagcuuucugcuuaucagucuuauuuauacuucuggguaagaauuuaauuaaagaaaggauuuuucaucuaaaaauguuucaaaggcauugcuauaagugaugaagggucacuaacagauuugaagcaggugacugacauaauguguauuucagauaauucaagcaguagaggauagacuggaggagagcaaaacuagagaccaaaagaccagguaagaggccacuucaguagucuaaguaagugauuuuggguacugaaauaacggcagugcagcagggcugaacaggaggcagcagccacaaaagagauuagaaggcagaaucgacaguacauggugagugacuagauguaugcaggggaugauggugggaugguggggacagaugagacaaagagagacugacuccuagauuucuggcuggggccacugcaugaauccuggugucaucauaagaagaaggaaaagaaggacuagcauuuggcuaauaguaauagagaccugacugcaauggcuucaacaaaagagcuuguucucucauguaacaucaggaggaaggcaguucugagcacugguugagacccaaggauagcagggcaaaggcucugcaauucuuguggccucuccuucccaguuccaggcuggcugcuaguguuccaauuaucauguccauuucccaagaagcaggauggaauaaggauaaaggguaaaaaaggcuugaagucacccaucagcugacaucuacuuccaucucuuuugcuuggccaaagcuaagucauauucagaaucuuaguuguuggggggaaggggacuggaauaugcacccuaacuuuacagacacucguguauaggaggguguagcagaagagugucagaguacgccuguaaucccagcacuuugggaggccgaagugggcggaucacgaggucaggagaucgagaccgucccggcuaacacagugaaaccccgucucuacuaaaaacacaaaaaauuagccgggcgugguugcaggcaccuguagucccagcuacucaggaggcugaggcaggagaauggccugaacccgggaggcggagcuugcagugagcugagaucacgccacugcacuccagccugggugacagagcgagacuccgucucaaaaaaaaaaaaaaaaagagugucagaguggugcugagcgaaucgaucugugguacuguccacaguagagaaaugauaaguuuggccuucaucauguuggaucugaaaaguaggacaucaggugaagagguagaguaggcaacuggcuauacaguucugggacacaggaaggcacaguaggcagauuuagauuuuaucaucagcauaaaaguguaacuaaugccauguaaggugacaagaaugcccaaggaaggcauaaagagaguggggacaaaagcaaggucagaaccgcauggaauaccaauacuugaggggcaggcagaagaaaaagaauccaaaggauugagaaggccaaagaaggagaaggaggcucacaagagcagcuucacguguugaaacccugucucuacuaaaaauacaaaaauuagccaggcauaguggugcacaaccguaaucccagcuacaugggaggcugaggcaggaggaucacuugaacccaggaggcagagguugcagugagcugagaucgcaucacugcacuccagcuugggugacagagcgagacucuaucucaaaaaaaaaaaaaaaaaagaaaagaaagaaagaaaacauguagcuagaugucagccuauaguuuuuuucugguucaacacuaaaguuucauaagggcaggauucuuugcuguuuacugguuguacuggguuagauagugacccuuaaaaauucacauucuggccgggcacaguggcucaugccugugaucccagcacuuugggaggccgaggugggaggaucacuugaguccaagaguuugagaccagccuggccaacauggugaaaccccaucucuacuaaaaacacaaaaacuagccaggcaugguagcacacaccaucucaaaaaaaaaaaaaaaaagaaaaaagaaaaaagaaaaaaaaauccacauccauccaggaaccucagaaugugaccuuauuuggaaauagugauguugcagacauaauuaguuaaguuaaaaugaugucauacuggaggaggaugggcccuuaauccaauaugauuggugcccuuauaagaaaagaacaggcaaagggagaaugccaugugaugauacaagcacugacuggagugaugcauuuacaauacaagccaaggaaugccaaggauugcugguaaacgccaaaaaccaggaaugaggcaaggaaggauucuccccuacaaucuugagagagagcauggacuuaccaauaccuugauuucagacuucuagccuccacaacuauuaaacaacuucucuuguuuuaggccacccaauuuguaguacuuuauuuuuuuuuuauuuuuugagacagugucucacucugucgcccaggcuggaguacaguggcacaaucucagcucacugcaaccucugccuccccauacaagcaauucuccuaucccagccucccgaguagcugggauuacaggcacacgcgccaccaugcccaacuaauuuuuguauuuuuaguagagaugggguuucacuacguuggccagccuggucucgaacuccuggucucaagugauccacccaccucagccucucaaaguguugggauuacaggcgugagccaccacacccaggcuguaguacuuuacuauggcagcucuagaaaacuaauacacuggcggccgggcacgauggcucacgucuguaaucccagcacuuugggaggccaaggcagacagaccacgaggucaggagaucgaggccauccuggcuaacacggugaaaccccgucucuacuaaaaauacaaaaaaaaauuagccgggcaugguggcaggcgccuguagucccagcuacucgggaggcugaggcaggagaacggcgugaaccugggaggcagagcuugcagugagccgagaucgcgccacuguacuccagccugggugacagagcgagacuccgucuccaaaaaaaagaaaacuaauacacugguauauauuccagacuucuaggauaguaccuggaacauaguaggagcucgguaaaugaaauauuuguugcaugaauggauggauuuuuuaauucccuaggauugaccuuuccaugacuucuagcaccugcugcugaccguccccuagccacacccccacacacuucuugauacucucuccuauuuucugcaucaccagguucuucugguucuguuccaauucuuuugucugccuuuuaaauauucaguccuaucugcuugcuccacacucuguaauuuuaucccuucccagguuucaauuucccauauauaccaaacucccaaaucuaaaacagagcuaaccacaucacaccccugcuuaaaaaacagagauaggccgggcgcaguggcucaccccucuaaucccagcacuuugggaggcagaggcagguggaucgccugaggccagaaguucgagaccagccuggccaacauagugaaaucccaucucuacuaaaaauacaaaaaauuagccaggcgugguggcaggugccugaaaucccagcuacucaggacgcugaggcaggagaaucgcuugaaccugggaggcggagguugcagugagccaagaucacaccauugcacuccagccugggcaacaagagcgaaacuccgucaaaaaaaaaaaaacggagauggcucuucauugccuacagauuaaggccaaacuuguccacuucagcacuuuacucuguccucacccuaguaugcaugaugccguuccuguaaaguaaccugugcuccagucacaaacgacaauucagguuucuaaagcacaccauguuugaugcuuuuaaugcuuccauauuccuuccaccuggaaugcucuucauucccuucaucuacuuggugaaauccuaguucaggcuaaacacaaaugccaucaucuuuugaagccuuuccuggccaccauucaggacaaaugacccacucccaccuguuuuuccuuucguucagaagaccaguauuuuuuccuaucacaauaggagucauucccucaaagucaugagcucuuuaaugguaaaaaucauaccuuauucaucuucacagauccaguaccuagcucagugccuggcacacgguaugcuccacaagauuacagguugaaugaacucauucaaaccuguaaauuguaaacaaacuacggcuaucaaauggcaauggaggggccgggcacaguggcuuaugccuguaaucccagcacuuugggaggccaaggagggagaaucacuugaggccaggaguucaagaccagccuggccgacauggugaaacugcgucucuacuaaaaauacaaaaauuagcugggcgugguggcgcacgccugucaucccagcuacuggggaggcugaggcaagagaguugcuugaaucugggagguggagguugcgguaagccgaggucacaccacugcacuccagccugagcaacagagugagugagacuccaucucaauuaaaaaaaaaaagcaauggaaucacaugugagcaccauuucaacaaagcacaauaaagauauuacuacauuaacagaaguuagaaaaccaccacaaaugucaaaguauugggaccaacugaccuguucaacaauagaugugauauuuauauuauucagaaacagacuccaacacaauagggaaauccuaaacagggagcaucaaccucuuaccuccgcagauacauagucuccucaucuucuguguuacaaaacuuaugggcauguuuggcagcaucaaucacacgggaccggucccggggccucaugggcaauuucucuaacuggcagucugaaggaauggagagauuuggucacuagagucauggcaaaauauagcaaaugagucacugcaaaauauccugagaaguuuugagugggaucccuagcacuagaauuuucuacuacaauuacuaugcuuauugaaaccuauuauugaauguuccaacuaaaaaugacuugcuaucaggagaccuugguauuuggacccagcucucuuacuacccuggugaucuuuggcaaaucacuuccuccuuuggagacuuuugccucauuugaaagaugaguuagaugauauuaucucaaaaguccuucccaauacugcaauucagguuucuguaaguauuucugugaucauaguacacuugguuuguguuauaaugcauuagaaucaggagacacaaucaagcauacuggaaugccuacaaggaagcacugggaaaaguggguaugugcuaagaaaaggagagaggcugggcgugguggcaugcaccuauagucccagcuacucagaagaaugaggcagggcgauugcuugagaccaggagugcaaugcuguaguguuccaugauugugccugugaauagccacuguacuccugccugggcaacacagcaagacccugucucuguuuuacaaaaaaaaaaaaaaaagaggccaggcgagguggcucaugccuguaaucccagcacuuugggaggucaagacgagcagaucaccugaggucaguaguucaagaccagccuggcccagcuacuugggaggcugaggcgagagaauugcuugaacccaggagguggagguugcagugagccaauauugugccacugcacuucagccugggcaacagagcgagacuccgucaaaaaacaaaaaaaaaggaagagagagggugauuauauaguaugcaaaugauccauccuaguuggaggaauuuuaaucugaaaacaaugaaaacacaguaaacaaauuagguacaguuguaaagcagauugaaaauugauauaaugggccaggugcgguggcucacgcuuguaauccagcacuuugggaggcugagguggcagguggaucaccugaggucagaaguucgagaccagccuggccaacauauagcgaaaccgucucuacuaaaacauacaaacauuagcagggcgugguggcacacaccuguagucccagcuaguugggaagcugaggcaggagaaucgcuugaacccaggaggcagaggguugcagugagcugggaucacaccacugcacuccugccugagcaacagaggaaaacuccgucucucaaaagaaaaaaaaaagaaaaaaaaagaaaauuuauauaaugcaaauuaagcaccuaaaggaucacagagaaagucaaguggucagaguaauucaagaugaauagaggaggugaagagaggaguuagagaacacuaggcaguuuacaugucagcucauuuacucuucacaaugaaugguuaaaguaaagauuuguuguuccuauuuuaaagaugaaggaacugagguuaaaaaggguaagagauauaccaugcaucuaauaagaagcagaacaagaauucagacccaacucuaagugauucaaaagcacaugcuguuuccaccacaccuccuuaccaagaauuaauuucuucgauaaauacgugagggcccucuagguagcaggcacuguucuaacacugugcuaaagauucagcaaacaacaaagcagauaaagucuccgcccuggccgggcacgguggcucacgccuguaaucccagcacuuugggaagccaagacagguggaucaccugaggucaggaguucgagaccagccuggccaacauggugaaaccccgucucuccuaaaaauacaaaaauuaaccgggugcgguugcucacgucuguaaucccagcacuuugggaggccgaggcuggcggaucaccugaggucgggaguuugagaccggccugaccaacauggagaaacccugucucuacuaaaaaaauacaaaauuagcugagcaugguggugcaugccuguaaucccagcuacucgggaggcugaggcaggagaaucgcuugaacccaggagacggagggugcagugagccgagauggugccacugcacuccagccugggcaacaagagcgaaacuccgucucaaaaaaaaaaaaaaaaauuagccagacaugguggcaggugccuguaaucccagcuacucaagagaaucacuugaaccugggaggcagagguugcagugaggugagaucgcaccauugcacuccagccugggcuacaagagcuagacacuguuucaaaaaaaaaaaaaaaaaguuccggcccugaugaagcuuacauucuaguggaagaggcaacauauuuuaaaauaauuauaauaugauuuuggguaaugauaagugcuaaauauuaagcaggguaagaggacaaagugacagggaugcuguuuuagauaagguaaucagggaaggguucucuaaggaaauuacauuuuagcagagaccugaaugaaguaagggagggauugagggaaaaguuuuuggggcagaagaaauaccaauuaaaaaggcacuggggggcaggaacacuuuugacaugauggagaaaaagcaaaaaggccacuguggcugaagugcgaugagcaagaggaagacuguuagggaaugaagccugagagguagccacaggccugaucaagggucuugguauggauggacuuugguuuuauucucaguguuauaugaaaccauugguuuugaacaggacucuggcuacuauguggaaaagaguggaagcaacgagagcaagagacuauugugccaauccaggugaaagaugguaguagcuuggacuacaguguuagaaguggaggugguaggccggccgugguggcucaugccuguaaucccagcacuuugggaggccuagguggguggaucacuugaggucaggaguucaagaccagucuggccaacauggugaaaccccaucucuacuaaaaauacaaaauuagccgggcgugguggcacaugccuguaaucccagcuacuagggagguugaggcaggagaaucgcuugaaccugggagguggaaguugcagugagccgagaucgcaccacugcacuccagccugggcaagaagagcgaaacuccaucucaaaaaaaaaaagaaaaaaaaaaaaacuagccgggccugguggcgcacacuacuugggaggcugaggcaggagaaucgcuugaaccugggaggcggaaguugcagugagcugagaccgcgccacagcacuccagccugggugacagagugagacucccucugucucaaaaagaaaaaggaauggaggugguaagaagcagucagauccugcauacauuuucacgaaagcaccugcaggauuuccugauggacuggacagauguaagguacgugacagacagaagucaagacugauuccagguuuuggucugagauacuggaugaauaguuguacuacugacugcaauagggaugacuauaagaggagcaauuggagaggggguguagagggucaugaacucaauuuucagcacgauauauuugagaggcccauuagacauucaaguggagauguugaauaggcaauuggagucucaggagaggugcagguuaaagaugaacaucugggaguuaccagcaugucaguuguauuuaaagcuugggaaugaaugagaucaccuaggggguggguacagagugagaacaggugagaguacugagcuauagggccuuggaaugccuaaaagucugagagagaaaagggagccagacaaggggaaaaaucuaaggcugggcgcgguggcucacgccuguaaucccagcaccuugggaggccgaggcggguggaucacgaggucaggaguucgagaccagccuggccaacguagugaaacccccgucucuacuaaaaacacaaaaauuagccgggcaugguggcgggcgccuguaaucccagcuacucgggaggcugaggcaggagaaucacuugaauccgggaggcagagcuugcagugagccgagauugcaccacugcacuccagccugggcagcagagugagacuccaucugaaaaaaaaggggggggggaaauacgagguaggaggaaaaucaagugaguauggagucuuggaagcaaauaaaaaacauguugcaaaaggaaugaaaugauuaccucugucaaaugccacugacagaauuaaaaugaacauugauaacugaccacuagaacuguuaacauggagccaaauacgguuaagaugaugaggugggaaggaaagccuaccugaagugaggucaggagagaauuagaagucaggaugcagagacagccaauauaggcaacucuuuugagaagcuuugcuauaaaagaagcaacgaaaugggguuauagcuggaggggaauacaggaucgagggaggguuuuauuuucguuugcugugagguaagagcaacugcagcaucuugguauccagcagaaaaguuauaaagcuucuagaggcaguaguuuuugaagacaguggauuaagagggaaauacaauauguuuguguuucuauuuuuguucuccugaaggaguuuaguuuugaggaaggucuggauacagagucacaaggcuaaacaaaaagcaggaaaaaaaaaaaugcccuggaguggggcggggaugcguagggaggauuuagucggagagagaaaacccaccaaucuucguugagaaguggcucccagaucacagccagaggaaauucgccuucaagaacccgaagucuggcuccuugcagacgcccccgcaguucccggcuacucacccagcacuaggaccaucuggccgcacaaacaguaguaaacauggaggggcuucucgccgucgucauauuccucccggucccgagugucagagcagacuacugaccgagacacuacuuucggcaugauucccaagagcaaucugaaaacucuacgccaagaagagggucgccccgaaau

SEQ ID NO: 192818 - RNA, 27261 nt, Homo sapiens
auuucggggcgacccucuucuuggcguagaguuuucagauugcucuugggaaucaugccgaaaguagugucucggucaguagucugcucugacacucgggaccgggaggaauaugacgacggcgagaagccccuccauguuuacuacuguuugugcggccagaugguccuagugcugggugaguagccgggaacugcgggggcgucugcaaggagccagacuucggguucuugaaggcgaauuuccucuggcugugaucugggagccacuucucaacgaagauugguggguuuucucucuccgacuaaauccucccuacgcauccccgccccacuccagggcauuuuuuuuuuuccugcuuuuuguuuagccuugugacucuguauccagaccuuccucaaaacuaaacuccuucaggagaacaaaaauagaaacacaaacauauuguauuucccucuuaauccacugucuucaaaaacuacugccucuagaagcuuuauaacuuuucugcuggauaccaagaugcugcaguugcucuuaccucacagcaaacgaaaauaaaacccucccucgauccuguauuccccuccagcuauaaccccauuucguugcuucuuuuauagcaaagcuucucaaaagaguugccuauauuggcugucucugcauccugacuucuaauucucuccugaccucacuucagguaggcuuuccuucccaccucaucaucuuaaccguauuuggcuccauguuaacaguucuaguggucaguuaucaauguucauuuuaauucugucaguggcauuugacagagguaaucauuucauuccuuuugcaacauguuuuuuauuugcuuccaagacuccauacucacuugauuuuccuccuaccucguauuuccccccccccuuuuuuuucagauggagucucacucugcugcccaggcuggagugcaguggugcaaucucggcucacugcaagcucugccucccggauucaagugauucuccugccucagccucccgaguagcugggauuacaggcgcccgccaccaugcccggcuaauuuuuguguuuuuaguagagacggggguuucacuacguuggccaggcuggucucgaacuccugaccucgugauccacccgccucggccucccaaggugcugggauuacaggcgugagccaccgcgcccagccuuagauuuuuccccuugucuggcucccuuuucucucucagacuuuuaggcauuccaaggcccuauagcucaguacucucaccuguucucacucuguacccacccccuaggugaucucauucauucccaagcuuuaaauacaacugacaugcugguaacucccagauguucaucuuuaaccugcaccucuccugagacuccaauugccuauucaacaucuccacuugaaugucuaaugggccucucaaauauaucgugcugaaaauugaguucaugacccucuacacccccucuccaauugcuccucuuauagucaucccuauugcagucaguaguacaacuauucauccaguaucucagaccaaaaccuggaaucagucuugacuucugucugucacguaccuuacaucuguccaguccaucaggaaauccugcaggugcuuucgugaaaauguaugcaggaucugacugcuucuuaccaccuccauuccuuuuucuuuuugagacagagggagucucacucugucacccaggcuggagugcuguggcgcggucucagcucacugcaacuuccgccucccagguucaagcgauucuccugccucagccucccaaguagugugcgccaccaggcccggcuaguuuuuuuuuuuuucuuuuuuuuuuugagauggaguuucgcucuucuugcccaggcuggagugcaguggugcgaucucggcucacugcaacuuccaccucccagguucaagcgauucuccugccucaaccucccuaguagcugggauuacaggcaugugccaccacgcccggcuaauuuuguauuuuuaguagagaugggguuucaccauguuggccagacuggucuugaacuccugaccucaagugauccacccaccuaggccucccaaagugcugggauuacaggcaugagccaccacggccggccuaccaccuccacuucuaacacuguaguccaagcuacuaccaucuuucaccuggauuggcacaauagucucuugcucucguugcuuccacucuuuuccacauaguagccagaguccuguucaaaaccaaugguuucauauaacacugagaauaaaaccaaaguccauccauaccaagacccuugaucaggccuguggcuaccucucaggcuucauucccuaacagucuuccucuugcucaucgcacuucagccacaguggccuuuuugcuuuuucuccaucaugucaaaaguguuccugccccccagugccuuuuuaauugguauuucuucugccccaaaaacuuuucccucaaucccucccuuacuucauucaggucucugcuaaaauguaauuuccuuagagaacccuucccugauuaccuuaucuaaaacagcaucccugucacuuuguccucuuacccugcuuaauauuuagcacuuaucauuacccaaaaucauauuauaauuauuuuaaaauauguugccucuuccacuagaauguaagcuucaucagggccggaacuuuuuuuuuuuuuuuuugaaacagugucuagcucuuguagcccaggcuggagugcaauggugcgaucucaccucacugcaaccucugccucccagguucaagugauucucuugaguagcugggauuacaggcaccugccaccaugucuggcuaauuuuuuuuuuuuuuuuugagacggaguuucgcucuuguugcccaggcuggagugcaguggcaccaucucggcucacugcacccuccgucuccuggguucaagcgauucuccugccucagccucccgaguagcugggauuacaggcaugcaccaccaugcucagcuaauuuuguauuuuuuuaguagagacaggguuucuccauguuggucaggccggucucaaacucccgaccucaggugauccgccagccucggccucccaaagugcugggauuacagacgugagcaaccgcacccgguuaauuuuuguauuuuuaggagagacgggguuucaccauguuggccaggcuggucucgaacuccugaccucaggugauccaccugucuuggcuucccaaagugcugggauuacaggcgugagccaccgugcccggccagggcggagacuuuaucugcuuuguuguuugcugaaucuuuagcacaguguuagaacagugccugcuaccuagagggcccucacguauuuaucgaagaaauuaauucuugguaaggaggugugguggaaacagcaugugcuuuugaaucacuuagaguugggucugaauucuuguucugcuucuuauuagaugcaugguauaucucuuacccuuuuuaaccucaguuccuucaucuuuaaaauaggaacaacaaaucuuuacuuuaaccauucauugugaagaguaaaugagcugacauguaaacugccuaguguucucuaacuccucucuucaccuccucuauucaucuugaauuacucugaccacuugacuuucucugugauccuuuaggugcuuaauuugcauuauauaaauuuucuuuuuuuuucuuuuuuuuuucuuuugagagacggaguuuuccucuguugcucaggcaggagugcaguggugugaucccagcucacugcaacccucugccuccuggguucaagcgauucuccugccucagcuucccaacuagcugggacuacaggugugugccaccacgcccugcuaauguuuguauguuuuaguagagacgguuucgcuauauguuggccaggcuggucucgaacuucugaccucaggugauccaccugccaccucagccucccaaagugcuggauuacaagcgugagccaccgcaccuggcccauuauaucaauuuucaaucugcuuuacaacuguaccuaauuuguuuacuguguuuucauuguuuucagauuaaaauuccuccaacuaggauggaucauuugcauacuauauaaucacccucucucuuccuuuuuuuuuguuuuuugacggagucucgcucuguugcccaggcugaagugcaguggcacaauauuggcucacugcaaccuccaccuccuggguucaagcaauucucucgccucagccucccaaguagcugggccaggcuggucuugaacuacugaccucaggugaucugcucgucuugaccucccaaagugcugggauuacaggcaugagccaccucgccuggccucuuuuuuuuuuuuuuuuguaaaacagagacagggucuugcuguguugcccaggcaggaguacaguggcuauucacaggcacaaucauggaacacuacagcauugcacuccuggucucaagcaaucgcccugccucauucuucugaguagcugggacuauaggugcaugccaccacgcccagccucucuccuuuucuuagcacauacccacuuuucccagugcuuccuuguaggcauuccaguaugcuugauugugucuccugauucuaaugcauuauaacacaaaccaaguguacuaugaucacagaaauacuuacagaaaccugaauugcaguauugggaaggacuuuugagauaauaucaucuaacucaucuuucaaaugaggcaaaagucuccaaaggaggaagugauuugccaaagaucaccaggguaguaagagagcuggguccaaauaccaaggucuccugauagcaagucauuuuuaguuggaacauucaauaauagguuucaauaagcauaguaauuguaguagaaaauucuagugcuagggaucccacucaaaacuucucaggauauuuugcagugacucauuugcuauauuuugccaugacucuagugaccaaaucucuccauuccuucagacugccaguuagagaaauugcccaugaggccccgggaccggucccgugugauugaugcugccaaacaugcccauaaguuuuguaacacagaagaugaggagacuauguaucugcggagguaagagguugaugcucccuguuuaggauuucccuauuguguuggagucuguuucugaauaauauaaauaucacaucuauuguugaacaggucaguuggucccaauacuuugacauuuguggugguuuucuaacuucuguuaauguaguaauaucuuuauugugcuuuguugaaauggugcucacaugugauuccauugcuuuuuuuuuuuaauugagauggagucucacucacucuguugcucaggcuggagugcaguggugugaccucggcuuaccgcaaccuccaccucccagauucaagcaacucucuugccucagccuccccaguagcugggaugacaggcgugcgccaccacgcccagcuaauuuuuguauuuuuaguagagacgcaguuucaccaugucggccaggcuggucuugaacuccuggccucaagugauucucccuccuuggccucccaaagugcugggauuacaggcauaagccacugugcccggccccuccauugccauuugauagccguaguuuguuuacaauuuacagguuugaaugaguucauucaaccuguaaucuuguggagcauaccgugugccaggcacugagcuagguacuggaucugugaagaugaauaagguaugauuuuuaccauuaaagagcucaugacuuugagggaaugacuccuauugugauaggaaaaaauacuggucuucugaacgaaaggaaaaacaggugggagugggucauuuguccugaaugguggccaggaaaggcuucaaaagaugauggcauuuguguuuagccugaacuaggauuucaccaaguagaugaagggaaugaagagcauuccagguggaaggaauauggaagcauuaaaagcaucaaacauggugugcuuuagaaaccugaauugucguuugugacuggagcacagguuacuuuacaggaacggcaucaugcauacuagggugaggacagaguaaagugcugaaguggacaaguuuggccuuaaucuguaggcaaugaagagccaucuccguuuuuuuuuuuuugacggaguuucgcucuuguugcccaggcuggagugcaauggugugaucuuggcucacugcaaccuccgccucccagguucaagcgauucuccugccucagcguccugaguagcugggauuucaggcaccugccaccacgccuggcuaauuuuuuguauuuuuaguagagaugggauuucacuauguuggccaggcuggucucgaacuucuggccucaggcgauccaccugccucugccucccaaagugcugggauuagaggggugagccacugcgcccggccuaucucuguuuuuuaagcaggggugugaugugguuagcucuguuuuagauuugggaguuugguauauaugggaaauugaaaccugggaagggauaaaauuacagaguguggagcaagcagauaggacugaauauuuaaaaggcagacaaaagaauuggaacagaaccagaagaaccuggugaugcagaaaauaggagagaguaucaagaaguguguggggguguggcuaggggacggucagcagcaggugcuagaagucauggaaaggucaauccuagggaauuaaaaaauccauccauucaugcaacaaauauuucauuuaccgagcuccuacuauguuccagguacuauccuagaagucuggaauauauaccaguguauuaguuuucuuuuuuuuggagacggagucucgcucugucacccaggcuggaguacaguggcgcgaucucggcucacugcaagcucugccucccagguucacgccguucuccugccucagccucccgaguagcugggacuacaggcgccugccaccaugcccggcuaauuuuuuuuuguauuuuuaguagagacgggguuucaccguguuagccaggauggccucgaucuccugaccucguggucugucugccuuggccucccaaagugcugggauuacagacgugagccaucgugcccggccgccaguguauuaguuuucuagagcugccauaguaaaguacuacagccugggugugguggcucacgccuguaaucccaacacuuugagaggcugagguggguggaucacuugagaccaggaguucgagaccaggcuggccaacguagugaaaccccaucucuacuaaaaauacaaaaauuaguugggcaugguggcgcgugugccuguaaucccagcuacucgggaggcugggauaggagaauugcuuguauggggaggcagagguugcagugagcugagauugugccacuguacuccagccugggcgacagagugagacacugucucaaaaaauaaaaaaaaaauaaaguacuacaaauuggguggccuaaaacaagagaaguuguuuaauaguuguggaggcuagaagucugaaaucaagguauugguaaguccaugcucucucucaagauuguaggggagaauccuuccuugccucauuccugguuuuuggcguuuaccagcaauccuuggcauuccuuggcuuguauuguaaaugcaucacuccagucagugcuuguaucaucacauggcauucucccuuugccuguucuuuucuuauaagggcaccaaucauauuggauuaagggcccauccuccuccaguaugacaucauuuuaacuuaacuaauuaugucugcaacaucacuauuuccaaauaaggucacauucugagguuccuggauggauguggauuuuuuuuucuuuuuucuuuuuucuuuuuuuuuuuuuuuuugagauggugugugcuaccaugccuggcuaguuuuuguguuuuuaguagagaugggguuucaccauguuggccaggcuggucucaaacucuuggacucaagugauccucccaccucggccucccaaagugcugggaucacaggcaugagccacugugcccggccagaaugugaauuuuuaagggucacuaucuaacccaguacaaccaguaaacagcaaagaauccugcccuuaugaaacuuuaguguugaaccagaaaaaaacuauaggcugacaucuagcuacauguuuucuuucuuucuuuucuuuuuuuuuuuuuuuuuugagauagagucucgcucugucacccaagcuggagugcagugaugcgaucucagcucacugcaaccucugccuccuggguucaagugauccuccugccucagccucccauguagcugggauuacgguugugcaccacuaugccuggcuaauuuuuguauuuuuaguagagacaggguuucaacacgugaagcugcucuugugagccuccuucuccuucuuuggccuucucaauccuuuggauucuuuuucuucugccugccccucaaguauugguauuccaugcgguucugaccuugcuuuuguccccacucucuuuaugccuuccuugggcauucuugucaccuuacauggcauuaguuacacuuuuaugcugaugauaaaaucuaaaucugccuacugugccuuccugugucccagaacuguauagccaguugccuacucuaccucuucaccugauguccuacuuuucagauccaacaugaugaaggccaaacuuaucauuucucuacuguggacaguaccacagaucgauucgcucagcaccacucugacacucuuuuuuuuuuuuuuuuugagacggagucucgcucugucacccaggcuggagugcaguggcgugaucucagcucacugcaagcuccgccucccggguucaggccauucuccugccucagccuccugaguagcugggacuacaggugccugcaaccacgcccggcuaauuuuuuguguuuuuaguagagacgggguuucacuguguuagccgggacggucucgaucuccugaccucgugauccgcccacuucggccucccaaagugcugggauuacaggcguacucugacacucuucugcuacacccuccuauacacgagugucuguaaaguuagggugcauauuccaguccccuuccccccaacaacuaagauucugaauaugacuuagcuuuggccaagcaaaagagauggaaguagaugucagcugaugggugacuucaagccuuuuuuacccuuuauccuuauuccauccugcuucuugggaaauggacaugauaauuggaacacuagcagccagccuggaacugggaaggagaggccacaagaauugcagagccuuugcccugcuauccuugggucucaaccagugcucagaacugccuuccuccugauguuacaugagagaacaagcucuuuuguugaagccauugcagucaggucucuauuacuauuagccaaaugcuaguccuucuuuuccuucuucuuaugaugacaccaggauucaugcaguggccccagccagaaaucuaggagucagucucucuuugucucaucuguccccaccaucccaccaucauccccugcauacaucuagucacucaccauguacugucgauucugccuucuaaucucuuuuguggcugcugccuccuguucagcccugcugcacugccguuauuucaguacccaaaaucacuuacuuagacuacugaaguggccucuuaccuggucuuuuggucucuaguuuugcucuccuccagucuauccucuacugcuugaauuaucugaaauacacauuaugucagucaccugcuucaaaucuguuagugacccuucaucacuuauagcaaugccuuugaaacauuuuuagaugaaaaauccuuucuuuaauuaaauucuuacccagaaguauaaauaagacugauaagcagaaagcugcucugaguggggaggagucuagcccaauccauuaaggacuccuccuuccuccccaucugauuucauuuagggaucauuguggaguacaaggaaaacacuccuaguuggcuggauaaaaauauaagccugaaugcgcucuaugaucuguccaucuucaucuucugguacucucuugauuuuuuuuuuuuuaaagaacaaacauuuaucauuuuauguauuuucugugggucaggaauucaagagcaagcuuagcuaggugauucuggucucucaugaagcugcgauuaagaagaugacuauguaaacagucaucugaagucuuuuuuuuuuuuugaggcagggucucacucugucacgcaggcuagagugcaguggcacaaucacagcucacugcagucucgaucuccugggcucaagugauccucccaccucagccuccugaguagcugggaccauaggcaugugccaccaugccuggcuaauuuuuaauuuuuuuuuguaaagacagggucuuccuauguugcccaggcuguucuugaacuccuaggcucaagcaaucccccugccuuguccucccaaaaugcugggauuacaggugugagccaccgugccuggccugaaaucuugauuagggcuggagagucaucuuccaaggugucucauaugguaggcaguugagugcuaacuguuggcaagaagccucaguuucucaacacagggaucuuuccauaaggcugcuugaguauccucaugacauggcagcuggcuucccauaauguaaguaauucaggagagcaaggcaaaagccgcaauguguuuuauggcuaugacucagaaggcacacacaguuguuucugugauguccuuuuggugucacaagucagcgcuauucauugugggaggugacuauacaaggguguuaguaccagggacaaggaucauugggggccaccuuagaggcuagcuaccacagccagaauggagaauuuuuuuucuugagaugaagucucacucuguugcccaggcuggagugcaguggcgcaaucuuggcucacugcaaccuccaccuccuggguucaagugauucuccugccucagcuucccgaguagcugggauuacaggcaugcaccaccaugccuggcuaauuuuuguauuuuuaguagagacgggguuucacuguguuggccaggcuggucucgaacuccugaccucaaaugauccacccgccuuggccucccaaagugcugggauuacaggcgugagccaccgugcccggccgagaauguuuuguuuuguuuuuggucacagagucuucccuaucucauauauuccuugagauucaggauaggaaagaaaaucaaggucaauuaucccaaacaucuagcucauauuaaucacuucuuuaagucauaccacuugaaauucuuaccucauuuacauuaaagucucacuauuucaauaagaugaacuuuuugagagcaggaacccugccuuauuuuucugaaacccuuaggacagacaucuugccugcuucuuggcacauaguuagaaauagauacauuuuuauaaacuugacaaaauccaguuugucauugguacuugaagauuaacucauugagaaauaugcggccccauuuauuugauauuucuauguguuuugaaagcuugaacuuacgggauuggccgacuucaggauucuaggggaaguucauucucuguauggugaaucucucccuucaguaugggguugaauuuagucccagugggaccagagaggguauauagaaccaaaaauauuauuagugcccugguccagugaugucaaugaauuggagcaccuuugacauaaguaauacuuguaaauggagaggcagaacauuaaagaugauggucagcacagucuguauaguuauaucccaagcaguaccacuuugugacuuugggcaaguaaucuuuuaggcccccaauuuccuuauccuucaauugggaaaauaauacccauguguugucaaagagcaacuggaagucuccuacaguaccagaaagaccacaaauaguuauaaugacuuuggaaaguacuuuggcaacauccaguauagcuaaaggugcauauaaugugugccuuauaaauucugcuuuucauguacaccuuagcaaagugauucucaaccuuugcugugugccagaaucaucuggaggaguuuuuuguuuguuuguuuguuuuaaugcgaaugccucagcuuuacccucagagauuucguuucuguuuuccacuuuuuuuuuuuuuuugagacagucucacucuguuacauaggcuggagugcaacggcgcgaucuccguucacuguaaccuccgccucccagguucaaguaauucuuccaccucagccuccugaguagcugggauuacaggcacccgccaucauaccuggguaauuuuuguagagacaggguuucaccauguuggccaggcuggucuugaacuccugaccucaggugaucugcccaccucagccucccaaagugcugggauuacaggugugagccaccacacccagccgagauuuaguuucuuuuaaauugaguuauagucuacauaccauaaaagucaccauuuuaaaguguaugauucagugguuuuaguauguuugcaagauugugcaaaagauuggacaccucugcccuagagaaaggaaugcugcacagaggccaagaaaagucugaacagacaggccuugcuggauuuagauaaugugcuuuuuguccaaucacauuucuacaugguugucaaucaugccucuguaacaaagcuuccauaacaacccaggaggacaggguuugggaggcuucuggauggcugaauauguggagguuccugaaggguggcguguccagggagggcauggaagcuccacgccccuugccccuuagcucacccugugcaucucuucucuguauccuuugugauauccucuguaguuaacugguaaacauuaacuauuucccugaguucugugagcugcacuagcaaaguaaucgaacccaaagagggggucgugggaaccccaacuugaagcugguuggucagaaguucuggaggccugacuaggcauggcggcucaugccuguaauccuagcacuuugggaggccgaagcgggcagaucacuugagguuagggguuccagaccagccugaccaacauggcgaaacccugucucuacaaaaaaguugcaaaaauuagccgggcagccaggugcgguggcuuaugccuauaaucccagcacuuugggagccugaggcagguggaucaugaggucuggagauugagaccauccugaccaacacagugaaaccccaucuuuacuaaaaauacaaaaaauuagcugggcgugguggugcgcaccuguaguccucaggaggcugaggcaggagaaucgcuugaaccugggaggcggagguugcaaugagccaagaugugccacugcacuccaaucugggucacagagugagacucagucuuaaaaaaaaaaaaaaaaaaaguuuuggaagccuggacuugcgacugguaucugguuaguggccggucuuggggaccaagccgucaaccugugguaucugacgcuguguccgaguagacagugucagaacugaauuggaggacaccuagcuggcauccauuuauuggaguguggggaaaaacccacacacauuuggccacagaagucuucuucuguguugaagguuguuguuguggugugagaucagaggaaaaacccagguugacagaguuuuucccaaacagcuggcauucaccaauaaaccaucugccucaguuguacugccugccugcccgcuuccucguuccucccucaucucugcccuggccaguuaaguuggaggggaaccuuaggaaggacaggggaaacagaggaaguagaaauucuuuuuuuuuuuuuuuugagacagaguuuugcucuuguugcccaggcuggaaugcaguguugcaaucucgguucacuacaaucuccaccuccaggguucaagcgauucuccugccucagccucccaaguagcugggauuacaggcacguaccaccaugcccggcuaauuuuuuguauuuaguagagaugggguuucaccauguuggucaggcuggucuugagcuccugaccucaggugauccaccugccuuggccucccagagugcugggauuacaggugugagccgccgcaccuggcccccauuuuuaaauugguguauuugucuuucuguuguugaguuguaagaauucuauguuaugcauacuagucccuuaucauauauaugauuugcaaauauuuucuuucauccugugaauuguuuucucacuuuuuugaugauauucuuugaagcacacaaguuuuaaauuuuuaucaucccauauaucugauuuuuuucuuccauugcuugugcuuuaggcaucauaucuaagaaauggccaggcgugguggcucaugcuuguaauccuagcacuuugggaggccgaggugggugaaucauuugaggccaggaguuugaaacuagccuggccaacauggcgaaaccccaugucuacuaaaaacacaaaaauuaaccauaugugguggugcacaccuguagucucagcugcucggggcugagguaggagagaaucgcuugaaccugguagguggaguuuguagugagccagccaagaucgugccacuguacuccagacugggugacacagcccgaaucuguuucaaaaauaaaagaagaaauguuugccuaauccaagcauaugaagauuugcagcuauguuuucuuccaagaguuuuauaauuuuacuucuuacauuuaggucuuucauucauuuugaguuaauuuuuguauauagcaugagguagggggcuaaauucauccuuuugcauguggcuaucuaguuuucccaggaccuuuuguuaaaaagacugaguuuuucccccuuaauggucuuggcacccuuguugaaaaucaguuaaccauauauguauggguuuauuuuagacucucaguucuauuccauugaccuguaugucuguccuuauaccaguaucacccugucuuuauuacuauagcuuuuuagucaauuuugaaauugggaagugugaguucuccaacuuuguucuuguuuuuucaagauugcuuuggcucuacuggauuucuuccaauugcauauuaauuuuaggaucagcuuaaauuucugugaaaaagccagcugggauuuugaaagggauuguguugaaucuggaaauucauucgaggaauauugccaccuuaacaauauuaagucuuccaauccaugaacaucaaaauguguuuacauuuauuuaggucuucuuuaauuucuuuugguaauacuuuuuaguuuucaguggacauuucuugcacuucuuuuguuaaauuuauucuagguguugaauagaaguagugagaguggcaucuuuaucuuguuccugauuuuagggggaaagcuuucagucuuucacuauuaaguaugauguuaguuuauguggugcuaugauuugaauguguuccccaaaaguucauguguuggaaacaaucugucugcccuaugaauggauuaaugaggcucugcucuuaugcauggauuaacguugcugucaugugaguaggucuguuauugcaggagcggcuuuguuuuaaaaucgagcuuucucauacuuacuugcccuucugccguguuaugaugcagcacgaaggcccuugcccaaugccggagccaugcucuuaugcuucccagcuuucagaacugugagaaaucaaucucuuuuauuuauaaauuauccagucugugguauuauguuacaguaacagaaaaugcacuaagacguggguaaacagauggggguuuuucagagaugcccuuuauuagguagaggaaguucccuucuauucuuaguauauugaagggguuuugacuuuugucaagugcuuuuucuaugugucuauugaaaugauuauguuuuucucuuuccuucuaucaauaugauguguuaauuuuuuuagcuuuauugagguauaauugacaaaaauuguauauguuuaagggauacagcuugauauuuugauauacauauacacugugaaaugaucaccacaauuaagcucauuaauguaucuaucaccucacaguuaccauuuucuuuguguguguagguagugaggauacuuaacaaauuuagaauguacaauacaguauuguuaacuauaguuaugaugcuguacauuagaucuccaaaacuuacucaucuugcgcaacagaaacuuuauauccauuggacaacaaccucccauuuccuccaccuucagccccuggcaaucaccauucuacucucugcuucuaugaguuugacuauuuuggauuccacaaacaagugagaucauguaguauuugucuuucuguguuuggcuuauuucauuuagcauaauguccuccaaguccauccauauuaucacaaauggcaggauuuccuucuuuucauaaggcugaauaauguucuguugugugugcaugugugcgugcgugccaccuuuucuuuauccauuuagccauugauagacauuuagguugcuuccauaucuuggcuguugugaauaaugcugcaaugagcaugagagugcacauaucucuuugagauacugaacucauuuccuuuggauauauaccaagaagugggauugcuggaucauaggguaguucuauaauuuucugaggaaucucccauacuguguuccauaauggcuguacuaauuuacauuuucacuagcaguauauaaggguucccuuuucuccacauccucccuaacauuuaauuuuugucuuuuuuuuuuuuuuuuuuuuuuuugagacagagucuuacucugucaccaggcuggagugcaguggugcaaucucgguucacugcaaccucuaccucccggguucaagugauuccccugccucauccucccuaguagcugggacuacaggcgcaugccaccaugccuggcuaauuuuuuguaucuuaguagagaugggguuucaccauguuggccaggauggucucgaucuccugaccuucgugauccgccugccucggccucccacagugcugggauuacaggcgugagccacugcaccuagccuugucuuuuugauaacagccauucuaacuggaaugagaggauaucucauuaugguuuuuuuguuuguuuguuuguuuguuugagacagggucuugcucuguuguccaggcuggagugcagugacgcaaucuuggcucacugcaaccucugccucccagguucaagcgauucuccugugucagccucccaaguagcugggauuacaggcaugugucacaacacccagcuaauuuuuguauuuuuaguagagaugggguuuuaccauguuggccaggcuggucuugaacugcuggccucaaguaaucugcccgccucggccucccaaagugcuggcauuacagguaugagcuaccacguccggcccucauuaugguauugauuugcauuucccugaugauuagucuuuucauauaccuguuggccauuuguaugucuuggagaaaugucuguucagguccauugcccauuuaaaaaaucagguuauuuauuuauuugcuauugaauuguaugaauuauuaugugagaaaagaagauugguuugaccacagaaaaaccuaaaauuuccacaugguggaaaaagucaaagacaaaugacaaacuagagaauaaacaaggccccuuaauuauugcaaguuuccuuaauauaaaauuaaaagguaacugaauaaacaaaggacaugaacuaacaguucaaaacaaagaaaaugcaaaugacuauuaaauauaugaaaagauguguaacuuuacuccuaaaaaaagaaauucaaauuaaaagauuccauuuuucacaugugagaauggcagugaugcaauuuaacggcauccaguguuggugagacuguagggaaacaggaacucucaguauauugguagugugagucuaaauugguucaacuucuauagagagaaauuuggcagcaucuaccagaauuuaaaauguacacacuucuaggaauuuguccaacacguaaaagacauuuugguuuaucuauacaaaggaauacaaugcgguccuuguaaagaaugaaguaacucuuuaucuauugauauggaauauauauauauauuuaaccaaguuauauuuuuaagugaacaaaaguagagaacagcguacauuugucuaaaaaaggaaaaaaauauuuucuuuauguaccagucagaguucuuugcuuauauaugcaucagcuaucucuaggaugaacagaagaaaccagaaacaguauuugccucuggggaagggaacuggguggguggaggaugaguagggaagauauuuuuuguuuuauacucuuauguauaccauaugcauauauugccuauuacaaaguugaaacaaggggaggggaagugaagagaccagucaggaccguuuguuacagucguccagggaguugauaauggugguguaggcuaagauaguggcaggaacguggagacaagcagacagauucaaggucuuuucuuggagauaaaaauccauagaauuugcugaugaaguaagugugggagaugaggggaagagaagaaucaaggaugagucccagguuucuguuaaacagccguguggguggaauugaguccuuguguauaugacuuggugucuaaggugguauugugugggcucuugagcuugacugccugggcuuaaauucaaccucugcuuccuagcuccacgacuuugggcaagccauguaauacucugugggccuagguucuucauucauaaagugggaauaauaauaugacauaccucacagaguuguuguaaggauuaaaugaguuaauacauguauacuuuuuuuuuuuuuuuuugagauggagucucguuccgucacccaggcuggagugcaguggcgugaacucggcucacugcagccucugccuuccagguucaggugauucuccugccucagccuccugaguagcugggauuacaggcauccgccaccacgcccagcuaauuuuuauauuuuuaguagagacggaguuuccccauguuggccaggauagucucgaacuccuuaccucaaaugauccacccaccugggccucccaaagugcuaggauugcaggcgugagccaccgugcccagccgaguuaauacauguauacuuuagaauagcucuuggcacauaguaaaggguuuauaagugguugccgcuauuauuguuguuguuauuacuacaacuacuauugcuaccuaugauuaugacuacacugcuccuccucuuccucuuccuuugucagggagauaccugaccuguaucaggggcuccauaaauguuuguugcaggaagggaggaauguugaaccaaugaguugaccuaugaaaugaaaacuuuuuuuuuuuuuuuuuuuugagacggaguuucacucuuguugcccaggcuggagugcaauggcucgcucucggcucaccgcaaccuccgccucccagguucaagcaauucuccugccucagccucccgaguagcugagauuauaggcaugcaccacugcgcccggcuaauuuuguauuuuuaguagagacgggguuuccccauguugaggcuggucucgaacuccugaccucaggugauccgcccgccucagccucccagagugcugggauuacaggcgugagccaccgugcccggcccccaaaugaaaacuuuugaaagggccucuuagcguuugaagaaaugggauaguaagguugauacauaaugagauuuguucauaucuuuuuaacuuccauuuucugugcagaccugaaggcauugaacgacaguacaggaagaaaugugcaaaguaaguauuaacaauguggguuucuccaagcauaggcaaguagaggcauaauguguuaggaaaauaauuauuuggauacaacucuccauuaugucuuuuuuuuuuuuuuugagacagagucuugcucugucgcccaggcuggagugcaguggugcaaucucaggucaccuuaaccucugccuccuggguuuaagcgauucuccugccucagccucucuaguagcugggauuacaggcacaugccaccaugccuggcuaauuuuuguauuuuaguagagacaggguuucaacauguuggucaggcuggucucgaacuccugaccugaguucauccgcccaccucagccuccaaaacugcugggauuacaggccugagccaccucguccgacccccauuaugucuuuauccuuaucaacugccuucagacuucaacuaugcacaaauaccaauauguuccccaaagaggcuagucaaaguuguaucuuugaccagcuggccagaaaaaugaauuuuuuuuuuugagacagagucuugcucuuguugcccaggcuggagugcaguggcaugaucuccacucacugcaaccuccaccucccggguucaagcaguucuccugugucaaccucccgaguagcugggauuacaggcaccugccaccaugccuggcuaauuuuuguauuuugaguagagaugggguuuugccauguuggccaggcuggucuugaacuccugaucucaggugauccaccugccucggccucccaaagugcugagauuacaggcgugagccaccacgcccggccuaagugauucuuaucagguagagguaguuuugggagacacugagaagagccagucauuaguuuaugccacaaacagaaauauucccagagucuaagcacacuuugcaaauugcuguuuugggaauuuggauuaugagaccucgcagaaauucacugugucauugcagguguggacugccgcucuucuaccaaucccagccaaagaaugcuccuguuaccuucauuguggauggagcaguagucaaguuuggccagggcuuugggaaaacgaacauauauacucagaaacaagagccuccuaagaagguaauuaccauugaaggagagacugcuuaauauagcucuagauuuagcucauguuuugaaauaagauuauagugaugagaaacugcucuuuauggauguauucuuuuuauuucuuuuucuuuuuuugucuuuuucuuauuuuauuucuuuuuucuuuauggauauauucuuauacuuuauuuuuauuuuuuaaaaguuaaaaacgauuugggggguauauagaugcacauauuuaugggguacaugagauauuuugauacagguaugcaauguguaaucacaucauggaaaaugggguauucauccccucaagcauguguauggaugcauucuuuauuaaucgggugccauuuuuguguauaaacagaugcuauguaauuguaacaccuguuauguguucucucuuuccuacaguugccucaugacuaagguuagaaauuguaugguuuuuacucacauuaauuuccuucaaauuuucuucuuuuuauggagagauaucauguguuauuuuacaaauuuuuuuuugaacaauuaaaaacaaugaauuaggcuaauuaaaaaauauauuccaagcugggcaugguggcucaugccuguaaucccagcacuuugggaggcagaagugggaggaucacuugaggccaggaguuugagaccagccugggcagcacggcgagacccuaucucuacaaaaaaaaguaaauuggcugggugugaugguauucaccuauaguucuagcuauucaggagacugaggcgggaggaucacuuuagcccaggaguuugagguuacagucagcuaugauugugccacugcacuccagccugggugacaguaagacccugucucuuaaaaaaaauuaauuggccgggugcaguggcucacuccuguaaucccagcacuuugggaggccgaggugggcggaucaccugaggucaggaguucgagaccggcccgacaaacauggagaaaccccgucucuacuaaaaauacaaaauuagcugggcaugguggugcaugccuguaaucccagcuacucaggaggcugaggcaggagaaucgcuugaacccaggaggcagagguuacggagccaagauugcaccauugcacuucaggcugggcaacaauagugagacuccaucucaaaaaaaaaaaaguaauuaaaaauaaauuuuaagaacccaugauggaccaugcauagugucucucgccuguaauccuagcacuuugggaggccaaggcaggaggauugccugaggccaggaguuggauacaagccugagacauuaagcguuaaggaugcuuuuuuauaccuucuguccuucuuuuuuuuuuuuuuuuuuuuuuuuuuuugcgagacccagucucuacaaaaauguaaaauuagccaggcgugggggcauaugccuguaauccuagcuacgugggagguugaggcaggaagaucacuugagcccaggaguuugagguugcagugagcuaugauugugccacuguauuccagccugggcagcagagugagaugcuauuucaaaaaaauaaaguaaauuaaaaaaaaauaagagccuuugauggcaaauguuagaaaaauauguaaauaaaaacauuggcacuuuuaaauaggucauccugucccaaagagguaguguuucccccaauacccacagccccucacacaggcgugugcgcacacacucacggcucauggauccuguuuuggugaaccggacugacuucuucuugccugccacuccaggugaugaugaccaaacggaccaaagacaugggcaaguucaguucugucaccgugucuaccauugaugaagaggaagaggagauugaggcuguaagugucucuggucuuaaggaaacuggaauuuggggagaaggguacgaggaaaggggacucuagagcgggagccuuggaguaguggaaauauuagagacuucacuuuuagacccugcucugcugauaagaaacuaugggcugggugugguggcucacgccuguaaucccagcaguuugggagaccgagacgggcggaucauaaggucaggagaucaagaccagccuggccaacauggugaaaccccguuucuacuaaaaauacaaaaaauuagccgggcguguuggugcgcgccuguaaucccagcuacucgggaggcugaggcaugagaaucgcuugaacccgggagguggaggcuucagugaaccgagauugcgccagugcacuccagccuggggacagagcgggucucugucucaaaaaaaaaaaaaaaaaaaaaaaaaaaaaagaaaagaaaagaaacucugacagugagccaguuccuguuuccuugaaucucagggacaucuguaaaaugaaaacgaaggaguuggauguugaaugagaucagugauuuuuuccuccaugcuauuuuuagagaugccuuagagggcaaagugcucaucccucuuaauuugagaaacuacuggacugaaagauuucaguuuccuuccagcccaacucgugguuugugagucuguccucaguaguaguagcaauuaccuuuaugguucuucaguauaacgauauugauggcaagaugucaucugcuguuuuacauauguuuugguuaaaacguaaaugcuacugaagaaucacuugaacccgggagguggagguugcagugagccaagauugugcuacugcacuccagccugggcaacagagucagucucugucucaaaacaaacaaacaaacaagcaaucaaacaaaauacccuaagugcuccuggauuacugaaaagauggagaauggaaaaggaacagaguccugccauuuuagucaugauuucaugauuugaguaguauacauuaugacuuaacgucuuuguuguuauuccuuggugagacuuccgguuuaaggaugcuccuuuuuuccuucagagggaaguugcugacucauaugcacagaaugccaaagugauugaaaaacagcuggagcgcaaaggcaugagcaagaggcgacugcaagagcuggugaguagcaagggguagcaaggugcuggggcccuaucauuuggaugucuuggucugaaagaccuuucagcaggcagggaaaucuuuuaggaaaucuguugggagguuuuagaguaguuggcugccaguuuuauaacccuggucugugacugucaguauacccuacucuguaguagugaccccaggaucuaggccuuaaaugaugauacuuguuauagcccuaacuaggaugauauuuuauuuucuguauuuuauuuuuauuuuauuuauuuauuuauuuuggagcuggaaucucacuuugucgcccaggcuggagugccguggcguggucucagcucacugcaaccuccgccucccggguucaagggauucuccugccucagccuccugaguagcugggacuacaggcacgugccaccacaccuggcuaauuuuuguauuuuuaguagagaugggguuucaccauguuggccaggcuggucucgaacuccugaccucaggugaucugcccgccucgggcucccaaaguacugggauuucaggcgugagccaccacgccaggccaggaugauauuuuaaucugcuucuugugguccaagaucaggaguuaaaggucaggguuucuggacguugucccaggauguaauggcacaugauagggcuaccuugguaguaccaggauuggggcuggucauugcuucuuaaagcacuggugguuuucugcacuauucaugggcucaucuuagagcauauggaucuguguaugauggugccuauguauuuuuuuuugacaauuacuuaaaauauuucaucaaaaucagauaucacuauguuggugucucauccaaagguauaccagucucuuugugucuguagugaguuuuuggugacagaagugguggguccugggagcugcuuuaccuugccauagucguuuagaacagugcuucucaaccuuucaaaggcagaaagaccagugcuuuccuuuuuucaaauuuccaugaacagauuuguaauuuauaaaauacaauaaaaaugaauugucucaauuuuuaucagauuuuaaaaauuacuauugugucaaauugcuauaaaagcuucuaaaugcuuacuauccauuuuuguacauauuuuguguggaccaauaacaaauaguucauagaccauauaacuuuaaguagcacuguuguagaaugauguucuuccuguucugccaagaauagcauacugguaugccacaguauugguucccucagccuguggggggcgcuggggcugcuggaaucccugcgcugauuuccuguggccacagccuugucuuuuugcccauuuugccuacaaauagcauuuuuuguguaugugcuauaacaucagaaagguuggaaaguagauguuagagguauauaaugauuugggaaccaugauucuaguuuguacacuaaaugaacauuaagggagaguguuuggguugguuagaauaaggaaggaaaauaauuucaugucauguaucaagacauaugcuuuuuuuuucuuucuaggcugaauuggaagccaagaaagcgaaaaugaaggggaccuugauugacaaccaguucaaauaaccaggccuuuuucuaagcccuagacuagaggcaagcauuuagaucaggaggcaaaguaauuucuugauuacauagacggauuccuauuuaugcccuagcagaaggcuuuacguuguuucccauugauucuccuacauucagugaggucuuuaacugaguccauuuaacuugcuuucuuuuuuuuuuuuuuuuuuuugagauaaagucuugcucuuucgcccaggauggagugcaguggugcgaucucggcucacugcaaccuccgccucccggguucaagcaguucuccugccucagccuccugaguagcugggauuacaggcaugugccaccacgccuggcuaauuuuuguauuuuuaguagagacggguuccaccauguuggccaggcuggucuccaacuccugaccucaaaugauccacccaccuaggccucccaaagugcugggauuacaggagugagccaccgugcccagccuugcccugcuuucuaggagauggaguuuucugaauuuuucuguauuuagguuuucuguacuauuuuuuguccacuugaugcaaacuucuucagcuguguagaaacuuuaugaauagaugagugcuugagugucuccagucucuaaaguggcugcuuuuauucuuucuucaaaguuaauaacauguugcaagauuuuuggacaaaauauuauggugugucauaggaaaagcaccaugaauuauauuuagguauagcaagucagauccuuugaagugacucugucucuguucuuagaaggguucuuggaauuggcugugguuugaaucuuucuacugucagaggagacccauuaaaagccagaaucugcauaaagcuuucuuuacuucaaacacugaagcuguaggcgagccaucccguaucgacuuuauacucaaagaaggaaaagccagauugcagugaguggguaggacagcucagauccaaaugaaaguagggucucaaguaacccaaggguggccggguacgguggcucacgccuguaauccuagcaguuugggaggcagaggcgggcagauugccugagcucaggaguuugagaccagccugggcaacauggugaaacccugucucuacuaaaauacaaaagaaauuagccagguguggcggcauaccccuguagucacggcuacuugggaggcagaggcaggagaauugcuugaacucgggagguggagguugcagugagcugagauugcaccacuguacuccagcacuccagccugggcgacagagugagacucugucucuacaaaaaaaaaaaaaaaaaaaaguaacccaagggagggagcuacccucuagucgggcagcugauacugcuuccuugcauggauacaugggagggagacguuauagauuaagaaaugauagcaagauaaacaaaaugauuuguuggguaucuuuuacuuuacauuuguuauuugcagaggaguguuguauauauagauguuauuuuaugucacacugcuucaaugauaccuauauccauguguuuguauccauguuuuuauccauucaacuguauuaaaagguguugggacagga

SEQ ID NO: 192819 - RNA, 43202 nt, Homo sapiens
aagaaagagccccgccccuagucuuaugacucgcacugaagcgccgauuccuggcuuuugcaaggcuguggucgguggucaucagugcucuugacccagguccagcgagccuuuucccugguguugcagcuguuguuguaccgccgccgucgccgccgucgccgccugcucugcggggucauggugugcuuccgccucuucccgguuccgggcucagggcucguucuggucugccuaguccugggugaguugucgggcccucccgauuagucuguccgccugggcccggggcaccaguucaaagcuacaaccugaaagacugguccgagggggaggggguugagaggcucagcagcuaacacugggcggcggcgguuggcccggggaggcaagcggugaccuagagaaggccugaccgacggauggcggggaagaagggcccaggagaguaagaaggggccgguaacgggggguggacgccgagggaguaggcugggaggagugaagcguggagagggucagcguggaaagaguaacuuggggaaaacacugaggagugagcguaggagggugguacaugcagauuuugggcgccagagacaauuaggagagucuugguuugcugagaucagggaagaguuuugaagaugguggaaaaacuauggggugagauaggaaauuaagagagaagaccaugccugccuggaguagcuugggagaagugugugggugggggacagaugggacagauaggacaguagagccugaggggcaggggcagugacaggguugggcauuuugaagguuggaauuugagacugugaagaaaggaugauucaagagauuaggagugaugcuggguuugaguuugguagucauaguuuuaagggcgaaggaaccuaagguagcuggggcaauuuccaggaaagaaaacuuggacccaaccucuggagacuaagggguucagggggaacuuugauggggagugcacaucugacuuggagguauugaggaugucgauuuucucccaguuuugcuacuuccucccagccagacgcugacaaaaaaauccccagacguuucaguuaggagggccucccagaugugagguuuuggggguggaguauuugaguuugguagacuaccucuuugccuucagaguuucuucuuuucuuucuuccccaucacacagcuagccuauuaccucauauuuugggggugcagggagcagguagacaaacuugcuaaggauuggguuguuaccagggccuaagaauggcuggauggggccgggcgugguggcucaugccuguaaucccagcacuuugggaggccgagguggguguaucaccugaggucaggaauucaagaccagccuggccaacauggugaaaccccgucucuacuaaaaauacaaaaauuagccgggcgucguggcacaugccuguaaucccagcugcuugggcggcugaggcaggagaaucgcuugaacccagaaggcggagguugcagugagccaagauugcgccauugcacuccagccugggcgacaagagugaaacucugucucaaaaaauaaaaauaaauaaaucaauaaauaaauggcugggugaauguucgcugauuguguugugcccuaauaggcagugggucgcuaacaacuuuaaugccuaaaagugaacuuugacuaaagugucucuuccugacuuugauucaugcugugcuuguugcuacccaccugcucuugcuauuugugacuuaauaaaauaacauaaagaacagacccagaugggaguggggaagaaauagacauauuaggggucugagaaagcagugagagguauacauuuuguaauucacauuucaguagaaugaaaucaacacccuggaauagugauucucaaccaggggacauuuggcaacaucuggagacauuuuugguuguaacaacugggggauugcuuuuagcaucuaguggguagaggccaaggaugcugcuaaacauccuaacuaagcacagggcagccccugacaacaaagaaucaucucccugaaaaugucaauggugccaacauugauaaauccugcucgaaaaccauaguauuggaaggguucuugauuaucuaauucagugacucucgaggaccuuuucaugcgucugugaaaucaaaacuucggaauaagguuaagaagguauuuguccuuuucugcugggcacaguggcucacgccuguaaucccagcacuuugggaggcugaggcgggcggaucaccugagaucaggaguucaagaccagccugaccaacauggugaaacccagucucuacuaaaaauagaaaaauuagccggugucguggcacaugccuguaaucccagcuacuugggaggccgaggcaggagaaucgcuugaacccaggaggcggagguugcggugagccaagauugcgccacugcauuccagccugggcaacaugagcgaaacucugucucaaaaaaaaaaaaaaaaaaagaaguuauuuguccuuuguccuuuucacucucauccucucaccaguguacagcagaguuuuccaguggcuacguaacaugugaugaccucaccacucugauguucuuauauuuuauucauuucucaguuuuaauuucuaauacuguaaauaccaauacauaugacucacauaaaccucugugaaguccucaguggauaagaaaguaaagggguccugacaccaaaacuuugggaaucccugauguaguccaacuguucacagcgcgcaggaaacucuucuguagcacuucugaaaggcggccuugaggcaggcuuugcuugaauacuuaauuggaagccuuaacuguaccuuggagcacuuacugagggccaacugacccuaagaaaggauuguuuacaauggaaaguaccuuaucagugacuagaacacaucugaccaaggcaucuguuaaucaguaguucccugccaauugaaucugugcacaaauacaacacuguuauuguuuugggaaagugaaaaaaauaauaguuguccuacuuguuggcuuucaugucauuaaauuuuuuuuuguuuuuuaaugaaagcuuuuuuguuuuguuuuuacaaaagcaaugcuuacucacugcagaaaauaaacaugcaaaaagaagcacauaaaagaacccaucagcucaucugcuaguuugccauuuauugaucaggacuaacuagauucuuccucuuggaaaauuuccaagauugauucccuccgccuccaaguucagagcaggauuuggaaaaguaaauauuaauaauguaccuagaucugauuuuuaagagguuccaggaugaaauagaaaccauuuuucuauacagcugcauuuucugauggcucuugguucaguguggagcccaaaguccucccauauagcuuuuucugucaagaauuuagcaguugcuugguggguuuugcacaaguuacuuuucuauaucaaaauggauaccaauaauagguuuuugaaaacuuaauaaauauuuguaaaguaccuaauauguagcuaaaucaauaaauauuuguaaaguaccuacuauguagcuagaacugugccuggguacuguacggagugccaaugaaggaggaccuguccuaaauuuauagucuuauuagcauuagugcucuagcugugccaguuugacuuuguaacuuuauaacucuaucccagcuucacccauaaccuuuuaaaaacagcagcuuuagaauaaguacagaaaaggauucuuagaggcuauauauuggucuuuuucauagagauuaaauuaugcugguguuuauuuggaugaauuguaacugaccagacaacuuuccgaagagaagcuauaugauuuagagguguuauaaaguggauagugggugaaaauccuuucuuuauauaauugccuaauuaugguccuuuugugauaucauagauuucaggauucuucugugguuauugauucuuauaacuagcuugacuucuguuuuuugguuuguuuguuuguuuuuuuaggguucagaauuuuuuuuuuuuagguuugaggcuuuucugggugggaaaaaccucacagaaauauucuuaguguauguuacugguaggagccucucccuuccacacguuuacugaaugccuauugugucccagccacuauauuaggugaaagggacagaggaauggauaagacagaugagguuccugcucucauggagcuuacauuuuaaugggagaagaaagcucaacagauaaauaauauaaugucagauagugauaaacacuaugaagaggccgggcaugguggcucacgccuguaaucccagcacuuugggaggucaaggugggcaaaucaccugaggucaggaguucgagaccagccuagccaacauggugaaaccccaucucuacuaaaaauacaagggcaugguggccagcaccuguagucccagcuacucgggaggcugaggcaggagaauugcuugaauccaggagguggaaguugcagugagccgagaucaugccacuguccuccagccugggggacaagagcaaaacucugucucaaaacaaaacaaaacaaaaacacuaugaagaaaauuacacagguaaugagaaaggagaaugaguagaugauaggaaugggugaugguggaugauccuucuuuauauuauguggucagagggccuuccguuaucgggugacauuugggcagagaccuggguguuggcaggaggccagccaugugaccaucuggggaaauaggaauaaaucuuaucauuugcaaaaucuuagguuacuagccuauuuuccacgcuuuuuuguuucccccuaguuuuagucaagucucuccuaugguagcagucucuaagagcagagacgaucuuauguacuguuacuucccauugccuaccuagcauagggucugguacaugguuaacccguagugaauuuuuguugaagauauucauuggugggcacuagggauauggugguaaacuagacucauuuagucuccuuuuucuuccaugaauuuuaaaugauguuuugcaagaaguucuuuuggauugaaaacuucaagaucagugcuaagcaguacggauaauuauacaguaauuuacuaauguauaaucccauauaauaaugcuaguuucuuaccuguacuccuucagauauaccuccguagucucgaaggggguaauauggagaauuaggaguuccuuggugaggagaguuagguuuucacaaaguuagguuuucucugagagaaaacaagcacuaagauuuuucuauaggcuuaacacauuucauuuaacugauaacuuugauuucgagguucugccaaauuauucuaguuauaauagagauacuguaaaggacugaaaaauucugaacccuaaaaaaaaacaaaaaaaaaacgaaaaacagaagucaagcuagaagauaagaaaggacaggcuuguuaguuuguuagucauugauuaucacaucugauaggguuauagauauucaaauaugucccaaauaccagauuaguuuguuagucauugauuaucauaucugauaggguuauagauauucaaauaugucccaaauaucagauugucacaucugauaggguuauagauacucaaauaugucccaaaagaacagcuuucuuccccuauaucuuuggguagauuuugucuauaaccaagcauuauuucguagcacuggagcugauuuaaaugacccuugaugcaggaaggcugcucuucuuucuguagugcaaaaguauucugaucauaauuucuuauuaaagugaucagagauccccucagacccaaaaguauacuuuauaaguacuuguugguauccugcugugcauugugaaagaauucuggaggugugccaaacacugcucaacaauaagcacuuuccauuaguugaguaguguugaaucuuguuuccuuacccacucuuuggccuuaacaaauuaagucauuuuauagcuuaaaaacauauuuuuauuaacuuuuaauacucuuuuucauguguucaacauucuuacuuuaaaaucauauugcuuuucuccuuuaagaaacuuaccaaaagcaaggguauaaaguaacugaaugcaaugaguguaccuauuauuaggaauuauaaaggagaaacaguuaaucugacuuaaacuuguaggaaaaccaucacucugaauagaaaacaaagauaaauagguaccguaugccucuguguccuguauuuuaaaaagaccuuuugcucaacaucauucuaaauucaugaguuugaggacaagaguccagaauuuaauaugaugaaaguaaacauaaagcuaaaacuugggaagguucccuuuaggugcuguguuuacuaaaaaggagacuuguaaauugguaucuaacuuguuuggcaaauuucuuuuagcucugaaggguuuauaugcuuucaaagaaccuauuggagaaauaugcacuauaauucuaaacaaggguaacuugcccaaagucucacagcuaggaaguuggacugccagauuugaguucuagcucuuccacuccaggaauggggacucuuaaucacuucauuauauaaucaauccauuguaucuuggaucauuguuugguuucuuuuuauugguuuuguuuuauugcuagcauuauguucuucccccaccccuaauuuuguguguuuauguuuucagcuauacuuugggucaaauagacuugcaaaaaccuagccacuuuuugcagugucauacacuuggggaaguaaggucuguguucucugugagagguuuuuuuuuuuuuuuuugacagggucuuguuccauucccccagcuggagugcaguggagugaucuuggcucacugcaaccucugccucaugggcucaagcgauccucccaugucagccucccgaguaguugagaccacaggcaugcaccaucacacccagcuauucuuuuguauuuuuaguauagauggggucuugccauguugcccaggcuggucuugaacucuugagcucaagugaucugccccccuuggccucccaaagugcuaggauuacuggugugagccacugcccggucaaggucugcauucuaaaagaauuuacaaaugaccuuuuuggaaaacaggauugagaggauauuugacuuugagaacgguugauuuugaggcauaccuuuuucuuuuauuuagagaauaaacucucagcucuaaaauuacacacucuagaauauauucaucuaugguuuuuuaaugucauaaagccuuuuaaaaauuggguauuguaaaaucaaacacagcaauaaggauggaaauugcuugcuagauacuuuuuaauaaaguguaaauauuucaacuguaaacuuaccuuuugggaaaagcucuguuccuagcuugacauccaugucaaaauuuauugaagugaaacccaacaugggguuugagggaauauccagaagacugauauguucaagauuuggaagagcuaaaggacuggccucucuguaauuagauuaagcuauguuuugggucccuauugcaguguguuuucaccuugauauaauuaaucaguauuuauugaaaaucuaauaugcauucagcacuacuuggaaugauaggagauagaggaaaaguaauacacaugguguccccuaccaugacacucaugauagaugacauucauauaaaagacacacugcuagggguugugggauacaucagaucaucugaucaagggagcauacuggaguucaaacgagugacagaaauguuaucuaaagggaaucuugaaucuauccauauauaucauucauucacagacuugguacuuuuuuuauuaguaacaaauuacuuacuguauacuauaauuuaccauggcacaccaguuuguuaugaagugacaguugaaaacugcuguguuggagcuuaugacaguaggagggacaggauuuacugcuauaaaauaacugaauaauucaggauaauguaaaauauacugaaaugggaugugcauuauuacugcuccuugagggcuuuuauagucagggaaagcuuuguggagaaaauggcuacugaaaaaacagauagcauaucagcccagguucuuaauugcaaggaagagaaauacaaucugauugauuuuaagcagaaaagaauuuauuaaaaagaacugggauauaaugcauacccuuuggccccacaguuucauuccuagauauacagccaacauacacgcauacauguguuuacuaauaugugcaagaauguuugcagcaguguuuguaauagaaucacacuggaaacuaaaugcccauuaaagguagcauagauaaguaguuuuuuuguuuguuuguuuuuguuuuuuuuugagacagaguuucauucuuguugcccaggcugguggagugcauuggcaugaucuuggcucacugcaaccucugccucccggguucaaacgauucuccuguaucagccuccugaguagcugagauuacaggcaugugccaccaugcccagcuaauuuuuauauuuucaguagaggugggauuuggccaugguggccaggcuggucucgaacuccugaccucaagugauccacccuccuuggccucccaaagugcugggauuacaggcgugaaccaccccaccuggccuguauucaccugaucauagaagguuauacagcagugagcacagacugcaauuaugcauaacaugggugaaucucacaaaaccuaaaauugaggaaagaaagcagacacaaaagagagcauagugaaugauuuuauuuauaucaaguugaaaaauggauaaaauuaaucuauagugucagaaaucaggauaaugguuacccuugggaagggaauaguaacccuugggaagggaaagggaaauaaggagggcuuuggaaguguaguugacccuugaacaacacaaguuugaacuguguguggaucuacuuauacaugaguuuauuucaccucuaccacccugaagacagcaagaccaaccccuccucuuccuccuccucguuaugauuuuuuuuuuuugagacggagucucuaucuguugcccaggcuggagugcaguggcgcgaucucagcucacugcaaccucuaccucacagguucaagcgauucuccugccucagccucccaaguagcuaggauuauaggugaccaccaccaagcccagcaaauuuuuaguggagaugggguuucaccauguuggccaggcuggucucgaacuccugaccucaagugauccgucugccucagccucccaaagugcugggauuauaggugugagccaccaugcccagcccuccuuaugauuuucuuaacauuuucuuuucucuagcuuuauuuucaaaacacaguauguaacacauauauaacauacaaaauaugugugaaucgacuguuuauguuguugguaaugcuuccagucaacaguaggauauuaguaguuaaguuuugggggagucaaaaauaauaugcagauuuucaacugugcagugggucaacaccuguuaauguucuguuucuugacacaggugguuuugguuugugaaauuauuugagcuguagacuuaauguuacgugcacuuuucccuuacaucuguuauacugugccuguuucuguacauauguuacauaucaaauguuuauuaaagggguauauuggguaacucagaauuucuggugcuccuggcuauauauaccaaaucccaguucaggauucaacaacccagaucaugcugcugaacugcacuaccacugccaagugugaaauugaagcuugcucugcuggccuuguugccugggagcuugauccugcuucuguuacuccacaccugucucccucccuguuccauuccuggcuccauuugcagcccuccuuucaaagugugggguggauaccuuuguuaggcagagccuagcacaagugguccuccuuacugcaagggagucugggaaagcaaguauccaguguuuucagcuuuuauaguggguggugauuucugccagaaauuguaacaaggggacaagggguguuucagauuuggggcagccaaaaagcgagcaaaauccaucuuugaggugagcauuuaggccaauagaagaaaguagauuucaaguguuaggaacaauagaagcccaggguagagguugaauagaguauggcauuugagcccaguggaaacaaguuuaacuggauuaaagggugugcucugggaaaauaguuugagaaaaguugaaggaauaggaugggacaagauuaaagauuacuuugaaagucaggcagaggaauuuaaauuucauaugggaauguuggagccaguaaaaguuuuugaacaagaaaguguccuaaaaggaaaugguacuuaaggauuauuaaucuggcagcacuucuagggguaucuaggcauuuucugucauaauuuagguguggggugauagauugggaguagaaauaaaagacaaagauuguauuuaagagaagauuugaaggaaaaaaaucaauaggacuucuugaagagaaagaaguagaggcuauuucugaaacugagcuugagugacugaucccacucuucauuuagagcuagcaaagcugaggagggacccaguuuggaggaagcagaagaaugaauuuuaguuugggaauugcugaguuugaggugagagauauugaguaaaaguggucccugugcaguuagaguuggggaccaagaaguggaaagaauugcacucaggcagaaaggcugugaagggaauggaacagagugugccagaacccucaggguguuucucagcucuuguuuacgggccaccagguauacuaucuugaauuuaauuuuaagugauacguuugaaccacaaccucuaccuuuuguuucauaaaacgucaguucucacacccuaagacacauugaugcaagcuaucgaugcuauuacuauuuuacauggucuucuuccuguuauucuaauauauuuggaaagaaaaugauuaauacaugugaggcuuuucuugguaauuuucaauacuuuugaauguuuugaauacaaggagaauaauauacuaaagcuagagaccuuaaacaagaccgagaaaagacugcauauaaaaagcaaaccuccaguucauuaaaauuguaaguuggagcucuuggcuccauggcagggagccuuggaucaguaaguauaacagcucccuuccguauuguacuuagaaaagaaugaucauaaaaccuacuuaggccucacaaggucuuuuugagccuuagccaaugcauuuagucacugucaguaaccacaagcuuuaguauaauauucuggcuugcaaagcagccaggucuccagagcaugacgauaggcucuucuauacaacuugaaagcuguugcugaggcauaccuucuugauauuccucuuagcacuuuucucuagucuauagcaagucuguaccuguagaugacaguggauugcucagauauuauuaaagaguaugcaaguaucuuaacaggaaacagcuuacccuuuggguaaugugugauacagugaagaaaaucccuuaaaugguugcccaauauuuaugcugcuggcauguuugcugggauauuuuuucuccucugaauuaguauuuugaguccuugggcucuucaguuuaauagauaauguuucuauguuuaaguguagaagauccaccauguuagcugaaaaguuccaaggcuuuucugucucuguaacauuucucugccuaaagagguagcagguugaaaauuuaggaaauaacuuugcgucaaaaaauucaucagccuuucuaaucaauucgauuuuaaagugaaacagugaugaacuuugcauuuaucagaauucauguuuuucucauggauuuaacagcccuuugcaacucugcuuccuugguuacaugauagaaagaguaucugaucacaucagaauaaaaucguuugggaagacauccgugugucauagauuauguagcuugcaacaggauuuaaagcaaaaagaugguagaauaucggaucuaucauuauuuuugcagugaauguuucaccagcugguuugagagaaguuuuacaccccuaccaggcuuccucuuaccucauuuaccgcaaaaaccacaaguccuaacaggcaaacuguaauugccuaaaacaaaacuaguaagguauaaaugcauguggaaaugauuauuugaaggcaaaaggcaaauaaaugucaccagucugagccaugaccuaagcauccuaggucuaguaaccauucuuuugguaagggauaaugccaacuuuuuuaucaauaggauucuguuaaaaauacaaagaaaaacagucagcaggauacuguaucuauacacauacauauauguauauacacauauauguauauauauguauguguauauauagauauaaaauacuuuuguuucauuuuagagcugguugaacuucagugguggguagagcuuguuuuuaauuuauauaauuuuuguaguacaauuuuaaaauauuauuuuuuuaaaugaauccaggagcugugcggucuuaugcauuggaacuuaauuugacagauucagaaaaugccacuugccuuuaugcaaaauggcagaugaauuucacaguacgcuaugaaacuacaaauaaaacuuauguaaguauauauuuuaauuuuucuuugaguuuuauaguaggaauuuaauugacuuuauccuuuagauacacguauacaaaugaaauuccacguugacugacuuaaugcugaaacucugggauuuuuuuuaagcauacacacucagaaguuauucuguuuaguguuagaaugaauauuucuucugauucauugguucuugggaguuuuuguaggacuugauuaagggcaaaugaucugaagacgacuauaugguguucaggucuaaguauuucuguaaaguguuuaaaauguacuagcaccaaagcuugcccuuuuaaaaagcagcuucccaucugggcaugguggcucaugccugugaucccagcauuuuggaaggccaaagcaggaggauugcuugaacccagcccgggcaacauggugagaccucaucucuacaaaaaaacuuuaaaaauuagccaggcaugguggcacacacauguaccuccagccacucgcugggccgaggcuggaggauugcuugagcucaggagguugagucugcagugagccaugauugugcuacugcacuccagccugggcaacagagcgagacucuaucucaaaaaaaaaaaaaaucgcuuacuuagguugguacaaaaguaauugccauuaaaggaacaaaccacaauuacuuuugcaccaaccuaaguaagcgauuuuuuuuuuuggcacaaacugcaauuacuuuugcaccaaccuaacacuaaaaucucccccuuuuugacaucuccucuuaauuccuuugccuucuuauuuucuuuuuguuaagguccucacuacuuacaaccuaauuuuuuaaaaaaucaguuuaagaacagcagcucaagccaguuuuccuuuucuuuuuagacauacacgaauuuauccagaggagugguauguagcagaagaaucagggacugguuuacacagcaaaccaggcaaagggcaaccuggccauggagaauguaugauuuaggcugaaguggcaugcccuacauaaaugcuugguguuccuugcugccuguuuguuucucacccccaaauuucuauuucuuuuagaaaacuguaaccauuucagaccauggcacugugacauauaauggaagcauuuguggggaugaucagaauggucccaaaauagcagugcaguucggaccuggcuuuuccuggauugcgaauuuuaccaaggcagcaucuacuuauucaauugacagcgucucauuuuccuacaacacuggugauaacacaacauuuccugaugcugaagauaaagguaaccuuaagaauggauuuguguuauguucucuugcuuuuuauuaaugauaaaaauguaaacaauuuuaaaauuguuaugaaugucugucuuccuaacuagcauggaaacuucaugucuuuauaacccucccacugaccccaugcauggcacauaugacaccauccaacauacugaugauauuugcugucauugcuugagugacuuacuguauaccagguauuauccuaguauacaguaagucaccuuacuauauauauccuaguauacauauauauguguauauauauacauauauauguauauccuaguauauauguauauauauauauacacauauauccuaguauauauauacacacauauccuaguauauauguauauauauauccuaguguguguguauauauauauauauauauccuaguguguguguguguguauauauauauauauaucuccuaguauacaguaacacaccuaguguguuaccugcagcaucucacuuaauucuuaacagcaacccugggaaguagauguuguuucauuuuuacagguaaaggaaaugaggcuugauaagauuaaaugacuuuuccaaacaucacacagucugguaagugggcgagcugguguuugaagcagucuauugaccugcagaauucauauacuuaacuauuauugauuucauucaguagugugcaugaaacaaagguuugaugaaugagaaaaugcuuuacuaauagcuacuuuauuuucaagaucggggguuggggggggugucucacuauguugccuaggcugguuuugaacuccuggauucaagcgauccucaugccucacagccuccugaauagcugggacuacaggcaugcaccacugugccuggcuacuaauagcuauuuuaaauguguaaaaguuaaguaaccugagacuaggagaaaugccucuuguucaaaucuuuuuaucauuuagguuggauuuugauugaaaaguaaaugaugauuaguuaaagguguaguagucccucauuacacucaggggguaucauucuaagaucucccguagaugccuaaaacugcaguuacuacuaaacccuauacaggaaaugcuauguuuuuuuuuuuuuuuugaucugauaacugacauggcuacuaagugacuaacggauggauaguguagacaacguugauauacuggacaaagggaugauucauguuccugguugugcagagcgggacagcaagagauuuaaucaugcuacucagaauggcguacauuuuaaaaccuaugaauugauuacuuuuggaauucuccauugaauauuuucagagcucaauugaccauggguaacugaaaccagggaaagcaaaaaccguggauaaggggagacuaaagucaacauuugcuguuauuuuaagacaauuucaggucaaaaugaacuugggaagcauuggcaauuaggccauucuaguaauucccagaacugaaaugcguguuaaaauauuuugaagauauagaguguagagauuuuauuuuauuuuauuauuuugagcuggagucucgcucugucgcccaggcuggagugcaguggccugaucucggcuuacugcaaccuccgccucccagguucaagcaauucuccugccucagccuccugaguaacugagauuacaggugcgugccaccacgcccggcuaaucuuuguauuuuuaguagagacaggguuucuccauguuggccaggauggucucgaaauccugaccucacgauccacccaccucagccucccaaagugcugggauuacaggcgugagccaccgcacguggucgagauuuuaauuuuguuagggauauaauucucuucuuucucccccugcccguugagauugaguuaaugugguauuuguaguagcuuagcucuuugcagauaguguuucauucugaccccagaaacagguagaugggcuuuaguugccuagaccuggggauuaauaacucauuuggacuuaaggaugucaaaagauccuauucgaaagaaccagaaguaaauaagcucacguaaaauuugggagguauugcagaaugagacuuggaaaucaaauccuaguguucuuuuuacuaaucucuuaguuugagaguauaacuaaagcaaaugguuauuggcuaucuuaucaguuuaucuuugugcccuguuuugccuuucagagcuaguauaagauaugccccucacuuucaaguagccuaagaaugagcuggggagacaaagcuaaaugcuauucccgaguuacauggaaaaauuggaaaacauugagcucagucugauuuuguuguuguuguuugcguuuuuguuugagggaguagaggguucauaaaucucuucugacagugugaggaaaacuuuagacucccucucaaaaaagaaaaaguacacaguaaacuuugcauauggaacauagucccugaacccauauguagaucccugugguuaagagugccugauuuaggucgagaaugguagcucaugccuguaaucccagcacuuuggguggccgaggcaggcugaucacuugagccagggaguucaagacuagccugggcaacauauuaagacuuugucucuacaaaaaaaaaaaaaaaaaaaaagccaggugugguggcgugugccuguggucccagcuaccuggguggcuaggguggaggaucgcuugagcccaggagguugaggcuccagugagcugugaucccaccacuacacucagccugggugacagagagagagagacccugucucaaaaaaaaaagaaaagaaaaagaaaagacuggcugauuuaaaaguguucccguguucccacaagugguccugauuaggaggagugauaaaggaaggcucaguguguguuagaguagugagaaagcuugguagagaaguaggaccugagcugaaacucagcuaaugguagaauuugaguaagcggaggauuuugagcaggauguuuccagcagggggaagcauagcauaugcggcaguaauuggagagcugccugauuaaaucaggcuguguguguagcagaaggaaaauaaaguuggcuaaaugaagugggccuaaauuauagggggccuuggaagccaaggaaagacauuuagcuugauggggcaggcacuggggaaucauuuuagguuuuuaaagcaggagaaugauauaacaaaagcagagacaguagcuuauaaagaauauucugcaggauuaguugagaagugaggaggcuacaagcagagaugcuggcuuaagaagcuguuauaguaaucaagggcugauguaauaaaugccuggacuacaggggcaucaguuguuagcaguuauuaggaggagguguuuaaucugacauauuuggauagaaaaacuauggacccugaaauguuaacacuucucucuuuccccuuuuauuuaaaacaaagggaggauuacuuuuuaaauuacuaccuucuauauaauaauauuugaaacuauuuggaauguuaaauggcuuccugaaauggacuauuaauaauuguuuuugauauaguucaguguuucaagaauacuaauuuauggcugggcgcaguggcucacaccuguaaucccagcacuuugggaggcugaggcugguggaucauuggaggucaggagauugagaccagccuggccaacauggugaaacccugucucuacuaaaaauacaaaaauuagccgggugguaguggugcgugccuguaaucccagcuacucaggaggcuaaagcaggagaaucgcuuuaaccugggaggcggagguugcggugagccaagauuacgccacugcacucuagccugggcaacagagggagacccuuccuuacccacccccaacaacaacaaaaaaaacuaauuuaggccaggugcagugacucaacgccuguaaucccaacacuuuggaaggccaggcagaucgcuugagcucaggagugugagacuagccugggcaacauagcgacauucugucucaaaaaauaaaaauaaaaaacuacuaauuuauuuuuaggcaucugauaacugaaguaacauugaagcugcuuuuuucuuuuuuaaauuuuuuucgugauuaaaauauagaaauguacuggccaggugugguggcucgugccuguaaucccagcauuuugggaggccaaggcaggcagaucaccugaggucagaaguucgagaccaacauggugaaaccccaucucuacuaaaaauacgaaaauuagcugggcgugguggcgugcaccuguaauuccagcuacuugggagguugaggcaugagaaucguuugaaccuaggagguggagguugcagugagcucauaucaugccacugcacuccaaccugggcaacagagcaagacuccaucucaaaaaaaaauuauauauauauaaguuacguauauaauaaggguuuuuuaaaaggcucuacauauacauauauauauauaaagauuauauaucuauaaagauuauauauguauacagagaauaauauagcagacccauauguacccauuauccagaauuaauaaaugcuguuuuuuuaauguuuguguuacuuuuuugauuaaaaagauaaaacguugacaauacaguugauauuuccuuugucuucauuccccagacccauuuuccuucuugccugcuaagaggcaaacacuuucacaaauuugggguauaaccuuccugucuuuauguuugucuuuuacuauauaaguacguguucauaaacaauacauaguuuaaaaaaagcuauucauaguauaacuccaauaugccugcaaguuguuuuuuugcugauuugcuuuugaaguccaucuauauacagccagucacguaucuauucauuuuuguuaacggugagaagcaauucugggaaaaauguucuaguucauugguuuuuuguuuuguuuuguuuuuuaauuccuauggccauuagggggugccaaggcagcauuauauggcugcuugcuacaugauggagaggcacagaaggcagccuauauuaaggaccuuggauacuuuccuuucuugcuacuucuccaaaagaagccaaaccacuugggugaucaucgucuuuugaaguuucacuauacacaggcuaauaaaaacuauaugaaauggcuguaacuuacugcuuucauacucugaagauucccugaaauggaaucaucuuuaaauguaauccaggaagcgguucuauaagcucauuggaguuaauauaacuuacuugggacuaguaaaacaaaaauaaggauuuacuauacaaauguaugauuaauccaucucucuugcuucuuuaguuauagucacuaaguccugaugauucuaccauagauaaguguuuucaguuuggcuucuuugcucucuuucuacugccccacaccaucuuaguuuaggcaacccucccuuacccuucaccuuaaccagaccaucacccucugguuucccucuuaaguggcuucccugaaaaguuuuucccccugcuuauccccuacaaauuugcuaucuuccuuaaaauaaauuauauauguguuauuuucugcuuuaaaaacugaggcuagcccucgacugcuaaaaagaaaagcccaaacaggccuuagaucauagaagaugcuucaaaguaugaucaccugcaacuugucuuuccuucuuaacccccauuucuuuuccuuuuuucuuucuuuuucuuuuuuucuugagacagaguuuugcucuugucauccaggcuguagugcagugggcgaucuuggcucacugcaaccuccgccucccggguucaagcaauucuccugccuuagccucccaaguaacugggauuacaggcaccugccaccaugcccagcuaauuauuaucuuuuuaguagagacgagguuucaccauguuggucaggcuggucucaaacuccugaccucaggugauccacccaccucggccucccaaagugcugggauuacaggcaugggccacugugcccagccccuaacccccauuucuucuucccccuuacuccuuauguuuuagccacagugaacuagucaugcccuuaagcaugcuauauccuuugucacuuugugccugggguagggcaggcagagagaagaagaaagccuauacaaauauauuuauauuaucacuuuucuccuaccuucuuggaaauagccauuguuaaucuuguuuuauaggaauucuuacuguugaugaacuuuuggccaucagaauuccauugaaugaccuuuuuagaugcaauaguuuaucaacuuuggaaaagaaugauguuguccaacacuacugggauguucuuguacaagcuuuuguccaaaauggcacagugagcacaaauggugaguaaaguauauauuucucuacuuggauccuaauuuaagaguagaguauaccagguagcuuucauugaagucauuaucugaaagcauuuauauauuaagguuuauucauagcuucuacuaggcuauaaaguuuuuguaaauaauagcaauucuuauuuuuguguaucuuacaauuuaaaguuuuugauguacauguuguggaaugguauuuuaaaagacacuaccuauacuguucucagcugauaaaaccuaaucauuguuugaacagauccucagauagcuugauuaucagcuuuuuuagcgguuccaagaccaaagcuuagaaaucagauucauauucuaaucuugaauuuuuaaaguugauuuuauaauuuuuauauagcuuuauggaaagguaauaauuucucauucaccaguucuggaaaacuaugaacacuucccaagaagagguugaaaugccuaugauuugccauagggcuaaugcaaauaaaugguucauuuguauuuaaguccuuugaugauuucuaagcuuuuuucuaguaaacaguauccuuccuuauggugauuguaugugggaauaaagaaccaaaaaauuuaagacuuaacucucugaauuucguaucagaggcaggcaaaguucuuugggaauaaaaagauuuaagggucugaaaaagacgaguauguggccaugugggagcagauaaagcauagggauguguccugaguuugcugugucauaacucauguagauauucuguauaugaagcagcaguuuaagaaccucugccuaauuuaguuucaaauauacuaacaagauauucucuuccccuaauauaacccuuuuggacuucuauuaugagaauuuuuuuugguuuucccuggccuuaugaauuaagaaaauguccgcuuugguuucuuuugucccuuuucgcuuguuuuagaguuccugugugauaaagacaaaacuucaacaguggcacccaccauacacaccacugugccaucuccuacuacaacaccuacuccaaaggaaaaaccagaagcuggaaccuauucaguuaauaauggcaaugauacuugucugcuggcuaccauggggcugcagcugaacaucacucaggauaagguauaggugucuaucuuuaucaauacauccuuuuugcauuucauuucaaauauugcguauccuaccuucagcccaaagguaguguuacuagaaugauuccguuuucuuuuuguuuguuuguuuguuuuuuugagauggagucacgcucugucccccaggcuggagugcaguggugcgaucucagcucacugcaaacuccgccucccggguucacgccauucuccugccucagccucccgaguugcugggacuacaggcgccugccaccaugcccggcuaauuuuuuguauuuuuuuaguagagauaggguuuuaccguguuagccaggacggucucgaucuccugaccuugugcuccgcccgucucggccucccaaagugcugggauuacaggcgugagccaccacacccagguuuuucuuucuuuuuuuucugagauggagugucacacugucgcccaggcuggagugcaguggcaugaucuuggcucacugcaaccuccgccuccaggguuuaagugauucuucugccucagccucccgaguagcugggguuacaggcgugcacugccaugcacaacuaauuuuuuuguauuuuuaguagaaauggguuuuuaccaucuuggccaggcuggucuugaacuccugaccucaagugauccacccgccucagccucucaaagugcuggaauuacaggcgugagccaccgcgcccagccugauucaguuuuaaauggagauuucauguuggcuuguugagcuuugauuaguuaggaguuacuauaaccaugauguguuaaugucacuuucagguguuguguuggccggcagaaaaccuagcaguuuaaaguacucuuggggguuuagauucuauuugccaucaguggaucagaguacaaacaauuggccuuuauuucagucaguuuaaaauauaacuccuucacacuuugaucugaaaugcacuguagguuggcguacaggaguggcacagcuauccguuucuccagcuauuugauuacucggaucguguagacaugcccgaguacaugauggcacuucuaguugcaauguuccacucaggcuguagagggauugccaagaaacaaauccgauuuccaggaucuugugacuuaaacaagcgaggcagauggcucuugugcuccauaaaaauguguguuuucauuuggcucauuacuguagaagcuucccucuuguuuuuuuuuuuaaguugucugagucauagcuugaggacccaugccaacuuuguuugaaagugaagacaccaugaauuuuaaguauccagacaaaagauuuuuuguucuacgcugaaguugauuuuguuugguagaguguaaggcuuugcuggccacuuuuauagcuaaccuguaccuuuucccuuucuucuucuccugaagguugcuucaguuauuaacaucaaccccaauacaacucacuccacaggcagcugccguucucacacugcucuacuuagacucaauagcagcaccauuaaguaucuagacuuugucuuugcuguggugaguaacagauuuuuuaaaguuagguucauucucuuagaaacacaucugaaagucuaaauaguugcauggggggagggggguauuuagcuuuauuuuccaguucuacaguacucaauuauaaaguguaguccauucaucccuguucaucccucagagucugugcaauggucuguggacuggacucuugcauuaauguucaccaagaguggccauuuuaccauuagagagacucuaggguagaagcaagaauuaacucacaucaaaaaaaagaaaaaaacgaaacccacaauugucuaaucuauccauacauaaguaauuuccaugauaauuuuuucucuguuauugguuagguagugcucauguuuuucugugauacuauuugaagccauuuggaggcuauauuauuugugauagugucaguaauaaaaauagguaacaucuauugaguacuuacuauguacaaagcucuguguuaaguguguauaugaauucauuaaaucaggacaauuuauaauggcagcauucagguuuuuguuguugaucaagagcugaaaccuaaacagaagguuuuggguuaagcauaccuguucuacuucuugcuagcauaaauuaaucaucggggaucuuuauuuccaccuucucagaagcaacuauuauucccauaauuucugugaagggauguaugugugaacauguuguggcaaaugagacugguggaauagaagauagcuguaagugagggaaaauguugaaccaccaacuauucucaaacuaaaaauauuguauaauuagauaaaaaccaguucuguuuuuaaaucagauuacuguguuuggggauggggaaauaaucucaacaucugauauauaaaaaguagguauguuguuauuucauaugugaucuugguauuuugagucuaaagcacauuuuucucuuuagaauauaugccgaguaauugaggauuacauuaggcacuuguauuuuggaaagguuuacaaaaauguuccuuuuuccagcauucaaauaauuccucuguuaaaguaccaugugaccagugaauuacuauugaaaaugucuaauugaauuuguccucuccaguaugguaaaagcaagccucaggcacauucucuuuuaaaguuaccuaauagggguuauggucaauaagaacaaggaaaguaguauuuuggguuuauucccuuucaagugauugaguuugaucuuucuagcugugguagacuccuaaaaggaacaugauuucucuugacucuuauacggcaauguuuaguauuuaagaauuacaauauuuaauuuacccagcaggcuaucuuaaaacguaauccaaaauagugacauuuuaaucaugcuacaggcacucugaaaaaucaagagacaccugcaauguccccagaguucaguggggcccauuuuugccuucaacccugucaugauagaugcuccuuaggagaauuuauagaauucgagugcguuaugugcaggcugcuaugguggguuauggagaagaaagccaguauucuuaaagugcccacaguuuagugguaaugggagaaaucugcaaauaauuaccauuuuugugaaaggccuacaugccaugccaaggcuuuugaacucgauucuguaggcaguauaguacuguggaagguguauaugaaaugggaugagugccagaccagagaauaguacaaagugcugcaggagaauggaggagggagagguuaauuccggcuggaggagagucaggaagguuuaauggcagagauggcauuugagcugggccuucaaggaugggucugauuuguauugguagggagauaaggagaguaagugggaaagugcagguuaucccuggauaaagggcauaaucaagaccagcugggagaaugaggaguguuauauguuuagugaaaauguggaaaagucauugggacaaauuguggagucuugaaugcaaagccaagauguagccuaagucgaggagggaugugaugaaggugugaaguccuccauuaugcuucuuccugaaauuucucugaagucugucuccuagcuuuuacuccccauugccuuugcucuggguccaguccacauuaccucuugccuggaccauucaaacagcuccugccugauugcuccucuuccucaccuucuccauuguucuacaucaacuuaaccuuccuaaagcacaucucuccaucaguguuucucucuuucuuuucuuucuuucuuucuuuucuuuuuucuuuucuuuucuuuccuuccuuccuuccuuccuucuuucuucuuuuccuucuuuucuuuucuuucuuugacagagucucgcuuugucgcccaggcuggagugcaguagcgagaccucagcucacuacaaccuccgccucccagauucaagcgauucuccugccucagcugcccaaauagcuggaacuacaggcaugugccaccacgccuggcuaauuuuuuguauuuuuaauagagacgggauuucaccguguuagccaggauggucucgaucuccugaccucauggucugccugccucacaauguuucucuuuugccaacaagguaacaucuaaaguccauggcuggguaguucaagccuucuuuucucccaugcaaugcagccugcauuuucagccuucacucccucuuuaugaaccuuauguuuccuuuaguuccuucagggugcuucccucauccuguccucugugcacuucuugugagguaggagaacauaguaauaauaauuacauagacuccgcagccauacucccaaaauggggaugauaacagcaccuauugcauaggaguguuguacuuacucagcgaagcaucauauguaaaguuuuaagaacagugcugggcacuuaguaagugcucaaaugcuagcauaaaaauuugagauuaugcuuauuuucuaacuaccguuauuuauacucuugcucucucaaauaccccuuuucccacuuguuuccuaagagaauccugcccgguucaaaaugccccaucccuaagcuggcauuacuuuuucuccucccuuauuuggaagugauuucucuccuauuuucaugacuucucacuuucuuuuuuguaauaugguuguuuauguguuuaucuuaccuucccuggcagauugcaaacagggugaaggcaggauugaagugugguucauuuugguagcuccuggaguacuugcacucugaaauuauuagaaugacuggcugaucagaugaguacuucagaaagauaauagcagugaaaaggaaagauuaggacuggaggggcugaaaggcagggagcccacuuaagaggcugcugugauccaggcuagagguggugagggcucagcaagugacaggaggaauaaaauugaggccauaaaucuucaagugucugagauccacaugacuacaccugugcuccaaaaguuggaaacaaaauacagaggaaagggauuucugucagauuaugaguucucuuuuacuuaguugcaguuuauucuaccgcaugauuucuucuucuguguaauaguguuagauugcuuuucuucuguggguauuaaccguaucuguuaucuguagacaguugugaaauguuaauuaacuggaagcucuuuuucaaacagaaaaaugaaaaccgauuuuaucugaaggaagugaacaucagcauguauuugguuaauggcuccgguaagcaaagcacuggccuggggaaaaagacuguggauuacccugaaggauuagaaauuacaauggucuuauuaccaaauagugccuuauuuaaugaaacagaagaugcuauguaaaaaguguaccuugaucauaccuuaaaaucaguaacuuagaacuaugauguucugucuuuuucuguaucccauuuuuucaaaguagaguagauaauaauuaaggauaugacugauuuuuagacuauagaaacaucuauagaaagauaagggaaccuaguuaugguaagaauugcuuuuuguggguugaucuugucccccaggccuucacugaaaaacccugaggacuguuccuuuuuuuuuuuuuuuuuuuuuuugagacagggucucgcucuaugcccaggccagauugcaggggugugaccacagcucaaucccagguucaagccaacuacccaccucagccuccuagguagcugggacuacaggugugcaccaucaugcccagcuaauuuuuuuuuguauuuuuuguagagacaggguuucaccauguugcccaggcuggucuugaucuccugggcucacgugaucugcccaccuuggcuucccaaagugcuggaauuacaggcgugagccacugugccuggccaacuuucccauuuuugauguugauaggauaagaaguuacuaaccuguuucuuuucuuugaaguuuucagcauugcaaauaacaaucucagcuacugggaugccccccugggaaguucuuauaugugcaacaaagagcagacuguuucagugucuggagcauuucagauaaauaccuuugaucuaaggguucagccuuucaaugugacacaaggaaaguauucuacagguaagaaucaagcaaacuucauuaauaauuuauguucuuauguugacagguggcuuuuccuuugaaucauagacauuuaaacguugaaauagaggaauaugaauucauagccuugaccaaauugugcaacucuauauuuggcucaucauuuugcucaaccgagauguuuuugugaucuuaaaaucauuugcaaaaaaaguucuuaaagcuaaaacugauagaagcuuuaagugagcuuuauuugagguauggguuuuaguuuguagggaagauggcacuugggagcagcagcuuugagcaucuugcaucugcuuccugaggccgucuucucacuggaaacauuuucauaccugaaugaaagcaguuuggucugauuuuguuaagacaaaagauaaagagcgguagcaaagccucaaauaucaugaacuauguuuuuaccagccaaaacgaucuggagaguuuucaaagcaugugccagugugaaugacgcuuuuugaagaucacucagggauaauggugguauuuauuagauuuuuaaugaaaccuuuugaagggcucauuauaauguguucauacgaauaugaaagacauauuuggcauuacaagauuaaaauuugcaugaagaaaaaaagcacauaaaauuccuuaauugacuuguccuuuuaagccuauuaccuaaaauuggggguuuguggaucacaacucuguugagcagagcuagcuauuccaggcauccacauccuuuucaaccauuaauucuaugguuuggaaggaaauguggaagcuguguuuaaaagcgaauauacugugagccauucgacuacuuuugcagugguguugaauaccuagucugacuugguuaggccacaauaaauugggcucuccacccuaccauucuugcgauuaaagacguuaguuacacuuuaaaaauauuuucaagaauucauuuucccuuuugucuguuuugcuuauguacuucaauuauuuugauccuuuaguagcuuuauuuuuggacuuuuuaucuggcuccccuucauuauuccccuaauuuuaaguccagauuuguguuuacaguuuaaaaucguuugcaguauuaguaucaucacuucaagacuguuuaucuagucaccuguaauagagaugagcugugcucuuucucuuacuuugaaacuuugguuuuuauguacauagaauuaaaaauaucacccaaagagauauacagcauuuaauacugauauugaauguauaaucuauuuguggaacuagguucuuggcuguggguaccuauaaauacaacacauagguaauauuugacuguauggggaaagaaauagaauugcaauaaggcagaagaguguugauuggauuuuacuggaucagaccacuuucuagaaguagaaaaaaauagcccccuuaggcugccaacccugaccagauaagaaaugcaguaagcacgcucaaauuaguaagaggucccaguuuucuugacuuugcagccacuaaaauuguauguacuaagucacgaucugcaaacuuuaaaguuccaaacagugaguguuuuaggcuuuggugccauauggucucugucacaacuauuugacccugcuauuguagcacgaaaacagcaacacauaaacagaugacuguggcuggguuccaauaaaaccuuauuuauggacacuggaauuugaauuuuauaugcucucaugugucacaaaauauuuuuuucaaccauuuaaaaauguaaaggccauuuuuagcucuuggaccagaucuggcccaugggcuacagcuugcugaccccugacccuaaagacagagccagccuggcuauucucaucacaugauaccuuccugauccuguuuccacuuucccaaaagacauucacucuaccacugagaggcuaaucuggcuauguaaaagugggcuagauuagcucccuuuauuucugauaaaguaauaugccuauuuuggaaaggacuuggaauauaaacaaacauauauguguguauguauauguauaugcacacauauauaucacauauaaaauauauaucauauauauaaugugugcauuauauaucauauauaaugugcauauauuauauauaugcacacauauacaaugugcauauaauauaugcacauuacaauaugagcuguguuuauagauguaaaugaauauacauguauucauauauaugaauaucugcauauauacacauaaacaaaugaaaggacaaagaaagucuuagaauuuuaauucuagaacaguucuccauuuucuauagcuuuaucauaaaaauauaccugucuuaguuacuugaaguugaucuuguaagaacauuucugacuuuuaaaucaacaucuuugacuucgagacauucuuuugugauuauacucauuauuuauuacacacuuuuucucaccuacagcccaagaguguucgcuggaugaugacaccauucuaaucccaauuauaguuggugcuggucuuucaggcuugauuaucguuauagugauugcuuacguaauuggcagaagaaaaaguuaugcuggauaucagacucuguaacacuaaucaauacgugaucucuguuacaaaagaaaaaagcaaguacaaguuccaacaugcaauacuggucaacuuaagguauauuuaguugcaguccagcucuuuagaaugggugguaugggggauuucaaacuuaaacaaaaaacuaucaacuacaaauuaguugccugacuuugguuuuuccaaccaaggaauuuaaaacuguuauuuuuacagcaaaagaugugcaaaaucacuggauuauaaguucuauuuuacugucuugaauuaguauuucaguguuuucauuuuagacauucagacuaaaaauacaccguuuagaaaaaacaauuuuugaaaaagagauuuuuuuucccugcagguaguugaguuggaacaacauguucuaccguggauuuguacuugcuccuuuugcucuuuuugugugugugugugugugugugugugugugugugugugugauuuuuguuugcagguuaacuuagcuacuuuggcauugcugcauauuugaccuuugagagauauaauaguagauuugaacaggggcugguauuauuauguucuuagcaauaaaugcuuuucuaaugccuuuugaauacauuuguauuuauguggcuguaaugacaaaagauacaaaagcuuuuuaaaauuuagaguagguauuaaucuuauuguuuaaucuuuuuuuuaaaaaaacuggauauuucaaucuuuuaaauugcaauauauaagacuauuccaacugggcauuucaauccauuuuuuaggugcuuuagagauaauugcuugccagugccaauugagggcauuaguacuuugugcucauaaauuggccucuguaugcaguacuaaaauuaaugcagauuucucuuuagccuuccaacauuucuuguugauagugauguauuuuauuauuuucuuuuucuuaagaaaugccaguguguccuagaaccuagauaacgaagugcacuuacacuuauaaaauaacuugcaucuaggcugggcguggcggcucacgccuguaaucccagcacuuugggaggccgaaguggguggaucacuugaggccaggaguuugagaccagccuggccaacauggugaaaccccaucucuaucagaaauacaaaaaauuagcugggcgugguggugggcgccuguaaucccaguuacucgggaggcugaggcaggagaaucacuugaacccgggaggcagagguugcggugagccaagagcgcaccauugcacuccagccugggcgacaaaaacgaaacuccaucucaaaacaaaacaaaacaaaacaaacaaacaaacaaaacuugcaucuaaccaaaaagucuugguuuuaucuuaauccauuaaaaaguuguucuuuguuuccagcuugcauugauugcuacaacaucacuaauuuggcuuucacauuuaaaugguucugugcuaaucaaaacuuucguuguuauuauucauuaugguagaaucauuuuuaauucacgugcuuuguguucaguuuuguggucugagagauguaccaauugucaaauuaccguguaccaccuaauguuuauaggagaaagcaaaauacaucagcuugguaguuaacacaucaaauauuucuugcugcuucuaggagaacuuuuuugguguguguuggaauggcugagcaaauauuaaaauuguuaauaugcagccauauauggaagguuccugugggguuguuuuuucguguuuuuuuuuuuuuuguggugggauuaugugccucccauucacuagaaaaugagaaaauugucuggguuccaaaauauugacauugaauggaucaauacacacacacagacauauauauauauaugcacacauauauaggcaguugcaugcuagcauggguauuuuuauaacaauauaacugaguuauauuggaauuauaaauauuuuccgucacuuaaauuuguucuuuguuuagccugaaaaccuuuauggcucaagaucagauuccugacuaaccccucucuuagagcuacagcgagcugcauuaccagcuuaaaacacuucuuagggauuaaauauagauguaauuuuucaaaaucguuuuuaauuuaaacuguguuuuaguguaaaauuguuaaccuuguaagauggauaauguguauaagaauguaggccuuaacuauuucacaugagucaaaacaaagcagcuuuaaaaaaauaauuggaagcacaagugcauggcacugacugaaugcuguuaauauuucuaaaaguuucuacauucagauuauaugccugauucauaguaaaauaccucuaauaaacacuguuuuauagaaaaccugacuucagugaauauuuuuguauuuuacaugggccaguuuauauacugcuauuuacacuauuauuuccuauagcuacauguucuuuguaccuuuuguaguuuuauuuguauuacuagauucauaccuugaugguaacgcucuaucugguuuuggguguuuuucauguuuuagcauuuguauaaagaaacugguccauguaaauacuuuccauguuuuuucuucaaauguuuaaaccacuaguugauguaugguaucuuuagauauuugccugucuguuugcucaaaauugcuucuaaaacaauaaagauucuuuuauuucuuaaggcaauuugcuuaccuuuuuucccguugguuaaagucaagauuuuguauacuacauaauggcaauuucuuucaaauggaaaaacuuuagaaauguuuagaaguagaacugaauuauuugcaaaauguucugauguucugucuguauauuaccaucuggaagaauagucccauacauaggccucgauugaugcuaggcaggcuacagaauaagaucaaccugggaagcguuuuauaaaaauagauuccaggcugcauccuuagaggauuuaacguaguaggucuaaugaggagacagagagagagagagacagagagagagagagagaguguguguguguguguguguguguguguguguguguguguguaagcuccccugcugaaccugaugcauagucaguuagggaaccagugaucuagaauauuuauuucauaauaaaagcugcggaguaucucuuuguacacuuuucucaauuccuaaguugagguugauauucaauaucucuacauaguagcuuuacauugcagccauacauauugagcuauugaucugaaccaacguaggauugugugcagucucucucuuacuuagaucacucuaaaauacuugagccuuccaguuuccauauacggauaguuaccuagucaccuuacuauaucacauaagaaaacuuagcaauguagcugguaacuuuucucugaauuacccaguuaagccaugugaaugccaguuagucaucacggcugcaaacucugcaguuaacuaccauugucuuuggccaaguuguuuaacuucuagugucucaauuucuucauccagugggugggggcuuuaaaauccugcuacucauuucuuugagugauaauuugcauuucagaggaaugcaucauaguauuucauacaucuuaguauuuuagaaggaaucugauaagcuacuuguuacguaucaagaacauacuauaaguucaguguaaaauguaccacuuaaguuuccugcaguuuuucaggaggaauucuuauaagacuuggacauuuuuaagaugauaguauuucaucuguuuauuuagguagauaauguuaaauugucuugggcucaucuuccacccaucuccuuuucuuuuacccugguagcuaacuuucugcguuaauaaucaccauuucuuguauuugaaacugguauagauauucaugaaugauauugaguagcuucacgaaucuuuucagaugcaugugauuuacuuaacacaguuugauuauagauauaaaauguauauaacaaaauaucaccuaagaaugugcuucuuaauguggauccuuccaaaaagaaguuuugacucguuuguuuguuuguuuuguuuuguuugagauggagucucgcucuguugcccaggcuuggguguguauaguggugugaucucagcucacugcaaccuccgccucccagguucaagcaauucuuaugccucagccucccaaguagcugggauuacagacgagugccaccacaccuggcuaccuuuuuauuuuuuuaguagagaugggguuuugccauguuggccaggcuggucucgaauuccugaccucaagugaucugccuaccucgaccuccugaacugcuguuauuauaggcaugaaacgcugugccuggccucaacugguuuuuaagagaaguuuuauuaguuuuuguuguaaauguauaccucagcuuuccaguucuuguguugaaaauuguguuugaaaaaugucugaacuggcagaaaauugaagauuaacagcauuuuuaaucuacaugaaacuucuuacugaaauuuuaguggccauggaacuuuuuaaucuuuaaaaaucuuuauugcuucuguggcuauuaaauucuucugcaaauacacuucucuuuuccccagaagcauuuucaauacagcguuaaguauacauuaggcaaguagaucagaucaaaaugacuuauaggaugagauuuucuuuucuucagaaugugaucccauuaaaguuacuguuuuaccaacauuuuuuccauuaacuaaauaauuuuuaaagguugaauucauacaaucaauaguuauuauaaauuaauauuucacauacuaauugagagcauuuuaaguaaaugacaguaucuagaaagaucuuuguauuagcggaauugccuuuuugagcuacucugagaauauuugucuuacaugaaagccuuauuggcaguauuuaugaaagucguuucaguacuaggucaaauacccaauuugggaaagagagaacuaugagucuguugccagaauaagaaauuaaucuacuaaugaauuuuuaaaaaaccaaguuauauuaaacccacggcauaauacuuuaugguacaugucaccuaauaguuuaugggcugggugguaauuugggaaauuguaggggaggugcuaacuggggauucuuaacaccaucuauucacaggucacaucuggcagccucagcucucuggauucuuaacagaaccaagaagcaaguaaaacaaauaauugaacuggcagcccaagucaaugucagaaaaguuuauaaacuccaggguugcauuuuguuccuaguuauugccccagaggcuagugggggcggcggggaaagcuuggcacauuucuugaaugcaagcacaaucagaauugccaugcagccuauuuguccuaucuuugauacaauucuaauaagcuuaguuaucugauuuaucagucccugguagacugcaagcuaggcagagaacuagggcaacaagacacaggaaaugggaaauagaaauagcaguuaacuucuuuccugcaaguguauccaucuguagcauuccuuccuccucuccagucucagaguagguuuucuuuuccugguuaaacugaggcaaacaguuaugucaucaaggcccauuuauaucucuuuucccauuacuaagugaccccagauuguuauguauugaguucuuaaugucuuacgcuuuuggaauucaaucucuuaacuuguaggagaacuuguaccauucagcaucuucugucaauugcuaauggcuguuucccucauccuauuuaaguucuucuaaccuuaagcuauccuuucuugucccuaugucccccuucuaauuaccucccuuuuguccugccuuaaucauucuaaacuucucaaaaugaguauuguauuuguuacccugcccaaguucuugauguccuaaccaaucacuucccauucccucuuaaaccugcagcaauuuuacucauaucucccacccuucauauugcuagaggcaauggacauguuucaaagcuuucuacuauuauuugcugucuuuccaccuuaauugaaacguuccauccuuagcuucucuggcgccauuuucuaucugcccuuuuacaucuuuuuccuacuccauugucuaucccacagguauugguguucccaaggguuuuugucucugauccucuuuuuauucuacuuccccuuacugagaaauguucuugcccauguuuuaacuaccacuuagguucauauagccacuugguuaggacauagugauuuuuuuuuuuuuuuugagauggguucucgauaugcugcccaggcuggucuugaacuccugggcucaaacaguucucccaucucagcuucccaaguagcuaggacuacaggcguaagcuaccaugcucaacuaaggacacagauaucuuaaacucacauaucuaaaacugagcaucucucucuuccacguauccuuuuuaccaccuguuccauauaacuacaaaaaacugaaaugcauauauucuuccucuuuuauagaauggcaccagcaucuacauaaucagucaaguguggaauuggaaaccauucuauuaucuccuccucguacacccccuacauccguuuggucaauuuugccuucuaauuugaucuccagucugugccuucugcuuuucuucugcacuucauuaauccagcucaggacaauauuauugguuaccuggacucuagugauaaagauauguccuaccuuacuaccuccaucugccauaacuucugaaaugaaauccugcuuaauauccugcugcugaauuuuuuuuucaucaggauaaggccagacuaccuaagagcauauaguaccuuugugaccugggucccugcacacuuuuucugccuucuauccagccaaaaauaccuuuugauccauuguucuagcucugccaaccugcuugcguuucccuugaagugcuaugucuuuuuacucuccauauuuuugucugugcuauuucuuauaccuggaaugcccuucccccauuacuugcaucauuaauuccuauucauucuuaaaaucucagcucaagugucaccuuuucaaagugugucuuauguaauaaggcugaacuugagugugccucugaaauuuuuccauggcacuuuguguugccuacuccuaccacaacacauuuugaaauuauaaccacugauuuuucuugucugacucuaacacuagacugagcaucuugaggcaaacaguuaugucaucagggcccacuuauaucucuuauaucucuuuucccauuaguaaaugaucccagauuguaauguauugaguucuuaugucugcuuuguauaguuguucauucagugaguuaauacuuaacagcaauauuugaagcauugugcuucuucgacaucauaacaguuugccucugaaagcucacggccugaucaucaaggcaaggcuaauuagauuuguucauuauguucuguuuaagaaaucugggaacuaugugaccauguuauacauuuuucauccaaaaugacugcauuuuuacuugguacuuaaaaguguauuauuugguuauuuggaaaaucacuuuuguggaacaucucauuugcugauaaugaaaugccaaugacuuguuaccuugguauaaaaaaccaaaauaugcguguuaggaagugcugucauuuuacucaaaauacacagauuugaaaguuugucacuguuucuguucucaauuguccuuucuccacaucuagcucaagacugcagugcagaugacgacaacuuccuugugcccauagcggugggagcugccuuggcaggaguacuuauucuaguguugcuggcuuauuuuauuggucucaagcaccaucaugcuggauaugagcaauuuuagaaucugcaaccugauugauuauauaaaaauacaugcaaauaacaagauuuucuuaccucucaguuguugaaacacuuugcuucuuaaaauugauauguugaaacuuuaauucuuuuaucaaucccagcauuuugagaucagucuuuauuaauaaaaccuguucucuuuaaucagcuuaaaauccaaagugucauauuuacugguccuggagacaaacuuguucaaaagaacaucaacgugcaauguuuuaaggucuaucuuaagaagcccuggccaaauuuugauccuaaccuugaaguaugccuugaacuuauuaacauggccauuauaagaauaaaauauguaguugugucuuaauggaauuaauaaaugucauuucacuacugguguucuguuucaauguauaaggacuauagugauuuaaacucaucaaugugccuuugcauaaaguucauuaaauaaauauugaugugguauaaaugcccaucagauaugcuuaaacuugguuuucaguugaaugaaguagagaauguccucaggaccaucagcauuuuaaagguuaugugacuuuugcugauuucucugaguucaaguuaagcaugaaguuaguaccucaagccugugauuuuucccuagggaugauacagacccaagaggcuacaacagaacuuaaacuggcuucguaauuagaguuuuuaagauaauuguuuguuuuucagcaauauagacugaaaagauccaagcauauuuagccacuugcuuuuuuguuucuuguuuuguucuucuuuggaugccugauuaguauugaaagauagaaauauucuaugaacuaauuaggacagauuguguuguguuucucuaccucaucuuguugaucucuggagcauuaaaaucuauuuaguguugucaucagugugguacuuaugaaauguaagcuaacagcaaucucagaagggaggcagugaagcauagcaacuaggcucuuguuucuucaagauggccccuguggggcagugcauagauggggguguaaagagaagcuguuggcauuaaaaugagcuagauaaucagcccuuguugaagcauauuccaugguauaagaguagcacagacaugaaacauagauaaagaaggaaggcuuaauagacuagaagacuuccacauugaaguauuauuaacccauuguauguauauaggggcaugaucagagucucuauaacuuccugauuaacaauacaguguaucuuguuacccagcugucagucuuugagagcuuucaguaaaauauaguaaauucuuucagcauaggcuaaugugugguuacugagaugaguguuguguacucagaaccguagcaacauuuuuaugaaugguaaaaguacaagaggaggaaaaguuaaaauuagaagaaaaguacaaguuauugcuuaaucauaaaucacaccagauaacacauuuuguuaauuucauuagcuauuacuggaaaggaccuuaacgauuauuuacagaaaggggagugaaauucauugagguuccauaucaagugggcaacaaaacuauuacuagcauuuugauaaaaauugccccuaaugaaaucuagucacucaacaguaaaacaacagcugguuuacacuugaaauuaugagaucagaauugggcacuuugggcuuccguacuauguuuugcuuaaguuuuuuuuuuaauacuaauaugggcuuuuucaguaguaauauaccaaaacacuucuauuuuaaucucuguuugcuacuucaaaaccuaauccuccucagaugggaucaugagcauaagaggaaaagagaagagaaugaauacuuguugaccucuugauguguaucagaugcuuuagaaauguaauuguauuuaauccucaaauaccuuauagguauuauuauccccuucuuacagaugaggaaagugaggcccaguuuaaauaacuugcccaagguccuuuggcuaguacuggaaggagucaagauuuaaacacaguucugucugaauccagaacucaaaaucuacauugcacauguugcuuuccuggugguucgguggaauggacugcaacgcauuagauacugcuguuauucuuccaggccaccgcucagcuaaaaauaauuguguguguguguauauauauauauauguacacacacacacauauauauacacacacacauauauauacacauauacauauauauacacauauauauacacacacauauauauguauauauauacuacauucuugauccuaagucuuuuuuaacuuaaauuuuauuacuuauacagaauucuuauuuauacuuuaauuauaggugugacgaagagaaagagaguagggaaauacacaggcagugguuuuaaguguagaugauggcuccuuaacccagugucauuagauaaucaaaccuaaagucuucccauauuaggcaagcgcaauucucuauuuuggacccuucccauucuucccuuaccuucugcuuuucguacugaggaauuucgugugauuuuagauaaagugauaaugagauauugagcaaauaagaaaauagagguaaugcuauaaaaaacuaagcuauguacacuuucaaaaugcauguuucuugcaugcuuuuuacuacuuaauugcauucuuugcuaauuuccuuuccuugcugucuguucuuuucuaacagcugaagaauguucugcugacucugaccucaacuuucuuauuccuguugcaguggguguggccuugggcuuccuuauaauuguugucuuuaucucuuauaugauuggaagaaggaaaagucguacugguuaucagucuguguaaucaguuaaaucuaguguuuguuuguuuuuuucaauuagaaguuacguuuccauuggcuaaaagccaggacaugcugugcaauagauuguuuaagauaugcagacuaacuucagugaguuccuagcuaacuugggcaugaguacacuuauuuaagacaaaauauauuaggaccaauuuuuuucuguuuuuuuucuuccuuuguuaaaguauaauuaaaagaaaaauuguggcuuagaauuuuuuaaguaaauaaugauuuuaagccccuggauccaauuaugaaagcauuuuugcugauguguaauuuuauauguuacaguuacuuauauuuuacuacuuugauguuauuugcaaaaucaaagguguuaaagaauuuaacuugcuucaggaaauaaauucaagaacauaguggauucauuuucauugguggcagacacgaaauuugguucaugauaagacuuccuuuccccaccuccugaucagcauuauuuaaaucuguauuuuucuguuaguuaagaaagaaauggcuucaugauauuguauuuaauagcaaaaguuuggcugucuucuucauuacuguuaauagcuacuauauuuuaacaaggagauuucuuuuuuuguuguuguuguucuagaguuuggaauauacugauuaucucagacuugacauuuauacugaaggaugaaguaagaccuccagcuuuuuuuaaaaaagguguugauuuggaacaccuguauggguuaugguuuauuaagguuaugguuuagaaaguuuuuuucccucagagccuuaacuuguuaagaagguucauuuauccugcacugaaaacaaaaacucuauauacuuuguuugugugccuccugcacucucccauucccuaugugaauaugcucuaguugauauuuuuaauauauugauuucuuuuuucucacagcaacaagugcuuacucuagagguuagugggcccugauaugucaucagucagaugccugccuagccaaagcuggacuaagauuauucuguacauuuguugaucuugauauagacuuauaucccuguagggacugcuaauggcuccggcuucuggaguaagguacuggagaccacucaucccugugucugcuugauugguucagcuguugaauugcccuuuuauuuggaagcaguguugaaguugucuaggguucaaauggcugcuuuguacaccugucauuaguauaaggcagauguuuauuuuaucaagcuauuuuaucucuacauuuaacuaaaaacaaaaguucccaaagaucugccuucacuucagaaauuuuuuuuggauuaaaaaaauuaagccugaaccuuaaauaaagugaguugguuauucauuccaaggauuaagucccaaucuaccucucagcacaaugcagaagcucaccacuguauugcugccauuaacucaugccagaacccuuugccaauaacuggaauuacaaauuuuuguuaaagaaaauuuaucaagaucuuucuuuacugccuucucuauauguacaucucaaaaacauguacaucucaaaaacuggaguagaaaguuagauugcucaacuacaacuccucuagaacucuauagcucugacauacagauucacacucuccucuauuugcuaaguauguaaagaauguuuucuuuuaaaauguucucuuuugagaacaacugcuuauuuguuauaaaagcauuugguuaaaaugaugucaucauaaaaaacaguggcuuuguuucaauacauauuuuugagaugauuaucuagaagccagauuaauaaaaucagcuugugaccuugcuaagcauauaaacuggaaauucagauacauucaaaauuauggguucauuuaaaaguguucuaccuuuuggguaugagacuaauaucacuaauuccucaauaguuaucauggcucuaucuuaauuaauuagaaaauauguguguuuaauucuuugagaauuaaaauagagaauauuaacagaggguuaaaaacugcuucaacuccaauaagauaaaggaagcucaaaaucuaugagcugaguguucaauuagcuuugccuacugaguucaauuuuaugucaauacaacaguggaucagacaguacgacuuugaacuggugaauguaaacaauuguuuuucaccuaagcugcuuuggaagaacugaugcuugcugcuaacuaaaguuuuggauguaucgauuuagagaaccaauuaauaccugcaaaauaaagcauacugugguacuucuguuugaucuaguaugugugauuuuagauugauggauuaaaaauuaauaaagaucauacauuccauacca

SEQ ID NO: 192820 - RNA, 132493 nt, Homo sapiens
acauccgggcuucugcuacuagugagaggaagauggcggccgcggcuguggugguucccgcagaguggauaaagaacugggagaaaucagggagaggcgaauugugaguguucgggccggaggcaggcgcacugccgggccgggccagggcgucagcugcacucucaccuguagugggagguugagggggaaagauguacccccucccccacccgggcggcgggcguggauggucgucuaggaguuucgaacucggggagaggugcuguuuaccgccgcggaccuccuuccuucccuggccucccagaaaucgcuacugccugcgguagcucggcuuccuuuagccucuuaguagaacucuuauuccgccccugcaggucuccgcgcucccucuuggucucuuuuugugucccccucuucgcuugaucucacuuggcuccuuuaucuuuauggggcugagccggggcaauucggacuuuccaucucucucugugccauuucuucacucugcacccguuggacuccgcaguuuggagcuuggcgccuccucugccugaaguccaaggagggcgaaccgucccggauuccccuccccuccucuucgcccgcugccgcgaagcccggggcgccgcgaagaacccgguuuggcaccucucgcccucccggggagcggucucucgacugucccggccucgcguagcgccguggggaaguguggcagggauugccgcuuucccugaagaaccaccgacauuucuuugcuccgucuuuucaccuuagagcuauuucggguuggauucaacuuucgucauuaaauguucccuaaaccccauuuuauccugggacugcaacuaauucuggcagcucuccaagcuucuccaguaccuaggauaacgcguuuccuuuagucgugaaacuuucccccguaacaccgaaaacaguaauuugccauaccccuagucuucucgcccccacguuagagcgcucccuccuccccuuccccuggaaggagucguuuaagcagcaaagcaaaccucagauauaagaacaaauauuaauaacaucucauuuccuucucugggucgcuuuuagaugcuaaagcucaacccuggaugaaauuaacccucguuagccauuuuugucguccuugcccaccccucuccauuucuaguagccaguuuaccguggcucaugcuaaagauucaaaucuuuguaacuucguuacuuggaacgaaacacgaggaacgcguugccggaucccgcgcuuguaauagugccagccuauguggcuuccucccccgcaccccccgcacugcuguaugaagucuuaacagugugagcucuagaauucccuaaauaagcggcugucuuagccacuuaaguagcugagugaccuuggguaaguuccuuaaccacuuggacuguuuccccuugaguaaauugggaauaauaaguacucuacucaaaggauuguugugaagacuaaauaaugccuguaaagcacuuggcuuauaguaagugcucaagugauagcuauuaaaaguaauauuauuccaaccuuuagauauuuaaacuucucaggacagcucaugcacuuaaagucuguaccacucagguuagcaauuaauuggucucugacuuauucauguguguuuauucuugcacuguaaugaauugggaggccuuugaaauauagggacuaugucucauauuucuuuugguuuaacacaugccccgcccccccagccuaugcuuagaaugcuuauugguuuauuaauugucagagaaggcuauuugauaaaucuucguuuuuaacuauaaugaacauuuuacaaauccucguaugugcuaguuaacaaauagcugucaaguuugauagcuaguugacaaauagccaucaaguuuggggaaggcaagaugggaaguuacccagccagaccaucaucuucaucgauauuaggguaaucccccaaaacugauaaaagcaguucauuguuuuguuuacuuucaaagccagcucauuuauuuaggggcuguuauguuuguagauugcucagcuuccuccuuucagcuacuguuuuuugacaguuuuacuuuuuuuuuucccccuugagacggagucucgcucugucgcccaggcuggagugcaguggcgcgaucucggcucaccguaaccuccgccucccacguucaagcgauucuccugucucagccuccugaguagcugggacuacaggcgcgugcuaccacgcccggcuaauuuuuuguauuuuuacuagacacggaguuucaccguguuauccaggauggucuccaucuccugaccuggugauccgcccaccucggccucccaacaguuuuacuauuauugcugccaccuuagcaugagugguauuagggcuauaaggugaaauucugcuuggcuucugacugguaaugguuugagaaaaagugauguaggagaucgaaauacuuagauaaaauggaauuuuagguucacauuauguauauuuacauaauacaugcuaucugucauaguucuuauguuugaagagcugcuuaaaaacuguuauuagaagccgagcgugguggcucacgccuguaaucccagcaaauugggaggccgaggcggguggaucaccugaggucaggaguuccagacaagccugaccaacauggagaaaccccaucucuacuaaaaguacaaaauuugccgagcgugguggcacaugccuguaaucccagcuacucaggaggcugaggcgggagaaucgcuugaaucugggaggcggaaguugcggugagcggagaucgcgcuguugcacuccagcauggguaacaagagcgaaacucuuuaaaaaaaaaaaaaaaacaaaaacccaaacaaaaacaaaccaaaaacaacagcaaaaaaaccuguuauuagaacuuacguguauguaguuauugcaugacuuguggaauguggauugaauuauaguagauccaaaucaguauagucaguuuuaugauugcauucuguuacaggaagagaauuuaaaauuguguaacauaauaagcuauuuuaaauaguuaaacacaucaccauccaguacuuaguuucaguuuauuugaccuguuuucccucuaugaaacuuuguugcauauagcaugucuuuggaguuuuugugucuuccuaaagauagguguuagcauuuucauauuacuaggcagaauacgugguggugcaaauauauuacaaaaaaccuuuuuccuuugucugaaaacagcuucugaaauauaaaacagcaacuggaaauguuaaaaaugaagguagugugccaccacauuauuagugaagcuauagauuuggcguuuagaauaugaccaauauuuaaaauuauaccuugggugaauuuuuccuuuuuaacaagauaaauuagcagauaagcuuuaacuugacugaaaauuaucuuuuuaaaaauaaugugauauauuucaugagguuguuaauucauuucuugucugucacuucuuaccagcauaaaucuuuucugggggugguagucagcuaguguugaaagcaacauaagagauguauggggcauuuuauaacuuucagauagggcaaauucuuaacuguacgccaugaaaaacaacugucuauuaaauggaaggucuugacuuugaagaauguuuuauuagguaauuagagagaaaaguaaaacuguauuuugccuaucugaaugguccauccaucacauaucuagauaucccauuauguuuccagagauaccaauuauguuuuuaaugcuaaauuauagaacucuuaaagagugaccuuuaaagugaucuuaaagagggaucagaagggcaaaggaggacuaccaaaauguaauuguaauuuccaauaauacuuauaucuaaaugcaaacucuuccaaauucugaaagauauguauuuaaucacuuaauuuuggaauuaguuuuaguuucuugauuauuuuauauugacguagaacuugccaugaugaagcuaauaaacuugcauguacugguagauccaguguagaauucuguuuuugguagaaaucauuaacacagugaacucagcauuucuuuguuacaggcaaccuuaauggagaauugauauucgaagcucuuaaucugaagaugcuagccucauguuaauacuuagucuaauuuugaaauacuuacguuuguugaauaucaucuguuuguuugaauagcuuauuuagguaucaauuagaaaguuuuguuaggucuuaccuuauuaaugguaguuacaauaaaguuuuaaaauuuaauugccaaauguuuugauuguuguucuuuuucuucuucugcuacuacaugauuuuagacauucuagaacuuauuuaaguauauuugguuguucagaacaugccaucugaucugaauuucuuggaggauuccagguaaagggauauaaucauucuaagaaauuuuagucuuggugguugagucuuuuuuccucgcaaaguugcuccaaauucagccaaagcuuuaucugaaaccuuuucuugaugucucaguuuucauuuagcauuuaauuucccauuucgaccuguauucauaagcuaaguauaagucuuagucuguuuuccugggaagagaaacauucuucacaaaauguugaagcaaugucaggagguuguauaggcuacuacuuuguuuguuaaaaaaaauuauucuguaaugcucuaacguuuagguagggugagugcugucaauauacuugugcuuuuuuccuacuguaagugcggcaacuccuguugucuuuuuuuuuuuuaacauuuccuguuuccuuuucuuuuaaaugcauguuucuacaagauaaaacuguguugucccaguauucauuuuuguggguuauguuucuguucuacaaaugauaauagagguagcacuuuauuuaacuacauuuaaccuuuuuguugucuuguuuuaaagaauuaagugaagcguaaaugaacaucagccuucuauauaugaaagccacauuugagaugugagcauaaucaaguaguuuaagcuugugacucuguuuccuuuuuacuggaaaaugggaacaaguaagaugaaaagccguauacucauguuaagaaguauucacaaaauaccuuuuaaguccuugaaggaacuucagacauuuuauucaguuuuccauacaucuuuugacagaaaguagauucuguccucauucucagggaccugagacagcaucuccauaauagcacuaaacuauuuuaaaaguagaaaaaaugaaugccuggcgugguggcauguaagguggugugcacuguggcacacaccuguaaucccagcuacuugggcaacugaggcaggaggaaggauugccugagcccaggagagcucugggcgacauagcgagaaccuaucucuauuuuuauuuuuaaaaaauuaaauuaaaaaguggaaaaaugguaaacucaaguauuugaaaguuauuaagggauuaaaauaauuucaauuuggacugagacagaaaauuugauuauuuuuaagcgauauuaaagugggcaacuauuagagguaguuuuguuuuuuccucucccuauaauuuagguuagugaccuaaaaccauuaggcagguguauaguaagacaaauguaauguucagaaacaguuucuuuaagaauccuugguggacuucuauuagugaauuacuuagggagaagagcacagauacaucuacuuguuggggaaaaaucucaguguuuguuuuuaguuucuuguuauaacuaaggaauaccuguuuuuuuuuuauuaaaaaauuuauuuuuaacuaaguuuuuuuugagacagggucuugcuuugucaccuaggcuggagugcaggcgaucacggcucacugcaggcuugaccccaccaggcucaagggauuuuccugccucagccuccugaauugcuagggcuacaggugcaugccaccaugccuggcuaauuaaaaacauuuuuuugugcggguguaugaguagggaugggguuuugcuauauugcccaggcuggucauaaacuccuggcuucaagugauccuccccccucagccucccaaagugcugggauuacaggcaugagccacuacgcccagccaaaggaauaccucuuuuauacuagggaaauguaaguaucuauuaugcaaacaaauugccuuauuguaauaaccuuucaaugguuccauaugcaacuugagcaaaucuuugagauucuaacuaauaguucaugaugacauugucaucuguguccuaaugaacauguuuguagccuggugacugacaauauagaauuauauuucaauuauuucuuaaaguuauguaaugaugacuguaccauuagucuagguaggaguuugcaacacugaugcaaccucuuccccgcaaccauuggaaggcuuuuugcaaaagacaugcauuaagauuguuaaauagaaaugaaacuauugaaaaugugaggaagcaagugcauuguuauaaggagaaguuuuuuuuuuuuuuuuuugagacagggucucacucuguugcccaggcuggagugcaguggcacgaucuuggcucacugcagccuugaccuccugggcucaagugaauaaggaggaauuuuaaacaauuauuuuauuucucuuucuuucucauccuuuccuuuuccuuuccucuuuuucuuuuuucucuuuuucuauaugaaggaauauuugaaauugcauuuuaguagcccgaguacaaagggaaagaugaguuacuuuauucuguuaaauucuucuuucaaagacauggugcuuccugcuauuauuauuauuauuuuuuuugagacagagucucacucugucgcccaggcuggagugcaguggugcgaucucgacccacuacaaccuccgcuuccuggguucaggugauucuccugccucagcuuccugaguagcugggauuacaggcauuggccaccaagcccggcuaauuuuuguaguuuuaguagagacgggguuucaccauauuggcuaggcuagucucaaacucuugaccucaaguaaucugcccuccucggccucuuaaaagugcugggauuauaggugugagccacggugccuggccccugcuauuauauucuaaagagaauugacccuauaagggaaaugagaacccaaagagggaauuguuuuaauacuucauaguaaauauugaagcaaccuugauauacuuauauaucuccucuccacaaaagaccuagauggcauuuuuagguuauaucuucugaugcuagucugaagcagauguuauuucuguguugccugguggaaggaagauugauuuuguuuuauauuccagauaaacuuauguuagguuuaacguauuuugugaaauuagaagcuuaaucgugguuuuuuuuuuuuuuuuuuuuuugagauagggucucacucuguuccccaggcugcccaggcuggagugcagugguacuacgaucaccacucacugcagccucgaccugcaggcucaagugauccucccagcucaaccucccaaguagcugggauuauaggcaugugccaccacacuuggcuacuuuuuuuuucuauuuuuuuuuuuuuuuuguagagauggggucucacuuguuggcuaggcuggcuaggcuggucuuguacuccugugcucaagugauccucccacuucggccucccaaaguguugggauuacaggcaugagccagcauauccaacuuuaaccaguguucuuaaccaaccacuguucucuucucaacccauuagaaggccugucuaguucuccagggaaguaguugaaaguacuugggaucaaacuuaaaccagcuuaccauuuguaagguacucucagaauaauuuuuuuagugagaaauguuuaauagcuaaaugacauuuucuuucuuuguuuuuguuuuugagaugggaucuugcucugucacccuggagugcaggcuggagugcaguggugcgaucauggcucacuggugugaucuuggcucacugcagucucaacuuccugggcucuggcgauccucccaccucagccuccugaguagcugggcccacaggcgcgugcuaccaugcucugcuaauuguuuguguuuuugguagagacaggguuucaccacguuacgaggcuggucuugaacuccugagcucaggugauauuaccaggcuggucucgaacuccugagcucaagugauucacccaccuuggccucccaaagugcugggauuacagacgugagcuacuaugccuggccugacauuuucaaacuaaauauuuaauuuaguagaugcucuccauugcccuuauuuuuuauuuuuauuuuuucugagacagagucucgcucuguugcccagguuggagugcggugaugcagucuuggcucacugcaaccucugccuccuggguucaugcgauucuccugccucagccuguagaguagcugggauuacaggugcgcaccacugcguccagcuaauuuuuguauuuuuaguggagacgagguuucaucauguuggccaggcuggucucaaacucuugaccucaacugauccacccaccuuagccucccagaguucugggacuacaggugugagcuacagugcccggcuuccauugccuuuuuauuuuuugguuuugaacauauuugugaaaccuagaagugaauuguugaccagcaaaaguuuacucuguugacuuuuaauaaccuuacccugcucauccugaugauaggguauugacauaaucagaaggcacagaggugagcugcaagguuauguauaaucugcaaaguagauaaucucucuguggaugauuguaaucuggcaucuuauuuagccuuagaugugauauauaagcagguucuguaagucuuaaaauuauuuguuucauugacuagaaaaaggauuacuagauauaaaagaguaagaaacucuucuauaugaauucauuggcucucuuuaaagccuugugcaacauggaagaauuuuuuucuaaauugugaaauguaaugaaaauacagagaagucaugaaaccucaauauagagcuuaaaauaaucacuguaagaugcacccccauguaacuuacacccaggucaaggcaacauacuguuuguucccgaucaaaccuuucccaccucucauguaguaaacauuauccugacauuuaugguuuuccucuugauuuuucucuuuuuuuaaccuugcaucuucaacucaaagaaacuuucuugauuuucuuugcagugucauuacccaauauguuuaauuuuuuucuugaacuucauauaaaugaaaucauugaauauuuauccuacuguuucuggcugcuuuuguucaacaguuaugacuuuuaagauucauccauauuguauguuugcaguucauugauuuuccuuuuuuuuuuaguucauucauuuucauaguugcaagauacuccaucguauaccaguauuuguuuauuuuuaugcugucuuguuaaacauuuuuguugcgucuaguuuuuggcuauuacuaacagugccaauagaaacauuauuauacaacaguuuugguguauacaagcauguguuuuuguggaguauauacuagguguagaaucucuggguuauagguuacacuuuagcucuguuagauauugccaggcuauuucaguguacacucccaccagcaguguaugaguugaccuuguuucacauugucacuauguuugauauugucagacuuaaauuuuuuguaaauauguauguaauuuuacuguggcuuauauuuccaugagcaucuuuuuauauguuauuggucauuuggaguacuucuuuuuuuuuguuuguuugagacagagucuugcucugucgccuaguuuggagugcggugguggcgugaucuuggcucacugcaaccucugccucccgaguucaagcgauucuugugccucagccuccugaguagcugggauuacaggugugugccaccacaccuggcuaauuuuuguguuuuuaguagagacaggguuucaccauguugggcaggcuggucuugaacuccggaccuccgaugauccgcccgccuuggccucccaaagugcugggauuacagacgugagccaccacgccuguacuggaguucuuauuucuuuuugugaaaggucucugucauaucuuuugccuuuuuuguuauugaguugcuugaguuucuuucacugauuuguagggguucuuuauauagucuguauuugagcccuuuuuggguuacacugcauguguuacaacugucauuuuuuuuuaauuuuaaguucugggauacaugugcagaaugugcagguuuguuacauaggcauacauuugccauggugguuugcugcaccuaucaaccugucaucuaaguuuuaagccccacgugcauuagguauguguccuaaugcucucccuccccuugcuccccaacccccaacaggcaccagugugugauguuccugucccuguguccauguguucucauuguucagcucucacuuaugagugagaacaugugguguuugguuuuuuuguuccuguguuaguuugcugagaaugaugguuuccagcuucauccaugucccugcaaaggacaugaacucauccuuuuuuaugguugcauaguauuccaugguauauaugugccacauuuucuuuauccagucuaucauugaugggcauuuggguugguaccaaguuuuuacucuugugaauagugcugcagugaacauacgugugcaugugucuuuauaguagaaugauuuauaauccuuuggguauauacccaguaaugggauugcugagucaaaugguauuucugguucuagauccuuggggaaucaccacacugucuuccacaaugguugaacuaauuuacucccccaccaacaguguaaaagcguaucaucggcagcaaauacucuguuguuuuccuugaagugacaggcucacuugguucaguuuugagaaaaugccugugaaagacccaugucuuaaaaaccauaguuugcuuuucuuucaaguaaaaaaugguguuucauaaaaacaagcuaguucagcuugcaauucaaacaaucgcacaagugcuuuaccuguagacaaauacugugguuguauuuggguguguggcagaaauuauuuaugcaaccuuuuaaauuucaucauauaggcuauugaaaggauguguuauuuuuuaauuuuaauuuuuuuuuuuuggagauagagucuugcucucucgccuaggcugcaguguaguggugugaucucggcucacugcaaccucugccuccugaguccaagcgauucuccugccucaggcucccgaguagcugggacuacaggcaugcacuaccacgccuggcuaauuuuuguauuuuuuaguagagaugggguuucaccauuuggucagacuggucuugaacuccugaccucaagugauccgcccuccucggccucccaaacugcugggauuacaggcgugagccaccaugcgagccaaaaggauguguucuuaaaaaaagacaugcuugcccaggcacaguggcucauuccuguaauuccagcaguuugggaggccgaggugggcagaucacuuguggucaggaguucgagacuggccuggccaacauggugaaacuccaucucuacuuaaaauacaaaaauuagccaggcauggucgugcacaccuguaaucccagcuacucaggaugcugaggcaggaggauuguuugagccugagagguggaggcugcagugagccaagauagugccacugcacuccagccugggagacagagcaagacucugucucaaaacaaacaaacaaacaaaaaaaaccagcaacaacaaaaaaaccccaaaacaacauguucuuaggguucaggauuuaacaaaauuaacaauuuuuaaguaacuuuuuuacugugguaaaaaaaaacaccuaacaugaaaucuaccuucuuagcaaauuuuaagugagcaguacaauauugucaacuauaaguacaauguuagcagaucuucuccugaucuuuuucaucuucuaugagcugaacuuuauauccauuauacaccaacuccccauuuuccccuuccugcagccucugacaaccaccauucuacuuuuugcuucugaguuugacuacauuagauacuuuauauaaguagaaucauacaguauuuguccuguggcugucuucuuaccuuagcacacuguccuuaagguucauccacauuguagcacaugacaggauuuccuucuuuuuuuuauggcugaauaauguuuacuuucauagauauacaugacguuuucuuuauuugcucuucuguugguggacauuuagguuguuucuaccucuaggcuauuguaaauaaugcugcagugaacaugggagugcagcuaucucugugcgauccugacuuaaauuuuuuuggauaaguacucagaaguaggaaugcuggaucauuugguagcucuacuuuucauuuuuugaggaaucucuauacuguuuuucauaacaauugcauuauuuuauuuuauuuaauuuuuuucgagagauaggcuuuugcuuugucacccaugcuggagugcaguggugcaaucauagcucaccguaaccuugaacuccugggcucaagugauucuccugccucagccuccuaaguggcugggacuauagggaugugccaccaugacccgcuaauuuuuaaauuuuuuuuguagagauggagucuugcuggguugcccaggcuggucucgaacuccuagccucaagcaauucucaugccucggccuccaaaaagacugggauugcaggugugagccacaugccuggccuauuuuuuuucuuuuuuuugagacaaggucucacucuguugccuaggcuggagugcauggcaugaucucagcucacugcagccuugaccuccugggcucaagugauccucccaccucagccucccaaguaacugggacuauaggccugcaccaccaugccgggcuaguuuugucuauuuuuuguggagaugaggucucuuuguuacccaggcuuauuauuuuuuauuuuuguuuuugagacagcauuuugcuuuguugcccaggcuggagugcuguagugaaaucauagcucaucauaaccugaaaccccuggacucaagcaauccucccgcuucagccucccgaguagcuaggacucacaccacaaugccuauuucuuucuuuuuuuuuuuuuguagagacagggucuugcuauguuguucaggcugaucuccaacuaaccucaaggaaucuuccugccucggccuugcaaauugcuagaauuacaggcaugggccaccgugccuggcuggcaucaccauuuucuuuuauuuuggaaauauguuuuauuuuuuaauuuuuuuuuuuugagacagggucucacucuguugcccaggcuggagugcaguggcgugaugucagcauauguugauuguagagauggagucuugcuagguugcccaggcuggucucaacuccuagccucaagcaauucuuauccuuggccuccgaaaaggcuaggauugcagaccugagccaccacgcuuggcaagaguucccuuuuauccacaucuucgauacuuauuuuuugucuuuuugauaauagccauucugacaggugugaggugguaucucauuguaguuuuaauuugcauuucccuaguuauuaaugauuuugagguuuuuuuuucuguuggucauuuguaugucuuuugagaaaugucuacucaaguccuuugcccauuuuaaaauuggguuguuuucuugacuucuuuuuuuuuuuuuugggagacgaagucuugcuuuguugaccaggcuggaaugcaguggcaccaucucuguucacugcaagcucugccucccggguugacgccauucuccugccucagccucccgaguagcugggacuacaggcgcccgccaccacacccgacuaauuuuuucgaauuuuuuuaguagagacaggguuucaccauguuagccaggauggucucgauuuccugaccucaugauccgcccaccucggccucccaaagugcugagauuacaggcgugagccaccgugcccggccccuugacuucuuuauauauuuuggauauuaaccccauauuugauguuuggcuugcaaauauuuucucugaauccauagguugucuccaucacacuguuaauuguuuccuuuccuguguagaaacuuuuuuuuuuugagacagagucucgcucuguugccuagguuggagugcagugccgcgaucuuggcuuacugcaaucucugccuccuggauccaagcgauucuccugccucagccuccugaguagcuggcauuacaggcaugcgccaccaugcccggauaauuuuuguauuuuuaguagagaaggguuucuccauguuggucaggcuugucuugaacuucugaccucagauuaucugccugccuuggccucccagacugcuaggauuauagguaugagccacugcacccggccuccuguguagaaacuuuuuuuguuugauguaaucccauuugucuauuuuugcuuuaauuacuugagcuuuuggggucaaaucuaaaaaauuauagcccagaccaguguuguguagcucuuccccuauuuuuucuuuuaggauuuuuauaguuucaggucuuacauuuaagucuuuaauucauuuugaguugauuuuuguauauggugugaaguaaguguccaguuucauuguucuguauguggauauuaaguuuucccaacauucuuuauugaagagacugucuuuuuucccauuauguguucuugguacccuuuguugaaaauuaauuggcuauaaaugcauggauuaauaucugcgcucucuauucuguuccauugguugaugugucuguuuuuaugccagcgccaugcucuuuuaauuacccuaguuuuguaauauacaguuggcuggccuuauauuuaguggguuggcugcauccacagauucaaccaacugcagaucaaaagcuguggauauggagggcugacuguuaaguauuuuucuaucuacaguugguugaauccgcagaugcggaaccugcggacgcagaaggaugacuguauauaugccauauauaagggacuuuugagcaucugugaauuuggugugugugggagaugguccuggaaccaaucccccguggauacagagggccaacuguaccuugaagucaaauagugugauacuuuagcuuuuuucuuuuuguucaggauugccuuggcuauugguuuuuuuuuuuuuuuugguuccauauaaauuuuaggauuuuucuguuucugugaaaaauggcauugguguuuugauagagauugcauugagucuuuauaucucuucggguagcauggacauuuaaacaaucuuaauuauucuaaucaaucagcauggaauaucuuuucauuuauuugucaucuucaguuucuuucaucagcauuugauagcuugugguguauggaucuuucaccuccuugguuaaauuuauuacuaaguauuuuauuuuuguagcuauuauauuuuuauuuuuauuuuucucuuuuugccauucuugcaaugcuacaauauagcuauuuuaaauggaauuaaaaauuuuuuucagguaguucauuguuaguauauagaaacacuaccuauuuuuguguguugauuuuuauauccugugauuuuacccuauuuauuauuuccuuuuuuaaaaaaauuuuuuugccuugauggauacaguauauuuauuauuucuaacuuuaugguguagucauuaggauuuucuaaauauaagaucauuuugucagcagagacaauuucacuucuuuucuuguuuggauaacuuucauuucuucuuuuugcccaauugcucuggcaaggacuuuuaguacucuguuggauagaaguggagagagugggcagguaccugaucuuagaggaaaaacuuucaacuuuucacuauugaauauaauguuagcuaugggcuuguuauuuauggccuuuuuuuguguguguugaggaacauucauucuauaguuaguauguauuuuuuuuuugauauggagucuugcucugucgcccaggcuggagugcaguggugagaucucggcucacugcagcacugcagccuccaccuccuggguccaagcgauucuccugccucagcuucccaaguaucugggauuacagacgcacgccaucacacucggcuacuuuuuuuuuuuuuuuuuuuugagacagagucucgcucugucgcccaggcuggagugcaguggcgccauuuugacucacugcaagcuccgccucccggguucacgccauucuccuggcucagccucccgagaagcugggucuacacgcgccugccaccacaccuggcuaauuuuguuuuuguauuuuuaguagagacggagauucaccguguuagccaggaugaucucgaucuccuuaccuugugauucacccgccucggccucccaaaaugcugggauuacaggcgugagccaccgugcccggcccacacucagcugcuuuuuauauuuuuaguagagaugggguuucaccauguuggccaggcuggucuccaauucgugacuucaagugauccaccugccuuagccucccaaagugcugggauuacaggcgugagccacugcgcucagccucuauaguuaauuguugagaguuuuaucauaaggauauugaauuuugucaaaugcuuuuucggcaucuaaugagaugaucaagugauuuuuauccuucauuuuguuaguguaaugugucacauuuaguguauguuguaccauccuugcaucccagggauaaauccauugugaucauggugaaugauccuuuuaaugugcuguuaaauucuguuugcugguguuuguugaggauuuuuucaucuguguuuauaagaggcauugaccugugauuuucuuuucuuguaauguuuuugucuggcucugguaucaugguguaguagccucuuauauuccuuuuuguuucuguguaauugguuguaauguuuucucuuuuguuucuaauauuguuugaauuuucuuuuucuuuauugaaugucuagcuaaagauuugucaguuuuguugaucuuuuuuuaaaaaaaacucuuaauuuuauugauuuuuuucauuuucauuuucuuuuuuuuuuuuuuuugagacaaggucucacuuugucacccaggcuggagugcaguggugcuaucuuggcucacugcagccucaacauccugggcucaagugauccucccgccucagccccccaaguagcugggacuacaggcgugggccaccaugccuagcuaaguuuuuguauuuuuuuuguagagagaggguuucaccauguugcccaggcugaucuugaacuccugagcucaagcuaucugcccgccucagccucucaaagugcuaggauuacaagcgugagccaccgcaccuggcugauuuuuuuuucuucuuuaauucucuauuucaguuguuucugcccuaaucuuuauuauuuccuuccuucuauuaacuuuggacuuaguuuauucuucuuuuucuaguuccuugaaguuuugaguuaggugguuugagauuaaaaaagaaaaaggcauuuauaggccuggcuccguggcucacaccuguauucccagaacuuuguugggcugaggugggcagauugcuugagcccaggaguuccaaaccagccuggguaacauggugaaaccccaucucuucaaaauauacaaaauuagcugggcaugguggcaugcaccuguggucccaccuaaugggauguugggggggugguggugcugaggcugaggugggaggaucacuugagcucaggucgaggcugcagugagccaagauuuugccauuacaguccagccugggugauagaaugagauacugugucaaaaaaaaaaaaaaaaaagccuuuauugcuacaaauuuccucuuuugaaccgcuuuugguauaucucaugaauuuugguauuuauguuuucauuuucauuugucugaagguauuuccuaauuuccuuuuugauuucauucuuugauucuuugguuguucaagaauguguuuaauuucuacauaauugugaacuuuccaguuuucuuucugguauugauaucuaguuuuauuccauuguguuuggaaaagauacuugguaugauuucuaucuuuuaaaauuuguuauuuguuugugaucuaaugugaucagaauguuagaucacauguuagagccuggaaaaagguuugugugugcuugagaagaauguagucuccuuaucuuggguggcauguuauggauauguccauuaaauccauuuggucuguaguauuauucaagucuucuguuuccuuacugaucuuuugucuggguauucuauggaaaguaguguaugaaauucccuacuauuacuguguuggugucuauuuguuucuucagcucugugucacauauauucauaugcuguuguccucugaugugguauguguauauauuuauaauuguuauauuuucaaaguauauuuugucuaauauaagcauagccaccccuguucucucuuggcuaacauuugaauggaguaucuuuauccauccuuucacuuucagccuaucuguguccuuaaauuuaaaacacguuucuuguagacagcauacagcuuuuuaaaaaaauagcucaucuuaaaaaagaucaauuuagauacuuugucuuuugaacauggaguuagauguuacauuuaagguaauuacugacaggaaaggacuuacuauugccauuuuguuaauuguuuuucuguguuguagcucuucuguuccucuuuuccucucuugcacucuuccuuuauauuuuauuacauuuuuccuugcaauuuguuuguuuaagagauugggucacucucuguuagauuuucccacaguuuggauuuuggugauuguaucccuaugguaucucuuaauauauuccucuguugucuuuuucuguaaauugguaguuggaucuagauggcuugaucagauuuugauucacacuuuuuuucccccuaaagacaacuucauagguaggugaugcuuucuuuucuuuuuuccuuuuuuuuuuuuuccugucucccaggcuggaguacaguggagcgagcagucaugguucacugcagccccaauuuccugggcucagaugauuugauuuuuucaccccagccucccgaguagcugggagugcaagcaugagccaccaugccaggcuaauuuuuguauuuuuuguugagacaggguuucaccacguuucccaggcuggucuugaccucugggcucaagcuaucugccugucuuggccucccaaagugcugggauuacaggcguaagccaccaugcccagccuacaugguguuuucuuucaucagaaucuggaggcacauaaugugucauagucuuuuuuucuuuucuuuucuuuacuuuuuuuuuuuuuuuguagagacagagucuugcucuguugccaggcugcagugcaguggcgcgaucuuggcucacugcaaccucugccuccuggguucaagcaauucucuugccucagccucccuaguagcugggacuacacgugcaugccgccacgccugacuaauuucuuuuguauuuuaguaaagacgggguuucauuguguugcccaagcuggucucgaacuccugagcucaggcaauccucccgccuuggccuuccaaagugcuaggauuacaggcgugagccacugcgcccagcccauagucucuuuuaguaauaugagcagccauugguagaugccuagauucuuuuauuaauuaggggucuuaaauggugauauucuaauuucauaauuccuucuuuauuacuacagagguauuuuuaaucuucuaugaguuaccagugguacaguuuguauaugaaaggcagaauaaaugcuugauuaaauuuuuuuuuacuugccaguugauauaauuugcuuuauaagaaucaucucauguuaggguggaaauugaaauacauguuuucuauuuuauucuaguuugcauuuaugucggauccucagugaaaauaaaagccaugauaguucaacauacagagguaagauuuuuaaaaguaucuuaguuauuucuugauuaaaauuaguaacugucugcuuucuauucauuguuagguaugaaaacaaaagguguaagauaguucacauuauauaaagguuuuacaugguuauauuauagucaggauuaaaacugcaguuacaguaagacuauaucucuguauacugauguuauuugaccugcauuauaaugauaugauauugcuugacuuuuguaauuggggcuugguauauuuagcuaaauuucagcaguuguuagcuguaucaaucauaaauaugacagaaaagauaacauggaaagaaaaauuguucugaucuuauuugcacuagaaaauuuccagaaacugagguucaguguuuuuacuaaagcugguuauguuuagguggugucuagggaucuuguuaaaggcaguugucaugggaaacauucaaaggaguuguuuacugcauaucacagauaugauuuauuaaaugaaauauguaauuaagcaguauguauuauaauuuuccaguaacuuuaguuucaaaggauuuuacuauuuaacauuuuguuaauuuaaaauuagacauguggauuuggcaaaggaggggcaaagcuaaaagugauugugucuaguaaguguaaagcauuuacaguaguauuguuggggguaaaacccacauuauuuuuuuaaauuagaaaauacauuuuuauaaccgauauucuauuugaagccaaaaaucauuagauaaaauuuauuauggucauuuaaauuaugcuuuugugaaaagaagauuaagaacaauuuuacauauauauauauuuauuuuuguucuaccaaaaaucaugacuuucauaauagaggauauacuuuuuuuuuuuuuuuuuuuuuuuuaaaguagacagggucucuuuccauugcccaggcuguaaugcaguggugguguaaucauagcucacugcggcuucaaacuccugggcucaagcaauccugccacuucagauucccaaguagcugggacugcaagugugcaacacugcuccuugcuuauuuauuuauuuauuuauuugagauggaguuucacucuuguugcccaggcuggagugcauuggugcaaucucagcucacuguaaccucugccucccggguucaaacgauucuccugccucagcuucccaaguagcugggauuacaggcaugugacaccaugccuggcuaauuuuguauuuuuaguagagacgggguuucaccauguuggucaggcuggucuugaacuccugaccucaggugaucugccugccuuggccucccaaagugcugguauuacaggugugagccacugugcccagccuuauuuuuuuaauuuauuuuuuguagagaugaggugucuugcuauauugccuaggcuggucucauauucuugaccucaagcaguccuuucgccucaggcucccaaauuguugggauuacugucaugagccaccuugcauagcugaggauauacuuuuuaaagaacauuugggccaggugcgguggcucacgccuguaauccuagcacuuucggaggcugagguggguggaucacuugaggucuggaguucgagaccagccuggcuaauauggugaaacuccaucucuaccaaaaaaaaaacaaaaacaaaaaaaaauuagcugcgugugguggcgugugccuauaaucccagcuacucaggaggcugagguacgagaaucgcuugaacccgggaggcagaggcuguagugagccaagaucacaccacugcacuccagccugggugacagagugaaccuuguuucauaaaaagaacauuugggugugugaguggaagaugguuuuuuuuuuuugagauggaaucucgcucugucacccaggcuggagugcaauggcgcgaucuuggcucacagcaaccucugucucccagguucaagcgauucuccugccucagccucccgaguagcuaggauuacaggcgcccgccaccacgcccggcgaacuuuuguauuuuuaguagagacgggguuucaccauguuggccaggcugauaucgaacuccugaccucaggcgauucgcacaccuuagccucccaaagagcugggauuacaggcgugagccaccgugcccgaccgaaaauguuuuuuuaacaaaugaaaaagccauuuuucacccugucauauggguaagaccuguuuuaagaguuaacauuccuagccugccaccccccaaauuauuuucuuguuuauccugcuuauaaaauugcaugaucacucaaaagauuuuugagguugauagacaguaauguauucuuguuuaaguuaguugacugucagaaguauaagaauguacaaaaagacuccuuucuaaaaauacuuggguacuuuaucuuuuuucuuccccggguuuaaaaucaguuuuuaacaucucaguuaacuuugaucuuguuugauagaaacauuagguggauaaaauagaagaauuuucaauaaaugauaguguaaauaguguaaccaugugacucuggaucuuuaauaacuauuagauuauuguuuauuugcaugguucugauucacaugugaaaccagaaauaguuaugaguguggccuuauuggcugaauugccauugcucuccuucucuuacccuugccugcuuccuuaacacauauacuccuuggcugaucucugucaacaggcaggcguugguuugaggggcuccaguuuguuguccuagcaggaaacugacugaaugucauuucuucagaaucucuuuucugucuuagggguuugaguucgggcaguguccccucugaccuuucucuuucugcccuucccuugaauuaauuucauuucaggcaggcaguuucccuugcacacacugcuuuuccuuguuucuuuuauaaaucaccuucccccccaccccagccacugccaaugaaacaacauuguaaugauggcuaauaaacaugaguaauugggguacagugugauauuuugauacguguauauaauguguaaugaucaaauuaguguaguuaguguaucaccucaaacauuuaucauuucuuuguguugggaaaauuaaaaauuccuucuagcuauuugaaaauaaacaguacauuauuguuuaaaaaaacaaacaugaguaguacuagcaauauuagacauaaccaagaacuggugucuucaacauucaaaccccgcaaaaacuaagaaucucuagaaguaccuucucggggccuuuuuuuugagacagagucucccgcucuaucgcccaggcuggagugcaguggcgccaucuuggcucacugcaagcuccgccuccuggguucaugccauucuccugccucaaccuccugaguagccgggacuacaggcgcccgccaccacgcccggcuaauuuuuuguauuuuuaguagagacgggguuucaccauguuagccaggauggucucggucuccuuaccuugugauccgcccgccucagccucccaaagugcugggauuacaggcuugagccaccgcgcccggccucuaguggcuauucuuaaaacuacucuuucugaaguguuaacauuaagauaaaauauuuuauugaauuuuuuuguagauaacuauaagguuguaaguuuuccuccucauuguaaauauaaaguuuuucaccugcaauauagauuuuauagguuucuguggaacuagccugacaguuuuaaaccaccacuuacaguucuauggauaaaacacaauaggaguuccuaaccauuuuuaaauaggcauuuagaaaacucgugaauuaggcugggccugguggcucacgccuauaaucccagcacuuugggaggccaaagcggguggaucacuugaggucaggaguucaagaccagccgggucaacauggugaaacccugucucuaccaaaaauauaaaaauuagcugggcgugguggcggacaccuguaauugcagucaccugggagacugaggcuggagaagcgcuugaacccaggaggcagagguugcagugagccaagauugcgccacuguaccccagccuggagggcgagacucuguuucaaaagaaaaaaaaaauaagaaaacuugugauuuagggacuauucguugcugcuguguggauuacaaugugauuguucuuaugucacuuuaguuucagcaaaaugacccaggucacuuguucucuauuuuaaucuccuucugugguuaagauuagacuucccugguccccuaugaguaccagaggacauauucucaugggaccuuaguuuuugauaauuggcuauuuuguucuucuaaguuacugcuuuaaaaaaaaaaagccaaaaaaaccaccuuaauugucuggaaaauuuuaaauaaguauuauuuguuguuuguuguaaagcauuuuauucauggaaauacaaagcauaaaguugaccucuuauaccugcgauaccaaaauacagaaauuuuuuccuuuguuuuuauauuguuauuuaaaagcacaacguagauauaguuguaaaauaggcagaauauauuuaauaaagaauucuucauaaauaauuggaauaauuauuagcaauagcaaauagcaauagcaaaugauuuaaugaacaaguuaauuuuacugcaaaauaguauuuucauuaaggggggauuuauguacauuuugauuucuauuauguuccuuuuuguggcuaggagucauagcaggggagaaguuuauuuuuauuuuuauuuuuauuuuuugagacaauggugcuaucacaacucauugcaacuuugaucuccugggcuuaaguucccgccucagccuccugaguaccuggcauaacaggugugugccaccacaucuggcuaauuuuuuuuuuuuuuuuuaguagagaugaggucucccuauguugcccaggcugguuucgaacuccuaggcucaagccguccuccugucuuggccccacaaaguguugggauuuuaggugugagccacugcgccuggcuaagaagauuuuuaaaauauuugauuuuuuaacuugcuguuugguucugaaaaaauuuugauuccacucaaaaggagauuauaaauagacuuuauuuuacauuagcaucuuuaaagcuucuuguuucacuacuuuucaugauuggaaggagguaaaguuuucaguauaugggacuuaaaaaaaagaugaccagaaggagguguucaccugaccacuaacuacccacuccaaaaccaaaauaucuuuuuucaggaaaggggacugugguaauuaauagugaauguugcuacuuguaguugacaguuaucauagaacugccauuuuauacauguauuuuuuguuugauuuuuaugggacaaagagauuuagauuuggggagaaauuucucucacacuaggguaugguuaaaacucgguaguauauguacugcuauucuuuaucuguugucacuauagugcugagauugaauugaguauauaucugaagucuacuggugaggagaaugauugguuugaauccacuugcuagaguucauugaauauaauuauagagacuugaguagcaugaaaaaaugcuuuaaaauuguuuuggggggaaucagaaugcuauaugaugugcauggugaauuuaaauauguaaaaucuguagacauacagaaaaaacuggaaaggaauguucaagcuguaguuauaguaguggagagaugguuaacauuuuucuaaccuuuuaauuuuguguuuuugugaaaauaaaagaaaaaauugcuagaggaaaagcauuagaauuauauuuuucauuauugauguuuauaauaauucugagacguaggaaauauauagauuuacuuuucauguucaagagacuguauccuuacauuauuucucuuauguucaacagauuuccagcaagcucucuaugaguugucauaucauguaauuaaaggaaaucuaaagcaugaacaggcaucuaauguucuuagugacauuaguguaaguauguauauauuuuuuuaaguuaauaguuguuauauaucuuuuugcuuugacacaaagaucccugaaguuuauaacuuguauuuuauucaaaauuauagaaguggauggauuuuuaaaauuuuauuuuuuuaacuuuuuuccccucagaacuauggaagugaguaauggauguuuuaaggugacauugguaacccauuuuugccagacaggaacacagauaguuuaauauuuuuaucugguuguugguaaaguaggaaauaucagguaagcugguagggagaaaaaaaaaagccugugcuguaaugaaauuaagguauccaugggugggggaggggggagggauaacauuaggagauauaccuaauguaaaugaugaguuaaugggugcagcacaccaacacagcaccuguauacauauguaacaaaccugcacguugugcacauguacccuagaacuuaaaguauaauuaaaaaaaaagaagaaauuaagguguccuuaauaaaaaaugccacucuaaaaaaguaaauuggcuaaaauauuuuucucucaauauaguauaagccauuuuuuguuuguaguuauguuuagaaauuaaauauauuuuaaaaauugaggauuaaauuauuuuaaauugcaauuguuuggcucuaacauucacuuggugcuaguuuucauuuacuuaugguuuaaaaaauaucgacuagauuaaaaaaaacucuuuuacaugguuauucuguuucacuccuucauuuauuggagaauuuaaguuagauucagaccaacuauuuuucauggugguuugccauuuaaauuggaaaaugggcuuucaaauuguaaaccaguaguuaagcuugagguuuuacaaguggcgugcuguucuuuuauuauuaagcuggcuuuuaaacuuguauauaaauaaaauuaucuugugucuguguauauauguguauauauacauuuauaaugaacuuguauauacauaaaauucagaauagcuuuuauaauagguuuuauuaaggugugggauuugaagcuucuuggucucaaucugaacuucucuuacuguguuucuuuaaucuucuguagccuuuuuuucugucaggggagguaauauuuguauguuuuuugugcuuucccagggauagucuuaaggaaauucuaaguuuagcuguugugauuuuccaccccauauugggguguauuugagcaguaggaauucugugaguuucccuuuugucucuaaauuaucuccagcugauaacaacagaauuaguucauguuggaguagucaaauuccuuuuuuuuuaacguuaaaaaaauucaguugcuaccaaucuuucuuaaacaacuaauauuucauuuuugaaaacucuugucuuacucuauuuuugaucuucaaguggccugaguacuugcauuuaaauagacauaaccagaguucagagcccuuaagaaauuugaggcuaaaaucugauugacaagguuauuucauuuuguaaauugagcauugguauagguuuuaguuuguuuaugggaucugauucugauucuuuuuucauuuauugaaaauggauaguucaagugaauuuuauauauguguguuugguucuuacauagcuucuucuuucuuuugaauacuuaaugaugucuuuauagauacuucugcagcuugauugucuuugucauggcuuucucuuaguacuauauacuguccaguaucuuacccacagaagaguaacuugugcgucuccuugcagcugccagauuuuucuuuagaauuucuuuuaguuucugaaaauaggcuaauuuuaggguugcuauacugccagccaacuguuaacugcaguaagugaacuaugaucccuucuaauggaaaauagcccuaaaauugagcgugggaguggaaagucaagagacaagucuagaauaaugcugaaguuuuuauucagaaacaggaggauccuuuucuuuucuuuucuuuucuuuuuucuccaagacagugucuugcucuguuacccaggcuagagugcaguggcacaaucuuggcucacuacaaccucugucucccagauucaaacaauucuccugccucagccucccgaguagcugggauuacaggcgcaugccaccacacccggcuaauuuuuauauucuuaguagagacaggguuucaucauguuggccaggcuggucuugaacucuugaccuugugauccaccugccucggccucccaaagugcuaggauuacaggcgugagccacugugccuggcccgauuuugggucauuuucuccaaaggcuacaagaguaaauaaagaaaauaaagagaauauugagcuccaaaaaagcggggagggaggagggcaauaaggguugaaaaacuaccuauugaguacuguguucacuauuuggaugauggauucgauagaaacccaaaccccagcauuaccaaauauauucauguaacaaaccuguacauguaccuccugaaacugaaaacugcccaaaccagcuuuuagcuuuuuagcugguuuuguauuuucaagauuucuguuuuucugauaccauuaugauuuuugcauaaaucaaauauugacucaggcaugagcacaacauuuaaagucuuggaugaaaaauguacaguuuuuaacagucuuccuuuagguaaguaugaggcacucuaaauucacgugauuucuaaaacgaaacuucuuuggaaaaauguuacucauuugugcucuuuauuuccuaaagugcuuguuuagguuucuguuuuuuuaucaaguuauuuuaugguagacauuuaaacauuuuuugcaaacauuaucuucuuccucuuuguuaugaaaguuuacuugaagaauuuuaauauuugucaauauaaugaugggguuuuuguuuuuuaaaaaucuuuuuucagcaccaccuggaaaucaauuuuuuuuuuuuuuuuuuuuuuuaaagacagaguuuccucuguugcccaggguggagugcaguggugcgaucuuggcucacugcagcuuccaccucccgggcucaaaugauccucccaccucagccuccugaguagcuaguacaccaucacgccuggcuaauuuuuuuuuuuuuuuuuuuuuuuuuuugguagagaugggguuucaccacaugguccaggcuggucccaaacuuuugggcucaagucaucugcccuccucggccucccaaagugcugggauuacaggugugagccacugcucccagccauuuuuuguuuuuaaguuucacagaagaguguuauuaugaaacccuaauacuugcugugugcuuuuuugcuauuuauuguaauuauauuuuuaaaauuaggaauuucgugaggauaugcccuccauucuugcugauguauucugcauauuagguagguauuaagccuuuauuucaccuguaaugugcugugugguaaaucaaauguuuguuaaauaaaauguuuuaaacuaagaauuuuacaaauguuucugcaagucuagaagcaaauugauucuuuguagagaauauagcaauauaagucaaaugucauaaucaauguuauaaacaaacuuuagagguauaauucaaauuguuugaguuuuugacaauguagauuucuauaaauuugagcuaaauuaagucauuucaaguuaaaaggccaaguuuucugagauuuugguaaccaaauaaucuuauucaaugcagguuuucaaugaaugaugucagaaucucagacuuaggacucucaagaaauacuuacuuugcucuuguacucuuuugauucuuaauuuuagaaagagcaagaagagccaaaguaaucaaaaguacuuuuguuuugaggaugagaaaccagcuuugggaauagcaacuucuuuauuuuuccagaauaaauaaggguucaugcaagauaaaaaaaggaguauuucugugacuuagaaugaaauguaguauccgauggcauggauuuaaacaauaauguuuauuauaauuuuuuucucuaauuuuagaucuagaugaaaauaacugagcacaguuuucccuucagucaguccugugcuuucuuuucuuuucuucucuuuuuugagacauggucuuacucuuucgaccaggcuggacugcaguggugugaucuuggcucacugcagccucaaccucgugggcucaagugauccuccuaucucaccgccaugcccugcuaaaauauauauauacauauaaaauauauguauauacacauauauauuauauauacagauauauauaauauauauguguauaauauauauguauauauguuauauauguauguauguaauauauauuauauauauguauauauguauuuuauauauaucuguauauauauauugguagagaugggguuucaccauguuguccaggcuugucuggaacuccugggcucaaacgaucugcccaccugagacuucuaaagugcugggauuauaggcaugagccacugcacuaggcccagucuugugcuuucuguaacuuugaaucuaauagaagacauugccaaacauuauuauauucauuuuauuuauuuaguuaguuuuuagaggcagagucucgcuauguugcccaggcuggucuugaaugccuggcuucaagugaugcucccaccuuggccuuccaaaaugcugggauuauaggugugagccaccgcacccggccaauauucacuuuaaaauaagacauccucugcagguuugugaaccuggaaugaauuguuuuagcucauuaaucuuaauucuuagaauuagauaaauuacuuaaauaucuuacugagaauuuagaauuuguucuugacaaauauaaauccuggugcuugauccuucaggaaguuucagauuuccuaaguucccgguaauguugggaguaggucaaaauguauguggacugggagugauaaaugaaaagagaagaccauugaugagaugaccacaugucccaguuuuguuuuguuuucacuggcuaauuauuaauaguacccucuuuuauucucauaacuauccugguuuggaugauagaguauauguucaugguaucuguuggauugauguaagccaaccaaaaaauguuuuaagcuaaaauuuuuagugaggcacuaaagauauuaccuuuuuuuuuuuuugcaaauaaauacaucaugaaacaaauuucaguuaaaaauauuuuuacuauaaauuuguaagacuguaagacugauguguagguaacauuuuguggaagcuauuguuccuugauagugucaggaguauaucuuucuuuggguaaucaucaauuaucagcuuauuggcccuaguaauuucuuuauugacuuacuagauuauauuuuucccuucauaguuauuuaguaauaugaauuauuguuacaagucauugucuuguacgaguaacaugaauucaugaagaugaugcuugguugcuuuugggaaauuucucuuagccuauccaguccauuuuuuguuugagauggcaucuugcucuguugcccagacugagugcaguggcacgaucuuggcucacugcaaccucugcuuccuggguucuagugauucuccugucucagccuccugaguagcugggauuacaggcgcgugccaccacgccuggcuaauuuuuuuuguauuuuuaguagagaugggguuucaccauguuggccagguaggucucaaacuccugaccucaagugaucuguccaccuuggccucccacagugcugggauuauaggcgugagcuaccgugcccggccuauccaguccauuuuuauaagcaagauuaugacggcaaacuuggaaagaggauuucccucaccugcucccucacucaccuacccucacccuuggcagaaaaaaaaugauucaagugugaucccagaucaaggauggggaauaggaguaagaaugcuagcuaccucuaauaauaaugaugaugaugaugacaauaauaaugauaacaauuuaaguucugcuuuuagaguaccuuccauguucuaggcauuguguuaagcauuuaaucuuuguuuuaauccuuacaucaacuccuguaaaggugguaggaguacagaucagaaaaaugagguucagcgaagcugugauuuuucaaggccaugcaagccaguaaggcagaauuugaaccugggucccuuuggcuccacagccuaugaucuuuuuauuacaucauauugucauucuaaauguugacaguuacaagggaaauuagugcugcacuuuccggguuaagauagcaacuuccuccccacccccccacccccccccacccccucaccaccucccccccgccgcccccagccccgccccgagaauggaguuucagucuuguugcccaggcuggagugcaguggugcaaucucggcuugcugcaaccuccaccucguggguucaagugauucuccugccucagccuccugaguagcugggauuacaggcaugugccagcacgccuagcuaauuuuuguauuuuuaauagagauaggguuucgcccuguuggccaggcuggucucaaacuccuaaccucaggugauccgccugccuuggccucccaaagugcugggauuacaggcuugagcuaccacgcccggcugauagcaacuuuaacagacuaauaguaugaaggugagggggcaugagagcuauagaaagggggagucugcuguaaguugauaugcugauggggccucugggcugggguagguaauuggugaugcugggcacuagagcuggaaauagcugagggcuuuuuauugaaaucauaggggaaauuaaagagaauuuauucgagguaaaggagucagggauaauaaaugaguuuauuagaaugguguuaugaguuagagcaaaaagaauaaagaaaccagggaagguacaguugggauaauagaguccuguacugauuguugagauagcucagcuaagaaauuuacugagacucuuuuaagcguuuccuaacauugucagaacccaagagaaugguuagacauuuaaguaauuuauccaauucuaagaauuaagauuaaugagcuaaaauaauucauuccagguucacaaacccucagagaguaagugucuuaaucagguuaaguggcugagaggagagacuugacuugaagaggaugaaucugccauccagugccccuguucuuagggaccuugagagguagaucuuagggacuuuagggcccuggagcauagauacauguuggguaaaagaaugggcccaguuuagccccaaucccuuaaaaucaguaucuuuaaaguucuagacugaggagggaccagaaaaccagauagcagggcaacaauugggagucccugaaaaggauuggugagauacacauggguuaaaagucuuaaugagaaauugagauuguauuguaauuuacauugcauaaauuauacccuaaaauuuccuuaauacacaugagcuaacugugugcuuagcuacaguggccaggauauguagaaauggcaacuguccaagaagggaaagucaagggccaggaaaauguggauauguuugaugaaaaaucccuuucucuuuugauucuuaguguuggcaguagaacauguagaugacaauuuuuauuacuucacuaaaaccagugcuucucuuuauagcauauucuaaauuaugaguugacuguaaaauuagguuaauaguauauaaucaguuaaagcaguaauccugagaucagccuuguuuguaauccugccaaugcugguugaaauuuuuggugcuuggcauuuggcacuaauuguuuuuuuucuuccacacuucagaucagaaaauuuuuugacaaauuuucugaauaauuuacugaaacucucaguuuuuaaauauuucaguaggaagauaaaaauuuugaauaauuucuauuuacugacuagaauuauaauucaagauaagauguuaauuuuuuuuuuuuuugagacagagucuuacucugucacccaggcuggagugcaguggcgugaucucggcucacugcaacuucugccucccagguucaagugauucuccugccucagccucccuaguagcuguacuuacagaugugugccacugagcccagcugauuuuuguauuuuuaguagagacgggguuucaucauguugcccaggauggucuugaaccccugaccucaggugauccacccgcuucggccucccaaagugcuaggauuacaggugugagccacuguacccggccaaaaauauuuaauacugucuuuucauaagguugguggccagguagcuugguuagaacaugguaauuugaccaggguggcgaaagucauggguuugaucuucaugaguauuaggaucuuuuuuuuuuuuuuuuuuugagacagagucucgcucuguugcccaggcuggagugcaguggcacgaucucggcucacugcaagcuccgccucccggguucaagcgauucuccugccucagucuccugaguagcugcaauuacaggcgugugccaccaccccaggcuaauuuuugcauuuuuaguagagacaggguuucaccauguuggucaggcuggucuugaacuccugaccucaugauccgcccgccuuggccucccaaagugcugggauugcaggcgugagccacugcgcccagccugaguauuaggcucuuuagaguuagaagaaaucuuuguuauaacccuguucaacuuuccaccuaaaauaaucuuuuuuuuuuuuuuuuagcaucucugacaaguggucauuuaaacuuuguuugaauguuucauuuuuugcgaacaauaguuuuugaagcuuuguugcuuccagugccauagcagguagcuccaguguaguugauguacuguuuuauggaucugucauaggucacagggucaaucuccaguuuuaggagaaauuaaagcauucauauaacaucucauguuaccauaguuuugaauuuuuccaaauucagauugaggcauuuuaaaauuaguuaguuucaaauaaaauaaguaucuuacuuuagugcuggggagucuagacaaaucaaucaaacuuuuuucuucuucaucauuauagacauugagacaaauuguuuagaagaaaaaagcaagagagacuauuuuacacaguugguauuagcauguuugguaaguuuuuaaaaauauuuuucccuuuuaaaaaucugcauuaaacaguuguaauagaaguuaaucauguuaaugaaggaggauauugacauucaguugacuuuucucauaaggugagauuuggguuuugaaauggaauguuuugugaaauaagacaugcuguuucugugaaauaagcauguaaccauauccauaucacuuaaacuaucuauacauuuaaaaccuuuggugauauuccugaccuaguaaguuccuaagaaaaagguaagcauuuauaaaguaaguagaaaugauuguagacagcuuuuaaauggauuuuuuuccucauaaacuguuaagcaaagaguaaaagaauagagguaguuuaaaaaugauaaauucuagaacuugccaugauuguugucugguaaaccauuuguguucauaaauuuagaaccagggagaacugccgugguugagaccuggaagaaggugcuugucuuugcuauacuagaauuuaacuuaaaguaggaggcuauuaagugcuguauuaggugaaaguccagauaagccaaaugcagucauauugaaaauuucaucuguaguucuugucauuuauaggcaguauacaacaugcauauaauuuuauagugaauuuuuugaaagccguuuauuaaauauuucaauauuuggagucaauauuuguuaaauugaacuucuaagccuuuuuauaaauuguagguuguuauguagagaauguuauuuuuguauucuuauuuaggaagcuuuaguuugaauauauuuaacauuguggaugcaaugcuaaggaauaaaugaccuuuaauauuuuuuaauacaguauuuaguuucagacacaguucuaaaggaacgccuggauccagaaacacuggaaucauuagggcuuaucaaacaaucacagcaauucaaucaaaagucaguuaaaaucaagacaaaacucuuguaaguacacguaucuuauguugcagaucaaguaucugaguauguuuuuucguucauauuuugaauccuaguagcuucuaaggggacuuugaagauuguuuuuuuuguuugugguuagcaugucuuguguuuuuugccuucuaaaaguagccuaauauugagucaucagugaucuuuaccugugcaaaaccauuguuacuuuugcccauauucaaaguuaaaauaauacucaugcuuucaucauuagcaauaaaauaauuuaugacuguggcuauacucaggguauauucuuagagauggaaauggugauauguuauuguucccugauauuaacaauauccuuuucuuguguuacugguuuucccuauguaauuaauauugggguucucauaugaaucacuguuauuuucuacucuaaaagguacacaaagagguaaacuuucaacaacuauucuuaggauuguuguagguuggagauaagaaaauucagugagaauacaguacucugugcaagcuuguuaauuaaaauuaauuuuauccccuuaaugauauuuaucugauuucaguuauaagcagcaaaaauucaauuuguuaagagaagagaaugaagguuaugccaagcugauugcugaauuggggcaagauuuaucuggaaguauuacuagugauuuaaucuuagaaaauaucaaaucuuuaauagguaagacauuuaucuguauaguauguguuguuaagauaacaaguuauuuuagcuauuggagaauauccauaaagacaaaaugagugcauuccaucuauuuuuuuuuucaguuaaggaaugggagagguguuuagcuuuuacuuuuaaugguuuaucaauaauuauaaaauuuagcaugauauuugugagaaaucuuauugucacuauaccuuguauguuaauauuagguccugcucugucuagucuuucuuuuuuguggaggggauccugagugguaagccaacacuuucaaaagagaauggaugacaaagaacaggauggacuguucugauagagugcccuacguuucucuaguauuucuauuuuuaaguauuucucaaccauuuuauggaggaccaaaaagcaaacaugaaaacuuuaauacaguaaaucuucagugaacuuuugaaacuacagauguguaauuuugaacuugauuuucaaaauaacuuuacaagggacuuugauacuuauuuuaucuuuauaguagccuuuuaaaguaagugcaacagcuguuguaaaaguguaacagauaggaaaguuauuauucucccuacccuuuaaguagaauuccuguagcauuacuguuuucuuuuuauuugcauugagcauuuggaagaaguaguugacuucuguaaaaaagaugaaugagcacuagaaaaauaggguaauccagauuuuccugagguggaaagaguuuuuuuauuauuuacuagguguugugcuaucuuagggaagauuuugcaguaccugggucuugagaccugccagaggagucauauuuugugccucacuaguuguaucuuaggggugcuuauccucagcuucuugguucuuucucuuuuuuuggaguuuauauaugacuaagaaagagggagaaggugucccaauccuuaucuccuuccucuagugcuuuguguaggaauccaauuaaaacuauauuuacuauaaucaccuuuguucuuaccaacaaguaaguagcuuuuaguuuauuuuuuaaauuuuuguuuauuuauuuuuuaagagacggggucucgcuaugcccaggcuggucuugaacucaugggcucaagcgaucuuucugccuuggccucccaaaguacugggauuacaggcaugagccacugugcccaacuaaauagccuuuuguuuaaauuuacucuuuucuuugaaguuaaucuaguucuggcagcugaucuagugucuuuguuguuucuuccaguugucaauuuaacaccaagauggguggcccccuagggcugugggacucuugcuuaacuguguggcagugacccauuuuuaaaaaccuucccauggugguuccuuaguuccuuucuguucuuucuuucucuuuuuuuuuucuuuuuuuuuuuuuagauggagucucacuccgucacccaggcuggagugcaguggcgcaaucccagcucacugcaaccucugccucccggguucaagcaguucuccugccucagccuccugaguagcugggacuccagccaacacacccagcuaauuuuuguauuuuuaguagagauggaguuuugccauguuggccagguuggucucaaacucaugaccucaggugauccgcccgccuuggccucccaaagugcugggauugcaggcuugagccacugugcccagccccuuucuguucuuucuaggguaggcgccacacuuuccugaguguuuuuugaucuagcuugagaagguuuucaguacugcuuugcuauaaguuugucuuuccuuguauccugucauacuuacuuaagguaguauuccccacauaaaaauucugugcuauuuuuuuuuuuuaacuuuauauccuuuuuuguugacaucuguuucuucuauuucuugugaguuuauaccuuuuuauuccuuuguuauuuugggaacauuucaaagagggauuuuucuugaaggugugcuuuuaucuuacuagaaaauguauacuacuuacuuuucuugaacuuuacucucagggagaacaggcuaugauccuguuucugaagaacaguguaacaggcacaacugcaagcucaugagguauauggacagucuaugaguauaaacaauuugauuuauugggcuaaaccuauauuuuaacccaccaaguagcagucaaaugucaccuucuuagugaagccuucccugcccaccccugucaaaacucccugcuauucccugauuauuuuucuuuuuuugcacauaucaccauauaauaugcucuguaccuccucccccuccaccugugauguaggcucugugaggacugggguuuuguuugguaccuuauccuuaauacuugguauguaggugauaaauaaauacuggguaaaaaaggaaugaauauuuccucuauucuuguauaaucuauacugacucuuagcauuuuuuuccugauauggagaauuuuagaaaguucaucuuccugucucaguguuuauuuaucucugacuaggugauuuccuccucccccaauugucugagaaaugaacuuuuauuuuuuugagacagagucuugcuuuguugcccaggcuagagugcagugguacaaucuuggcuauccgcaaccucugccucccagguucaaacgauucucgugccucagccucccgaguagcugggauuacaggcgugcaccaccaugcccagcuauuuuuuuguguguguguuuuuaguagaguugggguuucaccaaguuggcugggcuggucucgaacuccuggccucaagugauccaccugccucagccucccaaaguguugggauuacaggcgugagcccccggacacggccugaaugaaacuuuucauugaugugaaaauagagguugaaacuucaauuccaaugaguauucuuucaguguuguuagcauuuauuggagucccucuuagugcagacuucauccaggccuugucucauucuguccagaacaccucacugaccagcauccuauuuuucauggccucuuuggauggguuucucuguguuuauucccauuguuuucuguuuaggaacagucuagacagguaauaccuccuucaucagccagugucagaaacugauaccuaguuugggcaguauacauuuuaggugcacauacuuucaggguacuuggucugaccaggauaaauccuuacuuaucauccuuuaguuaaaaggcaguuauuuggcuggaugcgguggcugaagcuuguaaucccagcacucuggguggccgaggugggcagaucaccugaggucuggaauuugagaccagccuggccaacaugguaaaacccugucucuacuaaaaacacaaaaauuaguugggcaugguggcacaugccuguaaucccagcuacucugaaggcuugggcaggagaaucacuugaaccuaggagguggagguugcagugagcugagaucgugccacugcacuccagccugggugacagagugagacacugucucaaaaaaaaaaaaaaaaaaaaaaaaaggcaguuauuugcuccuaaaagauucuggcacaucaaaauuuuuauauucugcuggauaacuuggggcuguuuacugcaugcgcaagcaaggaagcagaaccauuaugcaucugcauggugauugugaucugacacuaaauuugaacaacuuauuaaauacgaaugaauagugaacaguagacuauugagcugccaagucauagacaccauacaaguggccauagcuugaagauggcaaaaaaacaucuuuuagaaauuagaggaaaggauaucacagguggacuccuuuguuugcugaacuaaacgguaagaacucuacucuuuuggaugcccuucaaaaaaaaucagagcaucaugcuguacacuuuaaauauauauaauaaaaacaagugguugcuaaguguucuuuccuuuccuuucuucuaaaucaguggucagcaaguguuucuauaaagggugagauaguaaauauuuuucggcuuuguggaccauaugguuucuguuguaacuacuuaauucugccauuguaguguaaaaacagcguaaaaacagcuauagauaguacauaaauaaaugugacugugugccaauaaaauguuauuuacaaaaacagaccgcuaaauggauuuaacccacaagccauaguuugcugauucuugcucuaaaucaaaaguucugccuaacaacuaaucacggagcuagcuuauuugagcguagcuuuagagagugaaaaugguucuuccugguuuuggauuuuagugguccaggaccuuuuuggccuaggcucuaaccccuuuaccuuugcucgcagaaccagagcuuucuucaccaaaccucaagaccuucauuuguugccuggugucaaaggguauagauuuggcuagggaaggguagagugagagucuuugccucuucagucucucaagugaccagaguaacauuaaaaacaaaauaaauccuuaagccaaacgauuuuuauuuuuggauagauuaugggacauuucaccccuuugacuacaugauuuugaguguauuuaguauuuuaucuuugguucaaucugaauauaggguccauucaacuuagacacaucuuauugugccaccuuuuuccuauuucuuugaaagggaaguuggcugccuuauuuacuuaaauuuuuacauuauugaaguuucuuggcuauauguuagaaguuuucccuucauaguaugaaaaagaagacagcaauuaguguuuccaacuauagggguuuuuuguuguuguuauuuauuuuauuuuuguuuugagacagggucuggcucuguugcccaagcuggauugcagugguacagucuuggcucacugcaacaucugccuuuuggacucaagccauccucccaccucagccucccaaauagcugguacuacaggcacacaccaccaugcccgucuaauuuuuguauuuuuuguagagaugggguuuugccauguugcccuggcaggucucgaacuccugagcucaagcuaucuaccugccuuggccuccuaaauugcugggauuacaggcgugagccaccaugccuggccuuguuacuguuuuuuagaucauacuuuuauuuuguuauucauugguucuugcuuugagaugugcaguuuuuuugcaaauaguguuucuuagaaauagucuagcauagauuuuuauuagcuucuaaagaaacucuuucuacauuguagaucauuucauuuuguuaaaaacaugauuuucuuugucuccuaagguccauucucucaggaacuugaugauugaggcuauaauuccguuuucuugccugaaauuuauaggcuggacaucucuccuaguuaugucugcaauauuaucuuggucuuuuauuuuccuguuaagaucucaauuuggccuaauuucuacaacagucauugucaguuugaucauauuucuugccccuaguuggugucacuguaacauaacugguuauuuuuucuaucuuuggggaaacuccaguugcuuuuuccugcauuucuucaaagauguaucauucaaaaggugugaacucuucucaaggguagcguaaacauuuuauuaaucgcuauaguuuuucagcuuuauucaggcuucauugacauauaguagaaugcuuauauuuaaaguguacaauuugacuuuuaauauauguauacaucugugaaaauaccacaaacaagauaaugcacauuccucccacuaccccugaaauuuucucuugccucuuuguguuuauccucccucucuucucucuucuguuuucccggagaaucacaagcaccuggcacauaguggguaguuauuuaauacuuauuuaaaugaaggagggcaucuauggccauuguagaucugcaguuucuuuauuuuuccacuuauucucuuuaaauaugguuucuuguuuguuccucaaaaggcauaaaggcauauguguguguguuuguguguguguguguauguauguauauguaaaaauauauauguguguauauauauauaaauugcuguguguauuaauguagcuggugguagagguagggagcuagguuugugaucucuguaaagaucacaugauuaucagugcuugggcuggacaaagcucuucuaagauguuugcauacaagacugcuuauguucuacuacagcugccauuagggaaacauuuuggauauucaaacuuacugauuauuauuagagucucacuguauaugaacuaguuuaacuguuacuuaaaacgcuaagauuuuaaaaaugauuuucagcugggcaugguggcucaugcuugcaaucccagcacuuugggaggguaaggcaggaggaucacuugagacuaggaguuugagaccagccugggcaacauagugaguccccaucucuacaaaaaaguuagccaggcauguugguuugcaucuguaguccuggccaauugggaggcugagaugggaagaucacuugagcccaggagugugagguugcagugagcuaugaaugcaccacuacacuccagcgugggcaacagagcgagacccugucucuaaaaauaauaauaaaugaaaauaauuuucuaaaccuucaauuggcuaccuuuucuaucuuauggauaaaauuaauuggacuuacggcaccugagauauguaauagaaaacucaugagccaguuuuucuuuaaugaaagaugcaaaggugauaccuguuauaaguaaaagugcacauaccucuuguuucagauuacugccuuaaauugcaccuagaaggaaaguggguaguugauaguaaaggucacugauagaauagccuugaugaaguaaugcuguuaaauaaaacauaaugcuagugguucacauuucagcauacugaaaauguaaacuuaaaagcaaugugaaugaagcacuuaaaagauuuuaaucuaacauguugcuguucuauucuuuauuuaugaguuuuguguauguagccuaauggguaauuauaagccagccaguuugccaaaaauuauauucagugucucuuuugucuucugugauagaguguuaauucauuuuuauuuagugauuuaauuuuuuauauuuaguuaauguaggagaaguuacaugauuugauaauuugcuagaucuuacuuccauaaucuaucaucaguguuacagcagugugaaggcauuuuucaucuuuguugaggcuuccuugacauacaguaaaaugcacauauuuaagaugugcaauuugaguuuuaacauauguauacaucugugaaaacaccacaaacaagauagugcacauuucucccauucccccucaauuugcuucuucuugacucacugcagccucugccucccuggcucaaguaauccuuccgccucagccuccugaguagcugggacuacaggcaugugccaccaugccuggcuaauuuuuuguagugacaggguuuugccauguugcugaggcuggucucaaacaucuggacucaagugaucuaccugccuugaccuuccaaaaugcugagauuacaggugugagcugccacgcccggccugaucugcuuuuuguuacuguagauuaauuugcuuuuucuagaauuugucuauaaauggaaucguacaguguguacuguuuuugucuggcuuauuucauucagcauaauuauuuugugauucuuucauacuguuaccuguaucaguaguucuucccuuuuuauugcugaguauguccacuguacuuuuccuuacuccacuuauccuauacggcaaauugcuuauccauuuauauguugauggacauuugaggaguauuguauauuacagauaaaccugccgugaacauuuguguacaaaucuuuguauugacauagacauuuauuucucuuggguaaauaccuaggcugggucauaugguagguauaaguuuaaauuuuaaagaaacuugccaauuuuacaaagugguuguaccauuuuacauugccaucagcagcauuuaaggaucuuaauugcuauuuucgaaucacuuuuauauucauaggccauacuuuuuugaaguacagggggagguaaaaauauuuagaaguuuucuuccuagaacuucagggaaacgucuuuuuggagaguuuaugaaaauauggagcuuuuuuugaguaagacaugaucacugcuuuaguccuucuuuuccuuaguuugagaagcggaagaaaauguguucuuaaguuuggaucucauaaaaagagggaaaacuuguauuuggaggauuugguuuucuaagugauugcuaagguaguaugaaacgugaaaugacauuaguuuuguagcauuuaauauaaauaaguguggcguuaauauaaguaacuggagauaucaucuuaccaaaggguugggacauacaaccuauggaaauuacauaggaauuuucuugggaaaauccccuaacucauccauaagguauaaguguuuagauguaacauaugucccuaaauuuaucacaguucuuuuuuccuccaguauuagaagaaaucaguguuuauuuguuagcccaaugaagugguuagcuugcauuuagggacuauguuuaaugaaauauacauauuuuaaaauacuagaaucucauucagcuugaugaaaggcaugugggaacugacguaaaccaggagccuccaacucccuugguauucuuugaucuguuaggauaaauagcauaccacuuuucccuuuagaaugcuacuaaaagccauggauauaaaucagugguauauuuuauaguucuguaguauauguaagauaaaauaaaaaugauuuuuaaaaugaugguccacuuuugugaacccggacuuuuaacuguuuaucagcauuccaaauacuucugccuaaaacauuaaaaaaaaaccccuuuuguugcuuaauuuguaaaaugcauuguuugauuuucguguuuuuccaagaauuaauaauguggaccuguuucacuagcccgaguaaucaagaacugaugaggcaaaguguggcauagaggaauguuuauuugacugguaucacugguccuggacuauacugacccagcucugucauuaacccguucugugauucugggaaagucacauucucaucuguaaaaauguguaguggauuuauuucccucugggagagaggaagcaaauuuguaaagaaaguuguuuuuaaaaacauuuuuaucuugcuauaugaguuauuccugaaaauuaauggcuucacuagaaaugauguauaaucauuuuuaaauuuuuguaugucucaucuguugcaggaugcuuuaaucuggaucccaauagaguuuuggaugucauuuuagaaguguuugaaugcaggccagaacacgaugacuucuuuauaucuuuguuagaaucuuacaugaguaugugugaaccgcaaacacugugucauauucuuggguucaaauucaaguuuuaccagguaaagaaaaacguguauguauguauauuuagagauugauuucuuaaucuuguuuauauaauuuaauuuguuuuauuuguaaaugauuggucucaucucagguguucuagcagaagagauagauaaauggauagcuaacaaugcaaugugauaaguacuauauugguaguaugaaugaugugaugugaaagccuagaggaaagaauuauuaaguuuugccuugggagagguggagucagggaagacuuuauagaugugucuuuuuuuaaaccugguccuugaaggaugaauaggaguucauuaagguuuucucugcaugaguaacgaacaaugugagaaucaagauguggcagugugaauauauagagauagaaggaaugguucauagucugauguggcuggguuguaagaugggaaaagaagggacaggaaaugaaauugggaagguauguguacuucagauugucacaggcuuugaauacuguguuaagaguuagaaucuuauuuuuauuuauuuauuuuuuauuuugagaugggaucucacccagacuagucucagacuccugguccgaagugaaccucccaccucagccucccaaguagcugggacuacagucgugugccacugugcuuggaucacgaauuuuguuuuauaaacaauggcuauuggaauuuuuuagggaugugaauaaauauucaaggcacaucuuacaucauucccuuaagccacuaaaauagcggucaagcuaaucugugucucugauuauuucuacuucaauccaucuuucauauuauuguuauuguugcuuucuuaaagagaccuaacugaggcacuucacuggucaaaaaccuuuacuucuaggaugaaauucaaacuucuaaauguggcagaaauagcacuucacaauuuggcacuguucuuuccggccuuaucuuuauaguuauuuuuuucuuaaaucuaauauucuagucauauuaagugacuagccauuucuugaacuuagauauagauauugcuaugaaccuuuguuccuguaguuccuuauaacuaagaaaccauucuuacccaacccucucacuucuccuuucuucaucuugugaacuccuauuuauucuuuaagagcaaaugcugcuuguucuguaaaggcuuagcugacucuuuacccaugcagaauuagucacuucuuaaucuguauucucauaaaacuugacacauaacuucuaacacccaucagauuaucuuagaauaaacuguaucuaucuccuuugccagacuguaaaccauauagggcaggugaauaaacuguaucuaucuccuuugccagauuguaaaccauauagggaagguucuauguuuuacuaauuccuauggauuaauuuauugccuagccuauaguaaaugcucacuaauuguaaacgagugaucuauguuuuaggaagacaauucucuugauagcauggaggauuuuaauguaauaaggccuccauuuaccuuuugguauagcucugcuaauuuguuuacuugccugggauagucagcuagucagaaagcauucauugaauguuuaugauuaugcuguuugcuaggcacugagguuacucugguguagaggagugucuguuucuauacucuuggagugugaggucaggauaauaagauaauuccuuuuaguauucuuaaaugauauaguaccuacugccuuugcucaucuuguauuuucuaugaucugggaugcuccagcagacagaagagaaagcagacgacaguuuaaaagcauauagcuuuucaauaccaaacaagagacaugguaggguuuuugggcaggagcauaauaccuuuguucaaaaaugagcaguggcggcugggugcaguggcucacgccuguaaucccagcacuuugggaggcugaggcgggcagaucaccugaggucaggaguuugagaccagccuggccaacauggcgaaacccugccucugcuaaaaauacaaaaaaaaauuagccaggcgugguggcgggcaccuguaauccccacuacucgggaggcugagucaggagaaucucuugaaccugggagguggagguugcugugagccgagaucaugccacugcacuccagccuaggcaauaagaguaaaacuccgucucagaaaguccacucuugguauugggaaagagagauucaagcauucugucagauuuuaagagccaccaugauugcucugggcuugaguacaugaagccaacugcuuuagugacagguuggcugaaauuuaacuugugcaugauuaauuaaaauuuaaauuagggcuuuggagacuguggguuugagagcauaugacagugaauaaugaugaccugcauaacaucagguuaguugaaugugaguuuuagaaugaaaaucuuuuuguaugaaaacauuccuuauaaauaauguaacuuuucugagcugaauuaaaauauacccgggggggucaacaguauuugaauaaucuuuuuuuuuuuguagacaacgaccauuuuucuuauauaagaaauacuuacccaauaaauacuuaauuuagaaauaacuuguucuuggaaugacuaacccucauauugcucuauguaauaccaucccuuuguuucuauuguuagaacugucuuaugggccaggcgugguagcuuacaccuguaauuccagcauuuuuggagggcgaggcaggugggucaccugagguugggaguuugagagcagccugaacaacguggaaaaaccuugucucuacuaaaaauacaaaauuagccgggugugguggcgcaugccuguaaucccagcuacucgggaggcugaggcaggagaauugcuugaacccaggagguguggagguagcggugagccgagaucaugccauugcacuccagccugggcaacaagagcgaaacucugucucaaaaaaaaaaaaaaagucuugucauugugagaaucugcaguuuuaagggccacugaggguaggggaagaaaugucagauauuuuugaaaaguuuuggccuugaagguaaaguaaggaaagcuaugaaaaucaggaacugcuuaggugauguaaccuugagaguuggcucccaagcauauauggucaaucuguguauuggucccuggccuaauucccccauaccccuuucccaucacuaccugaaaauguucacaauccuuuuccccaacucauauguugaccagcugggucuuauuuggauuaauaggcuucuuuuuuuuuccccuuaaugcuaguauuauucuaugauaucaacgacagugagagguugagcaucccaaauccacaaagcuccgaaauccaaaacuuuuugagcacugaaugauguucaaaggagaugauuggagcauuuuggauuuuggguuuucagauuugggaugcucaaccaguaugcaaauauuccaaaaucugaaaaaaaauuccaaaaucuaaaacacuucuggucccaggcauuuuagaugagggauacucaacuuguacaguagaggauuuggggacagcaugagagacagcacaaaggacaggaagggaguacaagaaagugugaagguaccagaagacaaacuugucuggaguugucuuguuacaggaaaggaagaggaggugauaggucucauccauauugcccuuugauuucuggauucaaaacacaguaauaguaguaaugguaguaccaugguucaacccuauuauacauaccccaaauucauucauuuaagaaauauagauugagaaucuauauuugugcaagguaguguacuagguacugaggcuauaucuguaaacagaaauucuuacuuuuuugauguuuagauucugaguaaauuauauguuagaaaacaauuaaugagauggggaaaaauacagagcaagauaagaucaggagugguagguugcaauuuuaacuggaauagugagaauacucauugaaaaguugagauuuaagcaaagacaugaaggauaugaggauguaaacuguauagaugucugaggaagagccucuaggccaagggaacagucaaugcaauggcucuaaggugugagcaugccugauguguugaagaacaguaaggaggucaguguggauguaucagagugauugaguagaacaguaggagaugaggucagagaugugggggaugagaucacagagccagugcaagguuuuugauuuugauacugagugaagucaguggaggguuuugaguaggguagugaugugaucuaacuuagcuuuacauuuuguuucucucucauuuuauugugaacauuuucaaauguagaaaagagugaauaguauaaugaauacuuauaaccccauuacuuacaauuaaguuuauuaacauguugccauauuaaaaauauuaauuuauguuacaaauaucaugaaagcuucuuccuaaauacuauaguuuacgguuuuuaaaaggaagggcauuuuccuuuuuuuucuuuuuuugaauggaguuucacuccuguugcccaggcuggagcgcauggcgcaaucucggcucaucgcaaccucugccuccuggguuuaagcgauucuccugccucagccuccugaguagcugggauuacagguggcugccaccacgccugucuaauuuuguauuuuuaguagaggugggguuucuccauguuggucaggcuggucccgaauucccgaccucaggugauccuccaggaucaauuucauaacauaauuagauuacugucauauaauaaaccuagacuguauucauauuuuccaaauuguccccaaaaugcauuuuacaccugguauguucacaugaugaucuaaucaaagaccacauguuguauuugauugucaagauucuucgucucuuuuaauuuagaauaguuccccaccuucuccauuuuuuaauggcguugacuuauugaugagaccauuccuagaagaccucaucuuuuggauuuaucuaauugcuuuuucaucuuauuuguucuuuauuuccuguauuuguucuauacuuggaguuaggucuaaaggcaaaauauuuaauggcaaaaauacuucauagauuauguaacaucuaauguucgacugucuuuaaaugguucaguaaguuugugauagucugauuccucaguuauacaauggcauccccccacccccccaccaccuuucccuucaauaacaaauuaucugcagguugauacuuuggcagccugggaauauccaguuucucaucaacuuuacauuaaaugguuuagaauccauggaugaccuuugcuugagccaccuuucccuuuagggguuccaaauugaugauuuacuaauuuuaucaugcccuauauauuuauuagcugucauucuucuaauaaagaagaguugucccuuacuaacucaggcuguuugcuuuccuugaaauacgguuccuacuggaaaggcaggacaaaugauuaauauuuucccacuaauuacgagcuaucagaguaaggaguuucuuuaauagcagccuccaauggugacgugaguuggguguguacaugugugucuguggugagagagagagagagagagagaaugcaugugugugugugguuacuuagauuuucaauggaucagucugauuguguguggcagcaguggauauugaugagauucugaauguauuugaagguaaaccaauaguguuugcugauggauuggauacaggaugugagaaaguagaguuaaggacuauucugaaguuuuuuggacugagcaguuaaaaagauaguguugucaccaacuuagggaaaauuucagguagauuggguuuggaguguugggagggagaauuaggaauucacuuugcgcauguuaaguuugagaugucucuuagacauccaaguguagauaaucgacauauggaucugaagggguggguugccccuccgcaccuguggguguuuuucguuagguggaacgagagacuuggaaaaggaagagacacagagacaaaguauagagaaagaaaaaaagggggcccaggggaccggcguucagcauacggaggauccaugccggccucugaguucccuuaguauuuauugaucauuauuggguguuucucggagagggggauguggcgggaucauaggauaauaguggagagaaggucagcagguaaacacgugaacaaaggucucugcaucauaaacaagguaaagaauuaaguauugugcuuuggauauguauacacauaaacaucucaaugccuuaaagagcaguauugccacccgcaugucccaccuccagcccuaaggcgguuuuccccuaucucaguagauggaauauaugaucggguuuuacaccgagacauuccauugcccagggaggagcaggagacagaugccuuccucuugucucaacugcaacgaggcguuccuuccucuuuuacuaaugcucuucagcacagacccuuuacgggugucggacugggggacggucaggucuuucccuucccacgaggccauaucucaggcuaucacguggagagaaaccuuggacaauaccuggcuuuccuaggcaggggucccugcagccuuccgcaguguuuugugugcagugguuugugucccuggguacuugagauuagggaguggugaugacucuuaacaagcaugcugccuucaagcauuuguuuaacaaagcacaccuugcacagcccuuaauccauuuaacccugaguugacacagcacauguuucagggagcacaggguuggggguaggguuacagauuaacagcaucucaaggcagaagaauuuuucuuaguacagaacaaaauggagccuccuaugucuacuucuuucuacacagacgcaguaacaaucugaucucucuuucuuuuccccacauggaucugaguaaauaauuggauauacggaccugguguucaagagaauagaccaggccagaaauagaagugugggcaucaaaagcauguagaugcuauauaaauacaugacauuggaugaaaucacuaaggguuguauacagagaggcaagagaagagaaccaaggacuaaggcuuggggcacuccaguguuaagggucuaggagaagacgaggaaccagcaaauaagguagaugaggaacaacauguaaaguaggaggaaaagagagaauguggcauuuuggaagcuaaauagaggaaggaaugauuaaccaucaaaugccucugauaggucauuuaaggacugaaaauuaaccauuggagggaggucaaaacuagcaguuuugguggaauugggugauauuaagagauaauggaaagaguagaauuggagacagugacaauugacaacuuuaucaagcaguugcuacaaaggggugcagaccaaaugggaugguagauggcaagggaaguggguucgagauuuuuuuaagaugggagagagaacgcauuuguauucugauggguaugacugaguggaaaguggagagcugguguuacaggggagagaggugagaauuauuuggagcgguguucuugaggauagagaaaauggaguuuggugcuuaaauggguggauuaacuugauauaggaggauagagaguuuaucauaacagguauaaaggcaauauauguagauauaguuggguaggugugauugggaguuuguagaagucuaauugaucuaauuuucuuacugaaguagaaagcaaggacaucagcugagaggaugagagagggagguauuggagguuaggagagaagguagggaaguacaguuaugugcugcacaaugauguuucggucaacaauggaccacauauaugacggugguugcauaagauuauaaugaaacaggaacacguagcugaagaagaggcccaagaaaaggaaacuacaggagaagaacccccaagaaaauucacaguaaaggguuuagcagaagcuuuucagcaagcuccuuaaaaaguugaaaacgugggccaggcacgguagcucacgccuguaauaccagcacuuugggaagccgagguggguggaucacuugaggucaggaguucgagaccagccuggccaacauggagaaacccugucucuacccaaaaacggaaaaauuagcugggcuugguggugcagaccuguaauccuggcuacuaggguggcugaggcaggagaaucacuugaacgcgagagguggagauugcagugagccgagaucgugccacugcacugcagccugggugacagagcaagacuccaucucaaaaaaaaaaaaaaaaguuugaaaacauggaccccaaugcugaccaagguuuuuauuaauagagaggaauguacauggcgcauugucugcuuacaagcgaaucugugaugaaacaaacaaaccaggcaaaccaucguggcauggacauauuucugaaaagagugacaccuccucaagaagagccucagguccuucaggagguauuccagaagaagacauugucaucauagaugaccgcuucaugaguguuauugccccuaaacaucuucuagugggacaagauguggagauggaagacagugauacugaugauucugauccuguguaggccuaggcucauguguguguuugugucuuaguuuuuaacaaacauguuuaaaaagcuuaaaaaaucuuuuuuuuuuuuuuuuuugcgacggaguuuuguucuccuugcccaugcuggagugcaguggcacaaucuuggccucacugcagccucugccuccuggguucaagccauucuccugccucagccucccaaguagcugggauuacaggcgccugccacuaagccuggcuaauuuuuuguauuuuuaguagagauggaguuucaccauauuggccaggcuggucuugaacuccugaccucaggugauccgccugccucggccucccaaagugcugggauuacaggcgugagccacugugccuguccagcaaaucuuaaaaguacaaaaaagcuuauagaauaaggauauaaagaaaacauauuuuuguacagcuguacaauguguguuuuaagcuaagcauuauuacaaaaaagucaaaaaguuaaaaaaauauuaaaaaacuuauaagguaagaaaguuacaguaacuaagcuuaauuuauuuuaauuuauugaagaaagaaauauuaaaauaauuuaauguaaccuaaguauauaguguuuauaaaauauauaguaguguacagcaaugucuuagaccuucauauucacuuacuaacuuacccagagcaacuucugauccugcacacuccauucuugguggguguccuacacagguguaccauuuuaaauauuuuauaccguaauuuuuuuguuccuuuucuguguuuagauagguuuagauacacaaacacuuaucauuguguuacaguugccuauaguauucaauauaguaacuugcuguacagguuuguagccuaggagccauagaguauuccauauagccuacauguguaguagguuauguaccauauaggcuuguguaaguaugcucuaaagaggcauugaauguaucuccguuguuaagugauacaugauauaguugagugaauggcuaagacaaauggaacaugauuguccagcagcauuaagggcccauuugaggacagauacaugaaauuggcauuauggaaggauugucauuagugguaauaauaagauuuaggauauggaguaagugguuaagauaggguauagaagaucuuuggaagagaaaggguucaggagaaccaagaggcuacaugguagaaggcucaccuacauguauaugaaaaucuccaaaaguuaagaauuguagucagagagagugacagaggcuaauauuguugcaaaaugaagggcaguagacucaaggauccauaaauggcaucaauaggacaucacugaaaguggcauaguagggaacuccagagcucugucucgccacaaaaacaacauaacgaaguggaaaaaacuaucagucaacuuugcugcugucuuauucuuccccaguccuuucccugguugguguaaguuuuuuuuacuauauucuagagcucuacaaaguuaauugagagugcuguggcauuuuaaauugccugucuacuagcccccacacccagaucagugguggccauggugauagaagcccacacuccuggugcagguugcuaaugcuagagggagcaaagaauuguguuuuuggguuuuaaucuggcuaccugcucccugaaggacccacauaggggccuacuuuuguaucuuuugacugggaguauucucagggcugguauggcuuuugccaaaagcacuuaaaggcacaauuauugucuguaauggccuggagcaagggacaacagcugagacaagcaguagugagaccgaaaagccugagaaggaagacauuagaaaaagagauacauggggaaaaagagcuuuuuacaaaguugucauauauaccauaagaaggucaugcuuaugcucagagcugggcacaugcccagaaaaggccaacagagacccuaagcuuucucuucugggucugaguaggcaggaagugaagacugaggcagagcugugaauggucuggccaaacuuugaggaguguucuaaugcacucucuuuucccauuuauccaggccuuuaaaaaaacugucaauauacuaauuggucacuaagcuaacagaacauagauucaaguggccacacgugaugaagaauacaaacuuuacaaaaaaaguuuauaaaagucacuaaacacacacacacaacaauaaauccacaauaagcagcaucaaccaaccucuggguauuuggggguggagaagaaucuaaucuccauaguugcuacauaauauuaaauauguccaguuuuuuuuuuuguuuuuuuuugaggcagagucucccucugucacccaggcugaagugcaguggcacaaucucggcucacugcaaccucugucuccagguuucaagugauucuccugccucaaccuccuaaguacagcugggacuacaggugcgcaccaccaugccugacuaauuuuugucuuuauaguaaagacaggguuucaccauguuggccaggcugguuucaaacuccugaccucaguugaucugccugccucggccucccagagugcugggauuacaggugugagucacugugcccagccuagauaaggaauugaaaucaauaguccuaaaaugcuuuaugagcuaaaggaaaccaggagugugcugucucaccaaauaaauagagaacauccauaaagagauaaaaauuaugaaaaggaaccaaacaaauucuggaguugaaaaguacaauaacugaaauaagaaauucacuguagagguucaacaguagaauugagcagguagaagaagccaagccaaagaaagaacacugguuaaaguaacucuagguaaaauauaaaagccaguacuauuacauuugugguuuguaaguccucuuuuuuuccuauaugacuuaaaagacaaauacauaauaauuaugaaucuuuaaaaagauaauuucaacuuuuauuuuagacucgggguacaugugcagguuuguuaccuggguauauugugugaugcugagguuugggguacaauucaucccaucacccagguuauaaaucugucaaauggcacacuauaaaaauguaauuugugacuaacaauagguggggaggggcagggauguauaggugcagagguuuuguacacuauugaagugaaguugguauuaauucaaacuagguuguuuuaaguuuaaaauguuaauuauuauacccaaaggaaccacuaagaaaauaauuaaaaacuaaacagaaaaaagaaggggaucaaaauggugcacacacacaaaaucaaacaaaaaaggcagugauagaggaaaugaggaacaaaaauaugacagaaaacagguagcaaaaugauagaaguucauccuuaucuauaauuauuuugaauguaaauggauuaaacccaccaauuaaaaggcaagaguuuggcagaauguauaaaaaaucaugauccaguuacauacuguguauaaggaacucacuuuggauuuagagauacaaauagcuugaaacugaaaguauggaaacauauucugugcaagcauuaugcuggagagaccugggguggcuaugcuaauaucaaaguagacuuuaagacaauaaguuguuacaagagacaaugaaaaacauuauauaauauaaaauggauaacccauugagaagauauaacaguuauaaacauaccuguaccaaacaacagagccccagaguauuugaagcaaacauuggcagacuugaaggaaacauaguuguguaauuauuggacauuuccauacccuacuuucauuaaugguuagaacaacuaaccauuacuugacaaaagaugaguaagaaaauagaacacuugaacaacguuauauauauagaacauuacacacaacaacagaaucuacauucuucucaaagcacauggaacauucuuuagaauagaccauauauuaggccacaaaacaagucucaguugaaaucaugcaaaauaucaucucugaccacaacagaaugaaacuagauugcaacaauagugagggaguagugagugauaugaaauucaaagcuggguggauagagggagaauagucuggaagcaacaauaacaagcaaaaagaaaacugccacaucaccuccaggccugguagugugaggcgucugaggaaaacagcuaccaguuaacugcguuacaauggcagggcuguucucagggugaaccaggcucugugugagcaccacggugaaaagaaccuuuaaaugagaaauuuggauauagggaauuuugcugagaauggaucaugaauuccauaugauuccguggaaguauuucaaggauguggaaagguaugaugggacagaacagggauugugcauaacaguauguggaugagaguguggggcauauuguggugauguauuuaaacaagaaugaagggaguaaugaauguggcccuggugcauucaagucagguaguggaggacagguugucaauaaguuaaauaagcuuuugugaguuuguuuugaaacccuggccacaauucauuuuuaugggaaaauguuuugcuacuaaguaaccauuuauaagcauuuauuuuuacauguuuuuaaaauuauuuugagauggagucucucuuugucgcccaggcuggagugcaguggcgugaucuuggcucacugcaaccuccgccucccgggcugaagugauucuccugcuucagccucccagguagcugguauuacaggugccugccaccacgccuggcuaauuuuuguauuuuuaggagagacgggguuucauuguguuguccgggcuggucucgaacuccugaccucaggugaucugaccaccuuggccuugcaaaguguugggauuacaggcgugagccacugugccuggccuguaagcaaauuagaauuaggaaacuauuguuacauugaagacaucucaucuguuuuuaaaaaauagagugaaacaaugccuucuauaaaugaugcacauuaguuugguuagcuuuguauuuuauuugcauaauaucauaauugugggaggaaccucacauacaaaggucucauuuucaguauugacuauaaaaagaacauaguguauuguuacuguuugcuuuuuauuuacauuuggccaguuaguuauugccaguuauucucacuucacuguuccauucaucugaccucagcaguguuaaaauuagcuuugaaaauugauagcauucaaagauucuuauguuucuauguaggguccucauggcuggccuggaauugacuuugccauucuguacuuuaaaacaucgauuuauucaucuguaauauuuauguacaccuguuuuguggagaacaucagcugacagccagauauacuuagcauaaaacccaagaaauaaaauuaaaggaagaaaaauauaaagcaaaugcugaugguucuucugcacuugacaguuugucuaucugcgucuccacuaagaacuaacuugaaaaagcaaguuaagaaaacacacauguguaucagccaggcaugguggcucaugccuguaaucucaucacuuugggaggcugaggugggaggaucgcuagagcccaggaguuggagaucagccugggcaacauagugagaccccaucucuacuaaaaaaaaaaaaaagcugggugugguggcauauaccuguaguuccagcuacucaggaggcugaggugggaggaucgcuugagccugagaggucaggacugcagugagccaugaccaugccacugcacuccagacugggugacagagugagacccugucucaaaaaaaacccuccaaaaccaaaaaacacacaaaaaaacagaaaagaaaacacacauauaaacagaacugcagacuaaaucuugugcauuauaaaaucucacuuaugcuauucagcugugagauuuuauuuaaauguuaaccugcauuguaaauuguguccguuuuugaaauugcuuuccuuguguucuucagaagauguuccaaugugaaaagggauguuggcauaauaauccuuguacugaauucagauauuugguaagauaaggaagagcagugaagcauuuucuuggccuagaguauuugaucuaauuguucuuaguuauugguaggugaaggauauugcuuuaauuguccuuucugcacuaaauggaaacuuuuuuuuuuauauuucuaggaaccaaauggcgagacaccaucaucuuuauacagaguugcagcaguacuucuacaauuuaaucuuauugauuuagaugaucuuuauguacauguaagucaagugggcugcuaagaauacuugauugucugucccaaggguagggaagaggaguagguagccacauagcacccccaggauuggguugguucgagguucucaagucucacucuuugaagccccaauacauuguugauuuguguuuacuuuauaaagugaauaaauuuaguuauuuggcagucuaugaaaauuaaauaccuuuuuggucaccuuuauggaguuuaaguuuuggucaccuuuauggaguuuaaguuuggauaugaaguucaaguucuuaacugucaucaaggcauagcucauggggagagaggccaaguucuaaccaaugugguuuuuuaagccuuuuuauuaucuacaaaugaugggaaauauaaaguuaccuauauacugcuucuuucucucuaaaauguuaauuuuaggcauucaggaugaauggggaacuucauuaguguauuuuuauauuuaguauauuuaaaaaauauuuuucuuguguuauucgugugcacuaaaugacuauuaugcuuuuauugcuggacccaggauguagaagaguucaugauuguggcagaugaccucuaguuuaacaaaaauuuagucaucaguuucagaaucuaggcuaauaguauauaaauuccucuucuauuagguuuuguauuaggauaucuauuaauuuaaaacaaguauguccaaaggugauaucaucuucacugccuuugagaucacuuuauuaacaucauugccuauuuuuguauacuguggcuacagaguugaguaaaacuuggucuuuaccuuggaagcagucauacucuaggaagggagaaaaaaauuuugcauuauuuaauagguacucuauuggagauauucacaaagcucagaauagauagugaccauaucugucuugggggauuuuggaagacuuucccaaacuagugauguugaacugggaucuugauagacaaguaggaccaucuaggcugaaaugguagaaaacuuuguagguagaauuaacugaguauaaaggcaggaguuguuguuguuguuguuuugagacagagucucacuguugcccaggcuggagugccguggcacuaucucggcucacugcagccucugccuccuggguucaagugauucuccugccucagccucccaaguagcugggauuacaggcgcaugccaccaugcccaaguaauuuuuguauuuuuaguggagaugggguuucaccauguuggccaggcuggucuugaacuccugaccucaggugauuugccugccucagccucccaaagugcugggauuacaagcgugagccaccaugcccagccaaggcaggagauuugaaagggcuuuuuuauccccuuaugggacugucaggaagcucagagugguuggagccuagggugguauauagggggaaugaggauggaauagagaaagcuaaacuguuaacggcuuaagugacauaguaaggaaucuggauuuuucucuugggaguggagagccauauuaguauuuaaaggagagaugugauguagaaacugagaauauggaaaaguggacagaaaagggaaaauuuaaaaacacagguaugacuuuagagggaaguauagaccggcauauguggaaaguacaaauugaugauagauuuauuacucauuaugauugcauuuagcaguaaauguaagcagacugagugguccuguuaauaugacaaagauugucaaguggaauuaaaaaugaguuuauuauuuauaugagaaacagcuuaaacuuaaggauaaugaaauguugauaguaaaaggaugagaaaauagaucagcaaacuuacuguuggacaaaauagacuuuuuggcagaaggagauaaagcgggcuacuucauaauaacaagauugugcucacuaggaagauaaaacaguucuaacuuuacauguaucuaaugacauauucucaaaauacacagaaauaaaaguugagagaacuauaagaagaaacaguuuggccauuagagggaguuguaauugucuggguaaaagauaaggaccuauggccgggcgcaguggcucacacuucuaaucccaacacuuugggaggccaaggcgggcagaucaucugaggucaggaguucgagaccagccugaccaacaugcugaaaucccaucucuacuaaaaguacaaaaucacccuggggugguggcacaugccuguaaucccagcuacucgagaggcugaggcagaauugcuugaagccgggaggcagagauugcggugggccgagaucgugccauuucacuccagccugggcaacgagagcaaaacugucucaaaaaaaaaaaaaaaguaaaaaauaaaacaagaggaccugugccagguguauaaguacagcaauacaaauguguuugauugccaggggagaacauacagaaugagaaaaagucuugcuuacuuccuugcaccaguccauagugacuuuucucucucccucccuccuuuuuuuuuuuuugauaaauggaaugaaaucuauaauguuuaauaguucauuauuauuuucauuuacuguuuacauuaaaccuaguuaauggaauagauuaugcauuucuaggggucaggaacacuccuuuuauagcuuaucauagugacuagcagaaacuacugaguaauuuguugccuaaaguuuucuuuguguuaggguuauuuuauaaaugucuucauuaaucaucuuccacucauacaaggugacuguuugagauacuugagccuuuuucauaauggaggguugacuaugcacauaguacuuuuucuuuugcaauaaauuaguaacuagcuugugacuuaaauaagcuccuagaaaaagugagaugucaaguuacuaauaauuuuucuacuugaaauuuuucauuuagaugauuuaaauuuaucccuuuguguuauucaguaguucaccuuucccaaauuggauccauauugcaaugcuuuauuuaauuuggaguuuagccuuuaauggggaaauuuguaauguuuuuaauggaacugcuauauauuuucuuggguaaacuaauaaauucaacggaaaacaucacuguugugguauuacauuacuuuagggacucugucagacagaagaugugaaacuuugagcugcgacuugauuuuaaaagggguacagaauucagguacuucauucugucaaauuauaagaaaauaacugaaauuuacuuagaaggcaaauggucacgaauaaguuagacuucuuauuuauaguuuuaucaauugagaauaguguuuccuuuuuauaugaacaaguaguugguauuagcuauuuuaugaaauuuuaauguaccauuuuuagcuucuuccggcugauaauugcauuauggaugaacacaaacgagaaauugcggaagcuaagcaaauuguuagaaagcuuacgaugguuguguugucuucugaaaaaauggaugagcgagagaaagaaaaggaaaaagaagaggagaaaguagagaaaguauguaauucauucuaguaaaauuaacacuaucuucuggauuuugaauuaugaaauuuaacuucuaaauagucauuuauggaagaauaauuucuuaguuuucauuuugcugaaaccucauuuucuggaucauuugcuacagugguuuuauuuuuaaucugaauggcuccuuuuuaagagaagcugucauauuuuuuuucuuguauaaauuucaaaauguuuucuaaguaaaaucacaaguuguauugacuuuaauuguccucuguguauuaguggcccucaaauccuaaagagauucucagagaugaugaauucugguuuccuguggcacgacauaacaugaaguagaacuuaauuccaagucuauaaacuguaaugccugugucuguuuuuuuuuuuaauaaauuuauuauuauuuuugagacagggucucacucuuucacccgggcuggagugcaguggcaugauuacagcucauugcagccuucuaccuccugggcucaaguaauucuccagccuuagccuccugaguagcugggacuacaggcaugcgccaccacacuuggcuaauuuuuguauuuuuuguagagaugggauuucgccauguugcccaggcuugucucaaacuucugagcucaagugaucugccuaccucagccucccauguuccuggacuauaggugugagccgcugcgccuggcccugauguuuuuucaauagcuaaaaauuuugauuguacuugcaggaauauauuguuuaauuucccaugaauagcaaauauuuuugauguguugcuuaggucaguuuuuuaagugacaaaguauuaagauuucuugaugucuguauccugaguaucuuaguuuugacuauucauuuuuagccaccugauaaccaaaaacuuggcuuguuggaagccuuauuaaagauuggugauuggcaacaugcacagaacauuauggaucagaugccuccauacuaugcagcuucacacaagcuaauagcccuugcuauuugcaagcucauucauauaacuauugagccucucuaccgaagguauguaacuuuauacuuuauuaaucauugagguagaaauagcuuaggacuacaacaaaauguauauuuaucuuaucuccucaaaccaagcauauauuuuaguaccuuuuaucaaaagauaagaacuauucacagaguguaucagucugauauauauuaaucagugacuugucuucuaacgucuagaccagggguucuagaaugugugcugcaguguagucugaaaacuacaaguuagacuucuagguuggguuuguuccauugagaguugaaacuccauucuucugguuuugacuuucccuccuuucagugggugggaggggcaaagaauuccugagguuuuuucuuaguguaauuuuucuccauccuggcugaguggcucugagugaggacauugccucucugauucccuuaccuuuccuggcauauaggcugcuguucuggaaauuaguaguuuagccucucuuaucauccccaguuacuaugucaucuaguccuuuagcuuucugccuacuugcaggauacuuaggagcaguauugauagcagcuguggcuacagccccauagaucagagccugccucaaaagccucagccuugugacuuuuguguagcugcugguugcugccgucagugucacuucaugggccguggaccaugcaggcuucuuagagagugaccccugugacuccacaguggggcaccugcugagcaggugagaacucuggguaugguguccuaaagugaccuucuuuuauuacauggcucacuuucccuacgaccacauucuacauacccuagguuguggaauccagauugagaaaugucaguugacuugaaucaguguuguuauauccauauuuuucuguuucaucuuccagugcaucuuagguccaucccuuguugcccauucccauauccaaguucccgauaccggccaaguuuaaaaacagauucagaugguguguguuaaauguuccuugaaauccacacuucucugauuaagcaguuaauuuggaacauucuccucugagcucugauuuuuuuuuucuaaugacuguuguuuuuauguguuucuaccaguugagaauuaucugguguaauaaaguuaggcacaauugaaauguagaaagcaaauaugagcaagaaaaaauuucacugauuaagauaacuuuguuaaaaugguagauauuguaguguguguguauauaguuauauuuauuauauacuuauuuauuuguuuauuuauuuauuuuacuuuuuaaaauagaguuggaguuccuaaaggugcuaaaggcucaccuguuaaugcuuugcaaaacaagagagcaccaaaacaagcugagagcuuugaagauuugaggagagacguguucaauauguucuguuaccuugguccucaccuuucucacgaucccauuuuauuugcaaaaguggugcgcauaggcaagucauuuaugaaggagguaaguaagauuuuucuuacaaaccuaaauuuugaaaugaaaauauucugaguauacuuguguuaugaguaucuuuagaaauaaaaauaugaaccucauuuaauaaaggguuauguugagugagguuuguggaaaauuccaguguguccuaaccauaugcagucaaguguugcuuaaugacaggugagaaaugcaucauuaggugauucgucauugugcaaacaucagagaguguacuuauacaagccuagaugguaugaccuacuacauaccuagacuauaugguauggcccguuacuccuaggcuacaaaccuguacagaauguucccguacugaauacuguggggaguuguaauacacuguuaaauauuuguguaucugaacauaucuaaacauuuaaaagguaauaccuugcacuaagauguuaggacagccaugauaucacuaggcaauaggaauuuuuuagcucuaauauaauguuauaugacccuggucauauaugugguccaucaaccgaaacauuguuaaauggugcauaacuguauauauuaauauaaacccaaaucuagcgagauuauuagucaagucccucacaugggaaaauauacuucagacaaguggcugcuuuuuuaauucccuuaugauuagugguuacuuagcauucuuuuccuucuagucauuuucuugaguguaguuuucaaucauugcugcuauguguaagaagucuuuucagccucagacuguuaaggacccauucuuuuauuuauuuauucuuuuacuaagauuuuuauugaaauaaaacauacauacggaaaaauacagcucagugacuuucccuaaacuaagcacccauauguccacuacccaacucaaauaguuuacagucccaccaacagugugaaaguguuccuauuucuccaccuccucuccagcaccuguuguuuucugacuuuuuaaugaucgccauucuaacuggugugagaugguaucucauugugguuuugauuugcguuucucugauggccaguguugagcauuuuuucaugugucuguuggcugcauaaaugucuucuuuugagaagugucuguucauauccuucgcccacuuguugaugggguuguuuguuuuuucuucuaaauuuguuugaguucuuuguagauucuggauauuagcccuuugucagaugaguagauugcaaaaauuuucuaccauucuguagguugccaguucacucugaugguaguuucuuuugcugugcagaagcucuuuaguuaguuagaucccauuugucaauuuuggcuuuuguugccauugcuuuuuguguuuuagacaugaaguccuugcccaugccuauguccugaaugguauugccuagguuuucuucuaggguuuuuaugguuuuaggacuaacauuuaagucuuuaauccaucuuuguggaagacaguguggcgauuccucaaggaucuagaacaagaaauaccauuugauccagcaaucccauuacuggguauauacccaaagaauuauaaaucaugcugcuauaaagacacaugcacauguuuguuuacugcggcacuauuuacaauagcaaagacuuggaaccaacccaaauguccaucaaugauagacuggauuaagaaaauguggcacauauauaccauggaauacuaugcagucauaaaaaaggaugaguucauguccuuugcagggacauggaugaagcuggaaaccaucacucucagcaaacucacaaggacaaaaaaccaaacaccgcauguucucacucauaggugggaauugaacaaggagaacacuuggacacaggaaggggaacuucacacaccggggccuguugugggguguggggagaggggagggauagcaucaggaaauauaccuaauguaaaugacuaguuaaugggugcagcacaccaacauggcacauguauacauauguaaccaaccugcacauugugcacauguacccuagaacuugaaguauaaaaaaaaaaaaacagaauaguaccugcaaccuagagucuuucucaugcugcauucuaguuacuauccuaaccauaaccauuuaugcuuuuuuuuuuuaaaaaaaucagcuuugagguauaauuuaaauacaguaaacuucuacaauuuuaugaguuuugacaaaugcauacaguuguauguucaccaccacaaucaugauauagaaguucccuccuuccauugcuguuccuggcaaccucugauaggcuuuccaucacuauaguuuugcuuuuucuacaucuuauuuaauaaauggaaucauaugguauauacucuuuucagucuaguuucuuccacuuaagcuuuugagauuuauccaaguugcaugugucaguaguuccuuuauugcugagugauauuuuauuacauagacguaccagaguguagccaccaguugaugggcguuuggguuguuucuaccuggaggcuauuauaaagcugcuuucaauauuccugcacaagccuuuugggaggcauguguuuuuguguccccaggggugggauugaugggucauaugaguaaguauauguuuaauuucauaagaaauugccaaacuguuccaaagcaucuguaccauuuugcauuccuaacagcuauuguaugagacuucuaauuguuccacauucccaccaacacuuguuguugucacucuuuuaaguuuuagucauucuaguggguauguagugguaucucacugagcuuuuaauuuuguuccagugacuagggauguugaucaucuuuucaugugcuuauuugccauuuauaguuaucuuuagugaaaugucuguucaugucucuugcacauuuuuaaguugcguuauuugucuuuuuauuauugaguuguaagaguucuuuauucuggaugcaaggccuuaucagauaugugauacugugaaauuuuuuucuuagucugauuugccuuuucauuuuguuaacuaucuuuugacagcaaaaaauuuuaacguuuaauucugauuuaguaguauuuuuuuuuuuuuuuuuuuuuugagacggagucucgcucuguugcccaggcuggaguccaguggcgcgaucucggcucacugcaagcuccgccucccugguucacaccauucuccugccucagccucccgaguagcugggacuacaggcgcccaccaccacgcccggcuaauuuuuuuuguauuuuuaguagagaugggguuucaccguguuagccaggauggucucgaucuccugaccucgugaucugcccaccucggucucccaaagugcugggauuacaggcaugagccaccgcgccuggccaguauuuuucuuuuaugguuugcuuuucaugcucuaagaaaucuuugcccagcccaagguuuuaaagcugaaaagaauuauacauaguuucuuuaaaguugugaaucaugacaacuaaaaaaaccaucuagacauuguuaaaaaggacaaaugcagggugucuucaguguuuggugauuauaucuaauuugaauuuuagacaacagcaacuguauagaaauacuaacggcuauuguguauuaauuucuugacaucugaaauauuugacuuggcuuuuuauacuuagcugguagauuuuuuuuguuuguuuuugagguaggauugcacucugucaugaaggcuggaguguaaguggcaccaccauggcucacugcagccuugaucucucaggcugaagggaucuucccgccucagcagcccaaguagcugggaccacaggugcaugcgccaugccuggcuaauuuuuuaaauauuuguagagacagagucucccuauguugccuagguagguuguuuuuaaugcucacaaauuuacauuauguaaagguacucuaaagaaaucuguuaaguaguuaauuauuacuauauauauuguuuauuauauaauauucauaugaaauggaaguauaucauuucuaaauguugggaacauucuaaguccucuguucugacuauuuugaaauauauaauacauuguuguuaacuguggucacccuacucugcuauugaacauuggaauucauuccaucgaucuaacugcauauuuguaccuauuaaucaaccucuguuuauucccccucacccccagccucuguuaucugucauucuauccucucccuccaugagaccacuuuuuuguuuuuuuggguuuuuuuguuuguuuuguuuuguuuuuuuuugagauggaguuucgcucuugucgcccaggcuggagugcaauggcgcgaccucggcucacugcaaccuccgccuccuggguucaagcaauucuccugcuucagccucccgaguagcugggauuacaggugcccgccaccacgcccaacugauguuuguauuuuuaguaaagacaggguuucaccauguuugcuacgcuggucucgaacuccugaccucaggugaucugcccuucuccgccucccaaaaugcuggaauuacaggcgugagccacugugcccggccaugaggccacuuuuuuagcuuucacacgagugagaacauaugauauuugucuuucugugccuggcuuauuucacuuaacauaaagaccuucaguuccauccacauugcugcaaaugauaugauuucauucuuuuuuauggcugaauaguauuccauuguguauauauauauacaccacauuuucuuuauucauucaucaguugaugggcacuuaacagguugauuccauagcuuugcuguugugaguaguguuguaauaaacaugagagugcagguauucuuuugauauauugauuacuuuuccuuuggauaaauacccaguaaugggauugcuuguaacaaauuaucacagguaccccacaaauauguacaaauauuuguaccaguaaaaaauuuaaagaaauuuagaaaggaaguauaauaauguuucacucuugauuuuuauugucugaaaaggaugauucauguuagcuagugccugcucaagaaacaaaagggcuguauuuuuuuccagugcaucauaucaggugcaugugaagucacuuuguuccauugcuggugauguuaacuuuaucauuugguuaagaugaucucugccagguuucuccacuauacaguuacuauuuuucccuuuguuauuaauauaugucuugugggaagauauaacacuuugagacuauauaaacagacuguuucuccucauacuuucaccuaccuaaugcugcucuuuuaacuugaaaaucuuaauguucagaucucuuguucugaaauucuuugguuauaaauaucaaacuugugagcaggagaccaaaccuucaacucauggaaguccuguacauaaccauauacaauauuauuaccaagauacacacuugguagagcugucacacuuccccucuugccuucuccauugcauucauccuguacacccguucugcccuaguugugccagguuccugcguuaacuccagucuauucuugcagagaugaagggcagaagggaagagaaaaauguuaguuuugaccauagagaccaguguaagaagaaaucugcguuuucucauuacuagguuugugauggaaaagugaauccuuacaguuaucugaguuagaauuuugaucuauuuuuacccauaaaagauuuugcugugacaaaucauuuguucuguguuuaaauggcuuuuguugucuagcuuggaauucaagcaggauuuuuaagauugcuucuaaagggugaauaugaccuuaguuccaaauaauguauuuacaauuacacuucuuuaacaaaucucauuuauaagcuuaggguugcuuuuauauacaaauuauguauauuuuuaaaaagaggcuuauauacuuguaccagauaucacuuaacagaauuaucuuccagcccuauaguuauuuguaauuuauuucucugauuauguguauauauguuucuuaaauuugagguauguaguauauaggacuaacuccuaguacagugauucucaaacuucagcaugccuuguaaucacccagaggacuuguuuuuguuuuuguuuuuuuuugagacguagucucgcucuguugccaggcuggagugcaguggcgcaaccucggcucacugcaaccuccgccuccuggguucaagcaauucuccugccucagccucccaaguagcugggacuacaggcacgcgccaccgugcccagcuacuuuuuguacuuuuagcagagacgggguuucaccauguuggccagaauggucuugaucucuugaccuugugauccgcccgccucggccucccaaagugcugggauuacaggcgugagccacugugcccggccaaggacuuguuaaaauaaauuguugggccccauccuuggaguuuuugauucaguaggucuugagaugagaccuuagaauuugcauuucuaauaaguucuccugugauguugaugcuccuggcccaaagaccaaacuuugaggauucuuguucuaggcuuaagcaguggaggaguguagugguucuagaauuguuucauguaaaaggacacauuuugcuauaauaacauuuucuuuaauuauagagcacuaacaugcucaccugacauacucaaauguuuuugauagcaccuauauauuuuuuagacuuuauuuuuuagagcaguuuuagguucacagcaaaauccagaggaaggcacaaagauuugcuauauagccccuguucccauaugugcacagccucccuuguaaucaacaucucccaccagagugguacauuuguuacagggaugaauccacauugacacaucacccaaaguccauaguuuacaucaggauuugcuuuguguuguacauacuagggaucucaucaaauguauagaauauuaucacugcccuaaaaaauccucugugcucugcucauuuaucccucucuccucacaaccccuggcaaccacugagcuuuucauugucugcgugguuuugccuuuuccagaaaggcauauaguuggaaucagauaguauguagccuuuucagauuguuuucuuucacuuaguaaaauuauacacauuuagguuuccucugugucuuuucauggcuugauagcucauuucuuuuuagcacugaauaauauuucauugucugcauguaucacaguuuauccauucaccuacugaaggacauguugguugcuuccaaguuuuggcaaucaagaauaaagcugcuguaagcaccuuuguacaaguuuuuguguggaccuagguuuuugaucuacucugacagucuuuguauuuuaauuggugcauuuagaugaucaguguucaaaguaauugauauauuuggauuaauauuaauaucuaccauuuuucuuauucuuuuuuaguuuuugccccuguuuuuuguucuuguuuuugucuuccacucuuuuccugcccuuucuggcccauuuuugguuaaguuuuuuagugauuaccccacaguuugcaauguacauuuacaauugauccaaguccacuuucaaacacacuauuuugcuucauggguagugugaguaccuuacaauaacagcauaauccuaauucuuuccuccugacccuugcaucacugaagucauucauuugcuuauacacacacacacacacacacacacacacacacacacacacacacacgcauaugcguauguaaucaaauacauuguugcuauuauuauuuugaacaaacuuauuuuuguuauauuaguuaagcauaagaaaaauaaacauuuuaccuucacuuaaucuuacuucaguguuucuuuuuuuguuuguuuauauauauccaaguuucugaccuauauucuuucucucuaaagaacuuacuuaguauuucuugcaaggcaggucuacuggcaacaaauucccucaguuuuugucugagaaagucuuuauuucuccuuuacauuuaaaguauaauuucacaggguccagaauucuaguuuuuuuuuuuaucuuaacacuuuaaaucuuucacuccacucugcuugcauaguuucuaaggagaaauguuuuaaauucuuauccuugcuucuccauaagcaagguguucucccccacacccagcaucuuuuaggauuuuuucuuuuucuuugauuuucuguaguuauaacaugauaugcccaaguguaguuuuuuuguuuguuuuauuuauuuguuuauuuauuuauuuauuuauuuacuuuuugcaucugucuugcuugguguuuucugaguuucccgcaucugugguuuggugccugauacuaguuuggggaaauucugucaucauugcuucaaauauuucuucucuuccuuccuuccuucugcuauuuccauuaugcauauguuacaguuuuuuaguccuacaguucuuggauauucuguucugccuuuuaucagacuuuuuucucuuugcuuuucaguuuugcaggcuucuauggagauauccucaagcucagaauuuuuuccucagccgcguuaucucccaauaagccaucaaaggcauucuucauucuguuacaguguuuuuuaucuguaggauuucuuuuuuuauuuuuucuuaaaauuuccauaucucugcuuauauugccccugcccuuuuuuuugagguggaauuuugcuuuugucauccaggcuggagugcaauggcaugaucuuggcucacugcaaccuccgcccccuggguucaaggaguucuccugccuuagccucucuaguagcugggacuauaagcaugcgccaccacacccagcuaauuuuucuauuuuuaguagagaugagguuucaccuuguuggccaggcuaguuuugaacuccugaccuuagaugaucuacccaccuccgccucccaaagugcuggaauuacaggcgugagccaccaugcccggcuccccgccuuuguuuuuuugagacagaguuuugcucugucacccaggcuggagugcaguggagugacccuggcucacugcaaccuccgccuucuggguucaagcaauucucaugccucaggcuccugaguagcugugauuacaggcacgugccaccaugccuggcuaauuuuuuauauuuuuaguagagacgggguuucgccauguuggcuaggcuggucuaaaacuccuugccucgagugauacaccugccuuggccucccacagugcugagauuacaggugucaaacaccguacccagccagucacggaaucuuguuugucuuuuucccuccuagaaguaaauagcauaaguuccucucucucucucucucucuuuuuuuuuuuuuuuuuuuuuuuagacggagucucgcucuuguugcccaggcuggagugcaguggcaugaucucugcucacugcagccucugccucccggguucacggguucaagcuauucuccugccucagccuccucaguagcugggauuacagguguccacuaccacacccagcuaauuuuuguacuuuuaguacagacgagguuucuccauguuugccaggcuggucuggaacuccugaccucaggugaucugcccaccuuggccucccaaagugcugggauuacaggcaugagccaccacgcccggccauuaaguucccuuuuuuuuuuccccagacagagucuugcuuugucgccaggcuagagugcaguggugcaaucucagcucauugcaaccuccgccuuccagguucaagcgauucuuauaaauauaaauaaaauauauuuuauuuauuguguuaggaaugggggagagagauucuguguuuauguuuuacucugccaugguaauuaauuugucuagaaagacuguauauguggcuauuucauacguuggcgcuugguaaaagccaaagugcucuaaauugauuuacaaauaaagcuuaguaaaaccugaaauuaggcaggcagaauauaccccagacuggguauuagaugacauuaggaaauaggugagauagugaucuuguguuaauauggcggcauguccuuguucuuaggagacacccugaauuauuuugagaaacgugucaugccugcaaauuuuuuuggucugccgaaaaaagggcaaaauguuaauuguugaauuuagcagguagguauauauagcuguuuaguauacuauccuuucaguuuuuauguaauuugaaauuuuucauaauaaaaauuuggauugcaaggagaaugugccuuagaccaguaguuccaaaacuguaguuuauaaaccaaaugcuuuagaacuuugaggcugauguuuacuacuuuuuguuuuuuugucagcuauuacaggagggggagucugauucugcuucauuccacuuauuuguuuucaaaauugaaaaucugucuugguuauguagcuuaaagcccaagauucuucauagaguaguuuuaagaaauaaaugcgaagguuuuagucuguacguggcacauagugaguacuaaauaaauuguaguaagaaugagaagaaggaggaaguugaaaauaguguuuuaauucacacaguuucagguuccagucuuuucaaaaaucuuguguuuuuuuccucucucuucugagacauaauccugaguaguguuugaaauguucaaggggcagggauacgaaaaauagaucauuaguaauaaaaaauuaucuaguuauaucuacaacuuuuccauuuauuccaugacuccccaaaaacccuccuccuaauaaaccuauaaaccuauauauuuuuuguguguccuguacuguuaugcagcccgaucagcuacugugucuuuauagggcaauuuuggaacuuguuuugggccauucagcuaauagccuauauaggcauaauuguggcuaguuuuauucaaacuuuuuuuuuuuuuuuuuuuuuuuuuugagacggagucuagcucugucacccaggcuggaaugcaguggcgcaaucucaccucaccauaaccucugccuccuagguucacgcgauucuccugccucagccuccugaguagcugggauuacaggugcgcgcccaccaugcccagcuaaucuuugcauuuuuuuuuaguagagaagggguuucaccauguuggucaggcuggucuugagcuccugaccucgugauccguggucucagccucccaaaguguugggauuacaggcgugagccacugcacucugccuauucaaacuuaaaaauucaguugcucacaggcaaguguguguguauauauauauauauuuauuauuauuauuauacuuuaaguucugggauacaugugcagaacgugcauguuuguuacauagauauacacgugccauggugguuugcugcacccaucaacccaucaucuacauuagguauuucuccuaaugcuaucccuccccuaacccccuacccugcuacagaccccugugugugauguuccccucccuguguccuuguguucuaauuguucaacucccacuuacgaaugagaacaugcgguguuugguuuucuguuccuguguuaguuugcugagaaugaugguuuccagcuucauccaugucccugcaaaggacaugaacucauccauuuuuguggccgcauaguauuccaugguguauaugugccacauuuucuuuauccagucuaucauuuaugggcauuuggguggguucuaagucuuugcuauugugaacagugcugcaguaaacauacgugugcaugugucuuuauaguagaaugauuuauaauccucuggguauauacccaguaaugggauugcugggucaaaugguauuuuuaguucuagauccuugaggaauugccacacugucuuccacaaugguugaacuaauuuacaacaguguaaaagcauuaccauuucuccacauccuugucagcaucuguuguuuccugacuuuuuaaugaucaccauucuaacuggugugagaugguaucucauugugguuuugauuugcauuucucuaaugaccaguaaugaugagcauuuuuuucauguuuguuggcugcauaaaugucuucuuuugagaagugucuguucauaucauucgcccacuuuuugauggguuuuuuuuuucuuguaaauuuguuuaaguuccuucuagauucuggauauuagcccuuuugucagauggauagauuacaaaaauuuucucccauucuguagguugcuuguucauucugaugauaguuucuuuugcugugcagaauaguuuaauuagaucccguuugucaauucuggcuuuuguugccauugcuuuugguguuuuagucaugaagucuuugcccaugccuuuguccuaaaugguauugccuaaauuuucuucuaggguuuuucggguuugaggucuuaacguuuaagucuuuuaauccaucuugaguuaauuguuguauaugguguaaggaagggguccaguuucaguuuucugcauauggcuagccaguuuuccaacaccauuuauuaaauaggggauccuuuccccauugcuuguuuuugucagguuugucaaagaucagauaguuguagaugugugguguuauuucugaggcuucuguucuguuccauuggucuauguaucuguuuugguaccaguaccaugcuauuuugguuacuguagccuuguaguauaguuugaagugagguagcaugaugccuccagcuuuguucuuuuugcuuaggauugucuuggguacacgagcucuuuuuugguuccuuaugaaauuuaaaguaguuuuuucuaacucugaaaaaagucacugguagcuugauggggauagcauugaaucuauaaauuacuuuggaugguguggccauuuucacgauauugauucuuccuacccaugagcauggaauguuuuuccauuuguuuguguccucucuuauuuccuugagcaguaguuuguaguucuccuugaggagguccuucacaucccuuauaagcuguauuccuagguauuuuauucucucuguagcaguugugaacgggaguucacucaugauuuggcucucuauuauugguguauaggaaugcuugugauuuuugcacauugauuuuguauccugagacuuugcugagguugcuuaucagcuuaaggagauugugggcugagacaaugggguuuucuaaauauacaaucaugucaucugcaaacagagacaauuugacuuccucucuuccuauuucaguacccuuuauuucuuucucuuggcugauugcccugaccagaacuuccaauacuauguugaauaggaauggugagagagggcaucccuguguugugcugguuuucaaagggaaugcuuccagcuuuugcucacucaguaugauauuggcuguggguuugucauaaauaguucuuauuauuuugagauauguuccaucgauaccuaguuuauugagaguuuuuagcaugaagggguguugaauuuucucgaaggccuuuucugcaucuauugagauaaucagguaguuuuugucauugguucuguuaaugugauggauuacguuuauugauuugccuauguugaaccagccuugcauccccgggaugaagccaacuugauugugguggauaaacuuuuugaugugcugcuggauucgguuuugccaguauuuuauugaggauuuuugcaucuauguucaucagggauguuggccugugugucugccagguuuuaguaucaggaugaugcuggccucguaaaaugagcuaggguggugucccucuuuuucuauuguuuggaauaguuucagaaagaaugguacgagcuccucuuuguacuucugguagaauuuggcuuugaauccgucuuguccugggccuuuuuugguuguuagguuauuaguuacugccucaauuucagaacuuguuauuggucuauucagggauuccacuucuuccugguuuagucuuggggggggggcguauguguccaggaauuuauccauuucuucuagauuuucuaguuuauuugcguagagguguuuauaguauucucugaugguaguuuguauuucugugggaucaauggugauauccccuuuauaauuuuuuauugugucuauuugagucuucucucuuucuucuuuauuaaucuggcuagcagucuauuuuguuaaucuuuucagaaaaccagcuucuggauuccgugauacuuugaaggguuuuuugugucucuaucuccuucaguucugcucugaucuuaguuauuucuugucuucugcuagauuuugaguuuguuugcucuugcuucucuacuucuuuuaauugugauguuaggaugucgauuuuagaucuuuuccgcuuucuccugugggcauuuagugcuauaaauuucucucuaaacacugccuuagcugcaucccauagauugugguacauuuugucuuuguucucauugguuucaaauaacuuguuuauuucugucuuaauugcauuguuuacccaguagucauucaggagcaaguuguucaguuuccauguaguuguguguuuuuuucuuaaucccgaguucuaauuugauugcacugugguccgagagacuguuuguuaugauuuccauuauuuugcauguccugaggagucuuuuacguccaauuaugugcucaauuuuagaauaagugugaugugaugcugagaagaauguauauucuguugauuugagguggagaguucuguagaugucuauuagguccacuugguccagagcugaguucacguccugaauauccuuguuaauuuucugugucguugaucugucuaauauugacagugggguguuaaagucucccacuauuauuguguggcagccaaaaucucuuuguaggucucuaagaacuugcuuuaugaaucuggaugcuccuguauugggcgcauauauauuuaguauaguuagcucuucuuguuacguugaucccuuuaccauuagguaaugccucucuuugucuuuuuuugaucuuuguuguuuuaacgucuguuuuaucagagacuaggauugcaaccucugcuuuuuuugcuuucuauuugcuugguaaaucuuccuccaucccuuuauuuugagccuaugugugucuuugcacgugagaugggucuccugaauacagcacacugauaggucuugacccuauccaauuuccuagucuaugucuuuuaauuuaggggcauuuggcccauuuauauuuaagguuaauauuguuauaugugaauuugauccugucauuaugaugcuagcugguuaucuugcuuguuagucgaugcaguuucuucauagugucgauggucuuuacaauuugguagguuuuugcaguagcugguuucagucuuuccuuuccauauuuagugcuuccuucaggagcucauguaaggcaggccugguagugacauaaucucucagcauuugcuugacuguaaaggauuuuauuucuccuucucuuauaaagcuuaguuuggcuggauaugaaauucgggguugaaaauucuuuucuuuaagaauguuuauuuuuagcccccaaucucuucuggcuuguaagguuucugcugagagauccgcuguuagucugaugggcuucccuuuguggguaacccgaccuuucucucuggcugcccuuaacauuuuuuucuucguuucaaccuuggugaaucugacgauuaugugucuugggguugcucuucucgaggaguaucuuugugguggucucuguauuuccugaauuuugaauguuggccugucuugcuagauuggagaaguuuuccuggauaauacccugaagaguguuuuccaacuugguuccauucucuucgucacuuucagguacaccaaucaaacguagguuuggucuuuucacauagucccauauuucuuggaagcuuuguuuguuccuuuacauucuuuuuucucuaaucuugucuucacauuuuguuucauuaaauugaucuucagucucugauauccuuucuucugcuuggucgauucggcuauugauacuuguguaugcuucaggaaguucucaugcuguauuuuucagcuccaucaggucauuuauguucuucucuuaacugguuauucuaguuagcaauucucuaaccuuuuuucaagguucuuagcuuccuugcauuugguuagaacaugcuccuuuagcuuggaggaauuucuuauuacccaccuucugaagccuacuucugucaauuccucaaacucauucuuuguccaguuuuguucccuuguuguugaggaguugugauccuuuggaggaggggaggcauucugguuuuuggaauuuucagccuuuuugugcuguuuuuuucucaucuucauggauuuaucuaccuuuggucuuugucguucagaugggguuuuuguguggacauccuauuuguugguguugacucuauuccuuucuguuuguuuuccuucuaauagucaggccccucugcugcaggucugcuggaguuugcuggagguccacuccagacccuguuugccuggguagcuccagcagaggcugcagaacugcaaagauuguugucuuuuccuucuucgggaagcuuccuccuagaggggcacccgccagaugccagccagagcucuccuguaugaugugucugucgaccccugcugggaagugucucucagucaggaggcacagggaucagggacccacuugaggaagcagucugucccuuagcagagcuugagcacugugcugagagauccgcugcccucuucagagcuggcaggcaggaacguuuaagucugcugaagcugugcccacagccgccucuuccccaaggugcucuguccuaggguguugggaguuuuauuuauaagccccugacuggggcugcugccuuucuuucagagaugcccugcccagagaggaggaauuuagagaggcagucaggcuacaccagcuuugugacgcugcagugggcucugcucacuuugaacuucccagcagcuuuguuuacacugugaggggaaaacccgccuacucaagccucaguaauugcacacgccccuccucccgcugagcuccagcgucccaggucgacuucagacugcugugcuggcagcgagaaugucaagccggugcaucuuagcuugccgggcuccgugggggugggaucugcugagcuagaccacuuggcucuguggcuucagcccccuuuccaggggaguggaugguucugucucgccugguguuccaggcgcuacugggguuugaaagaaaacuccagcagcagcagcuagcucagugucugcccaaacggccacccaguuuugugcuugaaacccaggacccugguaguguaggcacagaggaagucuccuggucuguggguugugaagacugugggaaaagcuuaguaucugggccagaaugcacuguuccucacugcacaguccuucacggcuucccuuggcuaggggagagaguuccccgaccccuugcacuucccgggugaggcaaugccccacccugcuuuggcucgcccucugugggcugcacccacuguuuaaccagucccacugagaugagccggguaccucaguuggaaaugcagaaaucauucaccuucuucguugaucuuguugggagcugcagaccggagcuguuccuauuuggcuuucuugccagccaccgaacccgugauuucugagaguucauagaaguuaggcugauuacauuuaaacaauuugccaggucucaacaauccauauagcuuuuuuuaacuucccauuugaucuucuuagaucugcaaguuuuauuuuccauuuucaaaaucuuuuuuuuuuuuuuuuuuuuuugagacagagucuuguuguguugcuuaggcuggagugcaguggcgugaucuaggcucacugcaaccucaaccuccaccucccagguucaagcgauucuccugccucagccucccgaguagcugggacuacaggcgagugccaccaugcccagcuaauuuuuugcauuuuuaggagagaugggguuucaccauguuggucaggcuggucucgaacucccgaccucaugaucugucugccucagcuucccaaagugcuuggauuacaggcgucagccaccgugccuggcccaaguacaguuuuugaucuucaagaggugccuguacucuguccuguucauauuugaauucccaaugccuggaaucuagucauugaaugaaugaaugaaugaaugaaugcaugucucuuguucucccucccuguuucugucucccucccauuucuagcuggcauucaguaaaacuuauaguauuaugugagagucuuacaguugcuuugaauuaaaaagcaaauuaaacuaaaagaaaaaguaucaagggaguagaauauauuuuccuaccaaacaaaagaaaauugcuuuuauuugcauguacuucuugauuuaauuuuguacauucuugcuauaauucgacuuugauaggaaggucuuuuacugcucuucuagaugguuuuauuuugcuuccuauauuucuuuccccuuuucaaauuuuccugcuuaaugaaaucuagagaauugauguuugaaauugauaugaaaccuagagaauagaugcuugaaacucauaugagucaccuagaaagggaguuaggacaacuuaguaaauaagaaaauguuuuauuucuaugggaaaaaaacugugugucgcuuuauuagguuuguuuaaauuauaguauaccaggaaaggaggagcuuaacugucuuuuuccccgacauaauauaccauaaaccuaguuuuuccaguuacaggauaccuguauuuuugcuucccaauguacacccuaugugccaccagaauuaugugugugcuaccuuaccaccccgaaaccaaaccaaaccaucuggcuuuuuucugccaggccacuccuuuauaacccaguuccuucuuugcuuaccaggauauauguugacuuaauaaauuauuucugugaaaggaaccauaccuuuuuaaccugccaauuaaaaacaaauugaguguauguauuuucccauaaagguaacauggcaggcccugaauuaguguuaugugaaaauguagcauaacaguuagacuuuuccugugguaauauccauuauauuacugaagugugaaagcguaugcauacacaaaacacccuuaucuaccaagaaaauaagaagcuuguuaucugcauauuagcuuuucccucuuucucacuugauauugagcuaaauccuugccagaaaucuagauugucacugguugucaguacuucaguugucuuuuuggccucuacagacuccgccagcccucugucuguuuauauucacacaaguaucauucacuguuucauuuugaauuaauagacauccuugucaaacaucacuuuaggggcucaucuguaaaucugcaaauuguuuauauaauacggacccaggauuuuucauucagucuguacaauuuaagcaaugguuuugucuuuguuaguaauguuacugguauuuugggcuuaucuuucagugaggacuuugggaguggugaauuaaaagauagauuuaaauuucuuugcguuuaauuuuggcuuuguuuuugcauuuuuguugcuuuaguguuugauuauacuaauuccauagaagaaaaacuauaaucucuggauggaaaaaugcaaauguauuauaaugaaguuuuuguacuggccacaauuuuuuuuuuuuuuugcucuuguuguccaggcuggcgugcaauggcacgaucucggcucacugcaaccuacaccucccggguucaagugguucuccugccuaagccuccugaguagcugggacuacaggugugcgccaccaugccuggcuaauuuuuguauuuuuaguagagacgggguuucgccauguuggccaggcuggucucgaacuccugaccucaggugaucugcccacguuggccucccaaagugcugggauuacaggcgugaggcaccgcgcccagcccuugcuacacuuuuauaauaaauucuuagaucaauuuuaggaugcuuugguuugauagguugagaaaagaauugguuuauaaaaauugacacuuaaaauucauggaugucaaguaugacuuagagguuagaaacagauaaaauuuaaaaagguuaacaggcuauauuuaaaaucuacauauuuguaaaaaguaagaacaauuuacaaccaugugcaaguuaaaguuuuuucaaauuagaaauuaauugugacaucauaaucuuaaccuuuuuguauuuuauuaauuucuuuuuuuaaauuguaguuucagucugauggaagcaaacaagaagauaaagaaaaaacgguaagagacuagaaaaauccaauaaugugucuaauguuugucuugcuacaguauauuacaaauuuuacugugaacaagcuuuaaucaucuguaugaguaauuguuuuauaauguagaugcugauuauaguuuuuggcggcauaugcaaaguuaucuuuuaagauuaacauuuuuuccccugauguugaaaaaggaagagagauaaaaguuccucauuccuuugcuaccccuuuccuuuccucaccccauuuuaugucuucgauggagaaacauaaauaagcuuugugaaaagggugggugaggaaugggauauuguguguuauguuauuaagaaaugguaauuuucccaaggcuguuauaaauuuauuguugguuauauuaauauagaccucuuacugaaauaacuuuuccuucuuucuuuuaggaaguuauccuuagcuguuugcuuagcauuacugaccagguacuacuuccaucucuuucuuugauggacugcaaugcuuguaugucugaggaacuauggggaauguuuaaaacauuuccauaucagcauagguaaauacauauuauuuucauguuuuuaacuauuaguaauucuaguauauuaaccucuaaguguuuaacuuuuccuaauucuucaucucaucguuuuuuaagauaucgucuguauggccaguggaagaaugaaacuuauaacagucacccacuuuuaguaaaaguuaaagcucaaacaauagacagagccaaauauaucaugaaguaaguuuuaauuuauuuuucauauuaaucuaaauuauaucugaaucuaauauacuuucuuucagguagcuugucugagccucaguuuugggaaagccuauguguugugaaugguauagcugauuuauauacuacagauggaaugacuguuaacugugguuuuagcucauuuugacuaccaaguuaauguuuucauaguuguuguguuuacauauggauaaaaaucuaauggaaauccucuuuaauaugugcaucauauuaugggaugaagguuuuguuuuuucuuuuuaaggacagccugcuguggccuuugcuuaccuuuagugauuugugcaagguaguaaaaguucuagcaauuuccacugcugaaaguuaccauaaugaauuuuuuuaaucuguuaggaagaacuaaugaaauuauccagaacuaucuccauagggagucaacuuuugagaaauuucuuuuuuaaaaaaauuuguacacuuuuauuuucauaucauuaaaaacauaagagugauguucuacuucccaguagauuauuugaaguuuaauuaugaaaaucauguacuucagauuaguauuaguuuagaugcuuaauuguauugcuguauugcaaguguuuucaacgaggcuauugucaguugucauuccuuuuuuaaauucauggcagugguaugguuauucuaauuaaaaguaguucguucucaguuuauuuagauuuaacaguguguaaugucuguuaaauguuguccuugcccagugauauuguuucuggucacagccuauugggaaaacaggugugugcaugaucacaaucuaguuguuguuuuuuuuuuuuuuuccugugagccuauggauuauauugaaacaaccuaguauaauaggugcuguuauacaguaugaauaaagugcuaugggaggauagaugagacuaaaugauuucacuugggggaguuuuguuuggcaggaguugauauuagaucugaaagaguuucuggacuuaagaguucuccagguacaguuucuagcuuaacaacagcagcuaauauuuagggagcuauuacuguaugugccaggcauuaaacuaagugcucugcauggauuguuuaauaauacauuaagcauuuuuaaauaccuugaauucauccacugucacuaccacuacuaccuuaguuauuuuaucugguguauuauaguuguauauucucuuaccuaaaaauccuuuggugacugacuuuaccugaagguauauguuaagcuuuauggcauggugauauaaauaagagguccucccugguuugucccucccugcauccaaccuccuuuccugccaauucuacuuccagauguacugagccuacuuauguccccuaaauguaccacucucuccuuagcuucucuuccccuguauauacuuuuuguucccucuguuuguacagguuuucccuuaccuuccuuucccccuuuccaucuggugaccucauucuuggagagugagcuccaguguuacuucuagugaaggcuucccuagcauaaacugccagacacaaucaaucuuuauuuccaucacuauucuuuagcauauaauguuaucauaccucuagguaccuugcuaugauuguuuuuugaauaguuuauguguuuacaugauuuaaguuucaguaaauauaaaagguauaaauacagcaaaaagucucacuccauccuccaucuacucaguucuuccccucaaggaaaaguaaccacuguuuagucucuuauuuauccuuccauauauucuuauguauaugcaagccaauacaauauauauuaucccccucuuauauuauuauuauauuaauauuguuuuucuuuguaaaaaugggaccucacuauguugcccaggcuggucuugaacuccuggccucaagugauccucccaccuugaccucccagcgcuggaguuacagacgugagcuaccacaccccagccaccuuuuauauuaucaauagcauauaaguacuguucuguugauugcucuuuuuuagaauauugaaauuuaauaaaugaauuuaaaucugucuccuucacuggaccaggcuugagagcaggaacuguuacucuguuauucauccuuguauuucuuauuuuuuuuuuuuuuuuugggagauggaguuuugcaccguugcccgggcuggagugcugcaguggcacgaucuuggcucacugcaaccuccgccuccuguguucaagcgauuauccugccucagccucccaaguaguugggauuacaggcgccugccaccaaguccagcuaauucuuuguauuuuuaguagagacgggguuucaccauguuggccaggcuggucucgaacuccugaccuugugauucacccgccuuggccucccaaaguggugggauuacaggcgugagccacugcacgcggcuucauccuuauauuucuacacugaccuuagcuaaaaggcugagacacaaucuuccuuguauuucuaaugcuuaguacuuugacugucaucguaggcauuaauaugaaugaaugaauaaaaauacaauuuacuacagaauaguaugugcagaauuuuuaauauacuuggauuuuuguuauauuuguaagcuauaacuauuuuaccaggcuuaaacaauaugauuuuguuacuguuugaaguuuuuacauugagcauauaauguauuaacuuauuacuuguagaauuucaugaguuuugaauacuauuuaaaacaugagcuugcuauagggcauuuaguaauucuuucuacaaauguuuauuauguuccauaugcuagacacugguaguuugaggggaagacaaagacaagaaaauauuucuuuaauuuuuguuuguuugucccuccagggugauggaggcagaagggaauggaaugaaaaacagagaaaggagggguuggccuuggcaaguagagggaggcaccugaaauauugggguuagaaauagggacagguagugguaaguuggaaauuugaacaaaauacuguauagcuaacuuuuaaaacuaauggucucucuuuucuaugaaaccaaaacugggauauggagaauuggaaagggaagcaguugaugaaacaguuuugauugauggggccaguuuugucaugagaaauuaauuaaagcaaguucgucacuuggagaauggucacaucuccugaauuauaaacugaauucauaauuuacuucauuauauuuucauccuagaaagcuuccuuccugucacuuguagccuuuugaagucucuagauuuauuauguaaucaucucaggagaggcauuuaagauucuguguaauaauuguuuugaacuguaagaauucauagauaaaauuugcagaaugcuggcaaaaggauaaugagcaaaggaagaaauaaagaggaaggaaaggaguagaauuuaguuucaaaauauuguuuaccuugaauaugaaaagcagauaacuuuacauauugagggaguaaaguuacauaaguuuacagauaacacaguaacucuguuagagucacugagacagauggcacgagacauuucauugcaugacaccaaauuugauaucuuaaucccuaaacugaugaguccuccuaaaucugaaauaauuuugauucuuuguaagaagaguuuuauguacuuguagaguacauuaagaguuuuacugauuauuagacuauuacuauaaaguggaaauguguauuuuauaaauguuaagcauuuaauauaaaauguuaauauccucugagagaaucccuaaccaaaauagcccaaauccuaccauaaaggaugugaugaauguaguuguuuacaugaauccauuuuggauauuuggggaauaauugcuuuuucccccacgaugauguaacaaagcuaucaacauuacaaggaauguuacuuaagaugauccgugccaccuuuuucuuccuccguaggcgccuaaccaaggaaaaugugaagccuucuggaagacaaauugggaaguugagccacagcaauccaaccauuuuguuugauuauguauguuuugagguuaauauuauuuuaagggauuuuucuuucuguugccuuuaaaucagugcaaguggaaauagaaugauguuagaaaaugaaacauuguaagguuaugcuaaaaacaaaauuacuacacaauauauuuaacacauugaucuauuuuaauaguaauauguaacagugcuacuauuacaggcaauauaauaguuauuuuguauauauaauguuauuuuguauaccacaucuugauuucugguauuacuugauuuuagacuuuuagaaacauucaaauaacauuucauugugauuuauauguaauacuaucacugcaauauuuauuuauuuauuuauuuuuuugagaugaagucuugcucuauugcccaggcuggagugcagugacccgaucuuggcucaccgcaaccucugccucccggguucaagcgauucuccugccucagccucccaaguagcugggauuacaggcgcaugccacugcacuuggcuaauuuuuuguauuuuuaguagagaugugguuucaccauguuggccaggcuggucuugaacuccugaccucagguaauccauccaccucgaccucccaaagugcuaggauuauaggcgugagccaccacaccuggcccauauuuagagauaucuaaaacauaugagagagacuagacucuuucauuccaaaauucagcuuuaggccuggaauuauuuccuuuuuaaauuaauuuuuuuaagaugcaagggguacaugugcagguuuauuacauggauguauugcauaaugcugagguuuggguuucuauugaacuccucacccaaauagugagcauaguacccaauagguaguuuuucaaaccuugccccaccccacuuaacuuuuagaguccccagugucuuucuaucuuuauguccguguguacccauaguaaaguuucaggauacaaaaucaacauacaaaaaucaguagcauuucuauguaccaauaauguucaagcugaaaaccaaaucaagagcacaaucccauuuacaauagccacaaaaaaaguaccaagagauacaucuaaccaaggaggugaaagauuucuacuagaacuauaaaacacuguugaaagaaaucauagaugauacaagcaaauggaaagacauuccaugcucuuggauaggaagaaucaauguaguuaaaauguccauaccgcccaaaggaaucuacagauucauugcaguuccagucagauuaccacugucauuuuuuauagaauuggaauuauuuucuaacugaaaaauguagccuaagaaaauauucucuaaggcagugauaaaauaguaauuucuauauaaauaugaaauauuuauauagaaaccacuuuguuaaauauuuauauaggaaaccacuuuaauuauaagcauuauuucuuuugaaaaauagaaaguguagccauuacuuaguuggcacaguagaaauccuuugaucaguuaaugccuucuauuguuuguugcuguuuuccagaucuugucacaaauacagaaguaugauaacuuaauaacaccuguaguagauucauugaaauaccucacuucacugaauuaugaugucuuggccuguauccuuucaagugaaguaauauguagauuucauauuuaauagaucauaugguaaacguuuuauuuucauucuauuuuccuuuaguaaccaucugagguugauucagguggcugaucugaaguuuggucagucaauuguguguguguguguguguguguguguaugugagagagagagagaguguguguguguguguguguguguacgugugugucuuuguguuguauaaagggagacauguuaggcuuaccaacuuuuuuuuuuugugugugugagacagacuuuugcucugucucccaggcuggaaugcaguggcacugucucggcucauugcaaccuccgccuccuggguucaagcgagucucuugccucagcuucccaaguagcugggauuauaggcgugugcuaccacaccuggcuaauuuccuuguuuuuaguagaggugggauuucacuagguuggccagggugaucuugaauuccugaccucaagugauccacccaccuuggccucccaaagugcugggauuacaggcaugagccacugcacccaguuggcuuaccaaacaucuugauauugauggaaucugucuugauugcugaaagauggaaaguaggcuaaagaagaaauguugguacuacaguaaguguauuuuucaauaauuaguuuuagcaacaucccuggucuuggaaaacuagaaaaauaauuuguaaugaccaacaauuuugccccuaugauguggcauauucauguuuuaagggucuuuauuagagauguaaugacuuaguuuuuucuuaauguaugaaagauuguaucauugaagcuuuagcuaauccagaaaaggaaagaaugaaacaugaugacacaaccaucucaagcuggcuucagaguaaguauuuuuauuuuuccaaagaugaaauuacuaucugugguaacugccauguuaugcauuuuauuaccgaugcuuagagacuuuuagaagccuauuuguuaagaguugcugagaauaucuagcuacugaguuuguucugcagagcccuuggcuauguaaggagguugauaugguacuuauuuauuuuccuaacuuaagagaccauuauugacugugauagaauuuggguaagcauuacuggggaggugaaaucuccuucuuuuuauuuuauuuuuuuuucgagauggagucucacucugucauccaggcuggagugcaguggugugaucucgacucacugcagccuccgccucccagguucuagcaauucuccugccucagccucccgaguagcugggauuacaggcacgcgccaccacgcccagcuaauuuuuguauuuucguuagaggcaggguuucaccauguuggccaggcuggucuugaacuccugaccucaagugauccgcccaccucggcucccaaagugcugggauuacaggcaugaaccaccaugccuagccaaaaaucuccuuuuuaacuaacauuauuuuauaggaguugaucguaagggaucuagucucauuucuucccauuccauccugagguuccagucaucuuaaaagaacaaaaacuugacuuaguuuaaccaaaaaaacuaaccauauuucuuuuuaauucuuguaccuuugguuucuagcagccaguuccuuuucuuucaacuuauuguaucugauagcggaaucuugcaguggcuccccauuguccuuuaaaguccgaaauguuuaauaagucauacaaguaaguucuuuugaaaucagguccuuuugcacuguucuagccucaucuuuucccugcuucccgauauucuagauuccauuaauacugaacuucuuguacuuuccaugaacuuuugcccauuauucacuugacuuggaauacccuucauggcccacuccauguucuguuuauucauuagauuucagcuuagaggucacuuccucuggaaagcuuuuucuguuaaugcucccacccacaagucugaauugggcgcuccucuuuuauauucccauggagccuuuugcucaucauaguuauuuguuuacuuuucuguaucuuccacuagacucagcuccuugagggcaggacuuguguuuuguccaauaucauuuaggugcuuagcaaauaguuguggaauaggcugcagagcacuugacuuuacuugaaucuccuacucuuguauuggcuggggucuccucccuauucaugguaugauaaggaccauugguuaaaguuggucucuugucugcuucuaggucugguaauacuuuauuuucuugcaccuccacaacuaguagcauguuccaagauaaaaagagauuuuuuuuuuucuugacucacauucaggggcuggcauuuugucauuuauucaaguuuacugagugaucugcaagauuuuguuauaacuuaguuucacaaacucuggaaucaggcugcaaagauuugacuuacugcucuacuuuguacuacgugaccaugagcaaguuacaugacauaucuguucugaauuugccucaucaauagguuauaccaaccuaggauaauaguugcaaggauuaaaugagauaaucauuauaaagugcuugguacagugcuugacauauguaugcucaauaaauauugguuauuguuauuauuaugaagcuccauucaacagcaucagcaauacaauuauugcuaccucauuuuguuuuagagguuuaguugaaaugauacuugugcauuuuguuuuaugaguuguuuuuacucuuuuuuuauuuuauauaggucuggcuaguuucuguggugcaguuuuucguaaauauccaauugaucuugcuggucuucuucaguauguugccaaucagcuaaaggcgggcaaaagguauucauagcaaauuauacauaaugaaauucaauagaguacuuuuggugguuugggguuauugagacucuguuaucccgaaagacuacuuauuuguugguuguaggcucaaguagaauaguugcucacuuauuuacauaaaauucuuuaguuaaaugauaacuuaauacauaaauagacaccuuuuuucaugaauaaauguacuauaugacuauauauguuaaugcacuaaaaagauacuuucaguuauuuugacugccuauuaggcuuuugaguaaauggcuaauaugauacauuguauaucuucguauaacaaaacauacugcacuaggucaguaugcaguaauugaccugugucacauugaacaucugguaggaacuuguuuaucuugaggguguauauaauaccuuuaaagcauaauuuuugaauuugaguuuuagagauacauaaggcuuucauaccuuuuggacaauguccuuuuuucuuuauaaauacugaaguuuauuuuauuuugggucaauaucagugcuuagaguuugaauuaguauguauguguauuaaaccucaugagaaguaaacugacuagaaucaaagaaccugaauuguuuucagaagcuuucugguagaaagcaaacaaacaaaaaauuaaaagcuacuugguguuccaaacaaguauuaccuaaguaauuauugacagauucuuauuuuggcuuagggaaaacuuaaaaaaacuuuaaacuuaugauuuuaugggcacaucccuuaugcucaucucucugccauuucuauauauuuuuauucuucuuugucuauaggccaggagaauauauaucauuuuuuaaucuauaacucagcuuucuguacugugaauacaguuuuugugaccaucuaauuaaaacauaguuuaaagaaaaaauaaacuguuucauugguacuuauauacuaguuuucaugagggcuuucuuuaaaaaaaacaaacgaaacuaaggaaagcaaggcaaguugagagaacaaacauuuaauaagaaucuuagaaaaugguucuuucgucuauuagcuugugucuuggguaugucugacuuuauguuuggaaaaacaucuguauguuuuaggaaagaauguuuuuacuuuguuuagauuaauuaaagaagaucuuagaggacauaagguauuauuuccauugguaguccuaaacuuugcagauuaaaaagcauaacuguuggcacauuacugaaaugugcucugggcuggccacuaaauugucaucuuuggcucagauaccacaacuuagaacuucuuuuuuuccuuccuucccugccucgcuuccaaguguaugugaccaugcuacaucuuugucccuguuuaguaaauggauuauuuagaaauggcucuauaccaucaaaaacauuuuggccauccuguauuggaggagaaaaaaugcuaugaaggacuuuauugggucaacugauaaaaugaaauaugaaugguagauuaaaguauuguaucagcguuacauguacuaaaauugauaacugugcugugguuauuuaagagaauagcucucuuaggaaauucagucuuagaaauuuuagggguagaaggccaugauguaaauaauuuucccucaaaugauuaaaaaauugagugugugacuauguauguagagaggggcuccagagagggagagaaaaugcaaauaaucaagcaggaguaaaaauguuaccaggugaaguugagguaaaggauauaugggugagcuuuguacuauuguuauuuuuccauccuaucuguaaauuugcaauuauuuccaaguaaaaguuaaaauaaacuuacgcaccaaguauuugucaauauaguucuaggaaugcaguuaaaaacugcuucagccccuucccccauauuuauauacaaauaauuaaggguuucucaguauauuaauuacaauacauuguuacuuuuauauuugaaguucuaacuauagacuguuucuuuuuucuuuuugaauaguuuugaccugcuuauauugaaagaagugguacaaaaaauggcaggaauagaaauuacagaggaaaugacaauggagcaacuagaggcuaugacugguggagagcagcuaaaagcugagguaagaauugcuauuuuuguucaucaacuuuuaaaauucauaauguaugcacggucauaguaaagaauccaaacaauauguaaguuuauaaaaccaaaugucaaagccauacauaccuuccuuucacaaccaccccugccccccuuuugaaauugagauacaguaauuacuuuaacuuuuuaaaaaagcugaaacaaaguauaaaaggcaguaaguaaugcauccguaaggaaaauaauuaccaaauaaggccgggcgugguggcucacgcuuauaaucccaacauuuugggaggcugagguggguggaucaccugaggucaggaguucgagaccaaccuggccaacauggcaaaacccugccucuacuaaaaauacaaaaaauuagccagguguaguggugggugccuguaaucccagcuacuugggaggcugaggcaggagaauugcuugaacccaggaggcggagguugcagugagccaagaucucgccaucguacuccauucugggcaagacagugagaugcugucucaaaaaauaaauaauaaauaaauaaauaaaauaaucaccaaauaauuacuauaucuucuaugauccuugauauccucacucccuuaagucuuaguugcucuguugaaucugugccauacugaauaaugaauaauccuuuaugaggggacugcaagguggaaaauggaaaauaugcagaaauuuaaauucaguugacauuugucuuuaagccagugacuguagucaguaauagucacugaaauaaauuuguguaagggaaggaauguggaauguaggaguuuuuuauauuaagcauuuuaacucaacuuuuuucugugucuuuuucaaauuagcauggguuauguacuguacacugguaaauuugugucuucccuugugcagggugguuauuuuggucagaucagaaacacuaaaaaauccucucagagauuaaaggaugcucuauuggaccaugaucuugcccuuccucucugucugcuuauggcucagcagagaaaugggguaaucuuucaggaagguggagagaaacauuugaaacuugugggaaagcucuaugaccaggcaaguuaaaguggcuuuuauguuuauguacauguuuuuaauccuguuaaaggaggauaauguguuauaauuugaaaaaugucauuuuugcacaucauuugaauaugagacauccuaaugugaaagacauucuggaaauagggccuauuucuauguaaauugugauauauaagagauagcuccaagagauguuauauguaaggcugucaauuaauuaaauauuacaucauuaaauuccugcaacuucaaguuguuugcauuuauaucuuucccgaucucuggaaaucucagucauaacagaauagaugcuugcuugcccacuugugcaugcucacucucuuuucccuuuuuuuuuuuuuuuuuuuuuuuuugagacaaagccucacucuguuacccaggcuagagugcagugcaugaucucagcucacuguagccuugaccucccuggcucaagugaucagucuaccucagccucccgaguagcuggggauuauaggcaugcaccaccacaccuggcuaauuuuuagauuuuuuuuguagagucgggccucugccguguugcccaggcuggguugcugucucucuuuuucuuuguguuauaguugaugauaguuaaacacauuuugugggcuaaucuuagguuuugguacuuaauauuuauaaauauauucuguaaauaaaguuuucuucuuuuaagggcaaaggaauugacuucuguuugccuaugguuauuauuuuauuugauuuagguaaauauauucuacuaaaagugaugaacaacagcuugacauuuaagagaccuaguuggcuaguaaaaccuuggauuagucaaccugucagggccuuggcaucuuuuuuuguaauauggucaugugguuauacuuguagauagucucuaaaguccuuuuaaguuauaaaauuuggauucuuaauuguuaaaauauuccuaaaaugacuucuuaaucacuuuggaaaauauguugauuuugucuuauuuuuuaaauuuagugucaugauacccuggugcaguuugguggguuuuuagcaucuaaucugagcacagaagauuauauaaagcgagugccuucaauugauguacucuguaaugaauuucauacaccccaugaugcagcauuuuuccugucuaggccaauguaugcccaucauauuucgguaaguacaagugucuuugcugccgcucaagaacgauccaaauuauuucuuaacgguuuuaucuguaaguacauaucacuacagauuuugggggaaggucuuggcccuaaacuaggaucccuucuuuguuuccaauagggguacgaagcugugugguagagguauacaaaaaaggugaugagaaauuuggagucuaauugaucauuuaaucaaacaucugcuguuaguguuuacauaucaacugcuacagucucccacuucuuuccuaacuaacugcuacuugauuuaauuaucacuuuguuagcacuaugcagaaauuccuguguuauguauacacucugaagggaaaaagacaauaagggagugguguuaggcugcuucuuccccuuuagauccucucaauccagagaauuguuugccgucuuuguguaacgucuuacuguugucacaccccaugguagaucagucucagcugugcaagaggguaccugauuucuugacagacagaggugggagaauuucuucaucuuaggaauucugaccugcccugugcuaagugaacacacuaaucagcaauauggaauccuagcaaacaggaacaccugguugucugugguuggcugaacuuuuccagcucagaaaauggagcaggucauucaagcuacuuuuucucucuuacuuguguaaaauauuaccuuugucuuuuaagagauacaaaaaccuaaacaaagaaauggcauuucccucucaggcuuggaagaaaacagaaaacuaaaugaaaguggcuguauagccaagucagauauaagucuuuuaucuguaggcagcaugccacucucuggaaaagguguuucccagcaaucuugugguugugcuggaugggcauccaagcuguccuggggauccuugcuuuugcuucuugagugaaagccucuguugaagagccuucguugagagagugaaaauguauauuaggugauugcuauguccccucuauaaacuaucagcaggcucucuugaggauaauucagccaaacgcugcccagauuuuuuuuuuuuuuuuuuuuuuuuuuuugagauggagucucgcucugucuuccaggcuggagugcaguggcgcaaucucagcucacugcaacuuccaccucccggguucaagcgauacuccuaucccaggcucccaaguagcugggauuacaggugcccgccaccacacccagcuaauuuuuguauuuuuagaagagaugagauuucaccauguuggccaggcuggucucaaacuccugaccucaggugauccgccugccuuggccucccaaagugcuggcauuauaggcaugagccacugugccuggccugcucagauucuugagacgagauuuuugaacaauagugagaaguacagcaauaauuguggauaucaguucuauuccauaagucuaguuccccaggcaauuugaaauguagaacuguuaugucucuucauuugacugaaggugugaacuugaagugggaguuaaacugacuuuagacaaggacauauucaucuuggguaaauacgaaguauagccuucuuuucugaccaagccuauuuuucuaacuagauagugacuaugggguuccuagcaauagaaaucacagauucagacccagaggacuggggagauuggagcuaucauguaacccucucauaccuauaaacuaauuuuuaguuuuaauuguugagguugugguccaccuugagacacaggucugaaagauaggcuuuuaaccuaguucauauucuagaucuugcccagaacagguaauuaggcugucuuuuaugcagauaaugucagcccuauuuuaucccguuuuguuagaaccuuagcagaagucauucugcucaucuagauucauauuaguuaccuucaauaagaccuguccucuaaauuaaaaaacacucucuguuuucccaacugcuauucccucagguuucugaugcaauugggacuccuuuuucguaacuaauguucuuuguagcuuugucacuuacguggucucagugguugucagcaugcucucuaaaauggggauaacagagcauaaaucuucccacuucuagaacaauuguaaaauucuagaacaauuguaaaauugagcacucaggaaggaaggcagguaacugagcuguaaggagcugagacucuuuugccuaucacaguguagaacuggaagcagaaccuuugaucaucucguuuuggguuacguguuuagcacaaauagaaugauuuaagugauuuucuaacguaaggaaguaacuaguuuuaggacuuccuuuagguucguaugaagggugauaccuaacuuaaacaaaauuuucuggaugagagcucuuucauccuaaagagacugaaggaugugaaacaauagcagcaacucuguguuaucuucauauauauguguguguguguguguguguguguguguguguguguguguucauguauaauauauauguucauauauauguuaucuucauauauauagaauauauagaaaaaauauauauauuuuuguguguguauauauauguauaauauauuuggcauacacaucucugcagccccucccauuguacuaacaauuuuuuuuccucauacaauuaagaauauggcauuccucuguuuuuucccccaaauuaggauaaaccagucaaacgaaagaagcugcagcaucaguucucacaugcuuuaaacuucaauauaccacagcuuuucacagaaaaauuuauuuggcuuagcaguagaguaaccaguugguccugguuugccugggauguucccaguuuuagcacugaagucuuaaauccucagaaaucccugaauccccagcaaacccugacaauuggucacccuacuuagcagucuuaaaacaaauuucucauaacuuuucuuaguguugauccagcuuuuuuuuuuuuuuuaauuuuuauuuuuugagacagucuccuucugucauccagucuggagugaaggggcaugaucucagcucacugcaacuucugccucugggguucaagugauccucucaccucagccucccaaguagcugggauuacaggccugcgccaccacgccuggcuaauuuuuuguagagaugggguuuugacaugcuggccaggcuggucucaaacuccugaucucaagugaucugcccgccuuggucucuugauccagcuuuuuaauugacaaauuuuaacaguugguagggucugcauguagugauacuacauucuguccuaguuggcuauuacuaguuccauucuuccucuuuucucauguuaagaccuucuauuuguucccuugaauaucucaaaagcaggacuggaaacccuacauguucaaucccugauacagcagcaagagggaguagggugggggaaugaaagaggagaacaugcauauacccuguucacuuuacucaacaggucagauuagauaagaacccucugagaaucuccuaguuggcacacaguacuaaagacuggaauagcuuccagagaugauuuaucuuaaaauaaacguuguucauaagaaacuagaauuucuacaacaguuuugagauuggucaucuuuugauucuuuagaagggaauauagauuuuuaugccaugaaagucaaagcuauaaauuauguuguguguguauguauguauguauuuuuacuuuuuaucuacagucaaaguaugaugaacuuaaaaaaucagaaaagggaaguaaacagcaacauaaaguucauaaguacauuacaucaugugagauggugauggcgccuguccaugaagcaguggucuccuuacauguuuccaaagucugggaugacaucagcccucaauucuaugcuacauucuggucauugacaauguaugaccuugcaguuccacacaccagcuaugaacgagaagucaauaaacuuaaaguccagaugaaagcaauugaugacaaucaggaaaugguagguuuuuguucuaguaguucaagugcaauaacuuuaugguauucaauguuaccuauauuuugaaauuguuuuagcucugguuccuuaaaacagugaucuuguugcuauauaauauuuucuuaaaugggguuuaauaguuacuucugaguggggggccaggaguuuggugacuagguggagguuaugauuaaucaaaaauuauuugaguguccuuuucuacugacgacuaugcuaguaacuuaaagugauucaugugacucuaauagcaagagcaguaguucucaagaggagaguucuuuaggagaagacuauugagaagccgagucuugaaauggacaggccuugaagguagauuagguuuggaaauauggaagcagauagggaggucaccauaggguuccagcaaagacaggaaguagauugagguuuagggagaccacuuuuacugauucacuuucauguagugaauguacuuagugauucauaugaauaguuaugauggggccagauuauguaggcauuggaagucagggagaaaaguagacuugguaaaauugagagcuauuuuagauuccugagcaggauaguaauguaaaaaaugguacuuaaaaaagauuacucaugacagcaguaugaaagaugcuuuuugacuagcauuaggcuaaagaccagcuagguggcuuuuugggcagucuauugugagagcauagacugauggagguaguggcaguguacaaggcuuguaaaccagucuugauauaaaggagagggaagagucaaagaugacaccaugccugagacuaauagugucaguguugcaaauguagccuguucugaugguguaugaagaugccaugacaguguuaugaguguguugaauggagauaaaaguagcacguucaaguggaccuauauucauguuaaaguaguuauaaacuaucagccuuuaucucuuuaaacuuuucaauuaaaagaagaaagguaaugugcauauaguuagaaaagugucuaauugaauucuuuguagcccccaaauaaaaagaaaaaagagaaggagcgcuguacugcccuucaggacaagcuucuugaagaagaaaagaaacagauggaacauguacagagaguucuacagagauugaaacuggaaaaggacaacuggcuuuuagcaaguaaguuguuggaauuguuagguuccugaugcugguaaauuacagaaaacaaaacauuauaacuuuagagguguuaaaguguauuauguuuguauuucaacucaguguucccuaucccauucuuugguuauuuguuaaugcagaaucaacuucauguucacuggaggaacugauauaguuugcuggugaaguuaauuaacuuuuaacuacauauuggcagcuugucauucagcuuuucuguauaaaacauauuucuggagaaaucauagaaaaaaagguccacauaguaaaaaugauaaucaugaccaggcaugacauuugguuacaaacuauaaauaguuugugguuuauaguauucucuucacuaaagguaauauguugucauguuuaguggcuuugaggcacuuggggaagaaguuuaccacuuaauauauucuuccuuuauuuuuagaaucuaccaaaaaugagaccaucacaaaauuucuacagcuguguauauuuccucgauguauuuuuucagcaauugaugcuguuuacugugcucguuuuguugaauugguacaucaacagaaaacuccaaauuuuuccacacuucuuugcuaugaucgaguaaguuuuuauugcaaccuuuaaaaaguucucacacaaagauagcuaacauuauaauuuauagagguauuauuguguguuuaguuaaaaagcaugaacucaagaaccaagugucugaacuugaauccuagcucuacuacuuucuagcuguaugaucuuuggcaaguuauuuaaccucucugugccuguuuucuuaucuguaaagcauaaguaccugcuucauaagauuguugugaggauuaaaugaaucacuacacauaaaaaguaccugauauguaauaggcacucaagguuaaacuauuaacuaaguauuugaguuuacguguuguaucauaauagguagaacucucuucuccauucuuaaccuucacuucucaaaaaaaaaaaaaaagacaaaaaaguuuacaccuucacacacauauaaaagcagggaagcuuuucaguauggucauaugcacauuuugcauuuagcuuuuuucuuauuacuacauuuugugguuuaaaaacauaauguggccgggugcgguggcucaugccuguaaucccaguacuucgggaggccgaggcggguggaucacaaggucaggagaucgagaccauccuggcuaacauggugaaaccccgucucuacuaaaaaaaaaaauacaaaaaaauuagccgggugugguggugggugccuguagucccagcuacucaggaggcugaggcaggagaauggugugaaccugagacgcggagcuugcagugagccuagaucacaccacggcccuccagccugggugacagaguaagacucagucucaaaacaaaacaaaacaaaacaaaaaacauaauguauguuccaguaugucagcugcauauuuuuaauuucuaucagcauuuccucugcuuacucuccccguaaacccaguaauauguauggcuaagugguuaagaaacuauuauguaauaaaaaaaaaacaacuuauuauguaauaauaaugauaaauuuuuuuuuccuugucacuguaaaucagcuuucuuuauaaaaguucuuguuuugggugguuguuuuaugaaugcauuauuuccccacaaaagccaaaaucuccaaaguucucugcagugucauuauauaaagggaauauacauuuugacuaggcuuaccuguuuauuaugacuugcuguaagagaaucuucuaauauuuuuaacugauuuugaccuugauuuguuuauauuuuuuaaacauuuuucuccuguagguuuucucugacauaauuuacacaguugcaagcuguacugaaaaugaagccagucgauacggaagguuucuuugcugcauguuagagacugugaccagguggcauagugauagagccacauaugaaaagguaugacuaauaaaaacccuuauauuuuacccauguauauaaugaccacauccauuaauaucuagauaguugaguuuuaaaagagaagcugaguuuaagauucaguuguaaaacuguguuuauaagcacaauuaauuuguuauuaaaaugugcuauguacuuuuuuauucuaucucaaacugacauuccaaauuaguaucuuuguauaaguugaacuuuuugugacuaccuauccaaauacgcaugauguuuuuacacggaaacauugaucuagucuacuuaaguuucaauuucugcuauuuuguggaucauaauuuuucuuuaaaagugacaaacauuguuuccuuaggaauguggaaacuauccaggauuccuuaccauauuacgggcaacuggauuugaugguggaaauaaggcugaucaauuagacuaugaaaauuuucgacauguuguacauaaauggcauuacaaacuaaccaagguaaaaaaaaaauuggauuuuucaaaggcaaauuuuucucuguauacuugugcuuuuauaauaauggaucugaaaauguuuguuguaggcaucgguacauugccuugaaacaggcgaauauacucacaucaggaauaucuugauugugcuaacaaaaauacuuccuugguacccaaaaguuuugaaucugggucaagcuuuggaaagaagaguacacaaaaucugccaagaagaaaaagagaagaggccagaucuauaugcauuggcuaugggguaacaaaauuauauuuuaaugugauuuacaagacuagaugacagaaggauucugaagacuuuaaaauguuuuacaguguugaaguuuaucuucugccuucaggagauuaugggagauuaugcgaucauguuuccacaggcuggugagaguuaccacuucugauuaucaacuuccggucuauacuggaugauaguuuuuuuaaagucauguauaauauuucuugauugggaggaaauauaauuuuaucaucauaguuaacagaucuucaagaguaaaaaaaaaaagccaucuuaguuuaaggauuaguuuauagugaaauuguaauuuuuaagaaagcugggcguucuauaaaaaccuucaagaacuuauuaaaaauugguauuuuuuaauucucuagaaccacauaguagaaugaauaacuugcuaauuuuauucuuaaaaaccucauguuuauguuuuuugauuuguguuuguauauuuaaacacuuugugcgacuuucagcuacucugggcaguugaaaaguagaaagucauacaugauaccugaaaaugaguuucaucacaaagaccccccuccgaggaaugcaguugccagugugcaaaaugggccugguggugggccuucuucaucaucaauaggaagugcaucuaaaucggaugaaagcaguacugaggagacugguaugcuuauuuguagaaacuuauaaguaauauauuuuauuucaacaaagugaaauguuuuguaucacagaacgaguacaaugcuggcuuaguauuacuuuuuauucccuagauaggaguauauaagcguuaagaaguaaucagcuugcuguuucuuucuaauuauucucuaaucauuuugcucugaaauuguagcuuauuuacauuuaggggcuuguuaaauaaaaccuuacuuuuauuucagauaaaucaagggagagaucucaguguggugugaaagcuguuaauaaagcuucuaguaccacaccuaaagggaauucaagcaauggaaauaguggcucuaacagguaggaacacugugccaugugucauaauucuaaauucuuuuuaaaaaugauuuuuauguauuuuuuugagacgggguuggucuugcaauguugcccaggcuggucucgaacuucuggccucaagcgauccaccugccuuggcuuuccacacugcuggaauuagaggcaugagccacugcaccuggcccucauaauucuaaauucuucuaugaguccucaugaguagaaggggagugguuguugaguaaugugaaaagucauuuauguugggcuuugaaauuuuguauguacccuauuuugcugauacgcuuuacauccuaauuauguuuuguauaguuaugcuuguauaacgacuuuguuucuccuucugggauauucaggggaauguaggugugaaguuaaacaaauauuuuaggauagagggauugcuguggguugaagcgauucuugugcuucagccucccuaguagcugggauuacaagcgugugccaccacucccggcuaauuuuuuguguguuuuuaguagagacaggguuuugccauguugaccaggcuggucucaaacuccuggccucacgugauuugccugcuuuggccucccaaagugcuggauuauaggugugagccaccgugcccggcuaauacaucuuuuaaaucugcaauuaaugaauuuguuuaugauuuacuggauaaagaaauacuuccuuuuuucgagaaggagucuugcucugucacccaggcuggagugcaguggugugauuuuggcucacugcaaccucugccucccagguucaagugauucucuugccucagccuccagaguagcugggauuacaggugcccgccaccaugcgcagcuaaguuuuuuguauuuuuaguagagacgggguuucaccauguugaccaggcuggucucgaacuccugaccucaagugauccacccuccucagccucccagagugcugggauuacaggcgugagccacugcacccgaccauuacuucuuccuuuuuccuugucuuaaaguuguccuuuaguuuucaaaggacucccccuuaguucuaguauuuuugaaguuaguaagaaacccuuuaugauauauuuuaucauauaucaaaggauauauuuuaugauuauuuguguuaaaaucccauguuuuuauucuuaagcaacaaagcuguuaaagaaaaugacaaagaaaaagggaaagagaaagaaaaagagaaaaaagaaaagacuccagcuacuacuccagaggccaggguacuugguaaagaugguaaagaaaaaccaaaggaagagcggccaaauaaagaugaaaaagcaagagagaccaaggaaagaacgccgaagucugacaaagagaaagaaaaauucaagaaggaagaaaaagcuaaagaugagaaauuuaagaccacuguccccaacgcagaaucaaaaucaacucaagaaagggaaagagagaaggagccauccagagaaagagauauagcaaaggaaaugaaaucaaaggaaaauguuaaaggaggagaaaaaacaccaguuucuggguccuugaaaucaccuguucccagaucagauauuccagagccugaaaggggcaaguuuaccuuucuuuauacguucuuacguuuuguuauuuuaauguauaguugguuauugucuccuuguuuugguaaguuauauagggguuuugcuaggggaacuugucauacaaguugguguuuuuuuuuaaguguuuggaaaacuagaaauguaccuuauucugacuauuucuuuuugucuuaacagaacaaaaacgccgcaaaauugauacucacccuucuccaucacauuccuccacaguaaagguuaguauagccugaggaaggcagcguccauguuaggcucaccuguuuggaauaccaguguccugacuuccuucaagucuuaugccaagcauucacuggagccacuggagguuuuauauugcauuagaaaaugaauuuuucuauauugguggacugauuuuuuuuccuauugaguauuuuuauuauaaaaauguuaaaacuucaaggacuuagcacuaauuuuguaguguuucaaagugcaagagaaauuuuacccagaagugccucaacugcuuuaagcagucuuuuuuggagugcaaugguagcuacaagcaaacgaaucuuuucagcagaaugaagccuauuuuucagcauauugaagaauauauagcacugaagacuuccuggaugacacaagauaaacaaguuaccucugaauucaagcuucuugaugagcaucauaccgaugugugccuucuaagaaggagucuugaaaggaguuccauuuuaaagucuccuuggugaucaguucuccuguaguuguguauauucagugagcaugcagcuucuguuguaucuucccuuggagguuuguuuauacccauuggguucccaacaaguugaaccuugcguuacgauaaaagcagauguggcauccaauccuaccacccagcaaagagaaaccccaggcauucaacugcagcacaaaaucguggguguagccuucuugaagacucaggguagccauuccuugcuccauauuuaauuuuaauucuaaagucaucuaauuucauggaaucuuugaauuugcaguacguugaacuuuuaaaaaacuguaaguuauuaauuguucaucaagagcacugugguggaauaucguaguugauuucuuuuucuuucuuuuuuuuuaaugcuuucuuugugugugggaggugugagauucaccaugauaggcacuuugcagaaaaaaaaagugauuacucuuauauauuuuguuuucuuguuaauacaaugccacugaauuuuucagcuaggauguguauauucauauuagaguuaaaaauaaaguaaaaugugaauccucccaauuaaagaagaacuaugaaaaauauaaggcaauguuguucuuccacagugaccuccaguauuuuaaauuuuuuguggagaaaaaaauguuuugcuuucuuaaaccucuuaacuauagcuuaaguagagagauaugaacaauguggcauugacauuuauuuuuaaauucugagcagagaaagauuuuuauuucuuacauugaguacauuuaauuuaguuuuuaacauuccaauuccauuacauguuuuuuuuuauuguugauauucauauugauaaugacaucaugaaauuuauccucacaagaaguagcugguuuauuuccagguuacagccauacuucccaaaguuccucuggguucugagaacuaugccagcucaccugucaucuccauucauuuucuacaggacagucucaucgaacucaaggaaucuucagcaaagguuugagucuuuuaaaaucaucaugccuaaguaaaccaaauguucuuuacuuauuuuauuuaguagauguccucacccuaguacauucaguaagcugagaucagugggauaaaguacucugcuuacauugaauaaccuucaaaaauauuaaauguuaaaacugaaacaacagaugacaguggucccuuuuaaugagauuguuauaaaauguguguaauguggcaacauuucuaucaucucuccuugcuugcuguguuauaccuucuccuuuuaugcuuuuucaaaaucuggaaauaaguuuaacauucggggaagagguuauuugauuguuuuggguuuauuuaauuuuucaaaacaaaucugccaggcugucugacuguuuagacaacccaaaauaccaaaaaauaaauuugaugcauucacauaucuguuuuaaaaauggaacucaucucaaucuauaaaaauucuuuauauauccucugcugagguaccuuuuugguaguuacagcacaauaucaggagauacuguuaaugugaaagaaucauuccccuggacaggaauacucggugguuguguuuacaugucaguauuaauucuuaccuauuauucuacuuucuugaguauucugcuacuaaaaguagugugcaguuuguguaucuuauuacagaguuuauuucaguauuauacuugaauuguccauuguucauguuguuuugucuuuguuauaaaacguguacccuucuuugauuuucuacuuugccuccucuuacaagcuacaagcaaaugaaucugcucagcagaaugaagccuauuuuucagcauaaauauugcuugccaugauuaaaauagaaaucagcuaagcaugauuucuuuacugguggaccaaaugaaauuuugaaacagagccaguugacauuacuaacugcuuuuagauguauagauuuauaaugaaaugucuguggauauugggcaaauaaggcacuaauuuuuaaguuuauauuagccaguguaccuguguccuaaaauuguagcauuguuuuuuagaauauacuauauuaaucaaaagucucagcuaugcugggagaaguuccauuuaguuuuauuuuuuuucugauuugaauggauguuuuauuugaaguagauaucgggguuauucuguaauacgcuauugaagaacaagccgaaauaacacauuagacacaacaucaaccuaaugacauuauuuuugaaaauucuaaacguccaacguauuuuuguuuuuuugcuguuagccauaacgucacaauacuaacagaguucuccauaccuaguaggaguuacaaaaauguugauaucagguuggaauuauauaccgcuauuuauuauuacaugggauuauuauuuaaaaugauguuccuauuuagguuaguuuuggaaaacuuaauuuauauuccauuucaauuuugauaucuauagaacuuucauuuaauguaaacuuuuuauuggcuaacuuaaauauauacugcaauauaguagguuuuuauaaccaguuucaaauuguuuaugucagucuuaaccaucaguggcuucuaugggcuauuuuaaauuaaugggcuaacaguguuaacuucugaauauuuguuuacugaaacauacuuugaagcaguuuguaaccugcuguuaaaauuaacuggauuuucuaaucgaugaugguuccucacauuugugaaaaggccuuuugaauauauguacuaucucauuucaugcucauaacagugcugugagguagacagggcagguggauagugucuuuuugacaaaugagagacuaaaaguucuuuagcuuucccaguuacauagaauuuguuaguaucaaaacaugaacuaaaauuaagguuucuugauuccuagcaccacccauuucaacaauaguugagaggguuuuucuagcuccuuuagugugcuugccuugguuuuuaaaaauuacagugauucaagucagucucccacaucccuccuuuuuaaaaaugguguuuugcaggccuuuaaaauuuaauuaauuuauuccacaugcaaccagaaaaauuugaaaauggcauauacauaugcuucuaaaaacugugugacuccuacuacuuuucagaucuuuagugcuuagcauggugccuggcaguaagguuagguauucaauaaauacuugaagugaucucuuaagccuuugcacuuugguaaagcaugcaaaguacugguuugcauaguagcugauguugcauuuuuaugugucuagaaaguuuaauagcauaugaaugucuuagaaaaaaaauuucacuggacuuugagugaucuccaaaguugauuaucuuuagccuguuucugagguagcuuuuacuuucuagaggguuuggaagauacgcaucuauuuucauauuaucuugucacuuguaccuauaaaauucucucccugcuuuaguuugacuuuuuaguuaugcguuuucugugggauucucuuuauuauuuauuugcuauuuuuacuuucuaauuugugguaaaagcaauacauggauuuuagcuuuucaaaugagauuaacuaaaagaagaaaaaucuagcuuaguauccaaaucuuuucugucaguucacccuuuaccccuaauuuccaaauaguguauuucuaguuuugaucaauuguguuuugauguagcaauucuagcagcuacuuuugaugaagauaguguuaaaaaaaaaaaaacaaaaaacagguuccauuaaucagccucucucuaauuuaggagggcaucaguaaccaccucaagacagaauuuagcuuucaauuuguucaccaucuuaaaaugaggauuuacagccaaacccaagccuaaaagugaggccaucuuuauauaauauagugaagcuuuaauaaagucaguggagcagaguuuucugaaacagauuuugaaaaucagucaaauucuuuuuuggaccuuaaugauccgaaugucaagaauaaaagccaaucaagaacaaaacccagcgaugcuacauacaaauccauuuaaugaauccuuaauuuuauuugucaaacuuguauugaguauucacuguguguacaaggaacuaggaaguauguaaaaguagaaaggcaccuuagcucuucuaccauacuggaaacuguuauggacaaaaauguaugacaugaaguuaauagggagcacuuguccuaaaaaaaagguaaauauaaaauaauguaaagugaguugcagaguugagggaugguugagugcuguugacuuuggccaucuuugaaggcuaaguaggauuuuaagaaguuaagauaaaaaugaacaaccauucuaguaaugagaacugcuggaaaggacagauguuagggagcagugauagccacagcauagaaugcauuggguuacuauagcaggauauaauugugaaaagaugguggagaguuuggaaugccuaaacuaagggguaugcauuuaauucauuaggcaaugagaaacucuguuuuuaugcaaaagaguauuugaucagaacuauucuaaagaaggaauugaauuggguacauucugaacuaagaauuucugauugucaguugagcuaugugacuuuuuaugucaagaaugaaguauuugaacauuaaugccagaaguaaguucuagaaaaauuucucaauuccucacaguacagaaaguaagcacaguucaaaacuucauuauuaauaaggguuguguguguguguguguguguguguauuuuuuuuuuugcuuuuauugggaaaaauuacuacuuagagaagucuucuuugaguauugcagcaauauuuccuuugucuuaaucauuuucauaaauaauguuaagauaugaauaaaccucacgauuagaaaaaucuugaugucauuuaaggcauucuagccagcaagaguaucuuuuagacaaguauuuuuaugacuaucguucucuugcucuuuauuaauaagcauuuugucuauuucaguuuaucaacuuuuaaacauugaaauuuuaaagaaucuacuucugcauugcuauggcaguauuucugagccaacugaauugaaaauguuuggugguguuaaaaaauaaguguuuaauucucaaacugaugguuuucauuuuucauguauuccuuugaauaccaaaggauuucuucauguaaaaauauuugacuuuugacucacuauucuauuuguuccuaagguguaucuagcauuguguaguuauguaaugaguuauauucaguauucugcugcauaauacuuuuaaugucuuaaauuaaacauaggcuuguagcacagauauaaaugccguaagguuagguaucugauuauuuccugacuacuuccuaaauauuuuauguuacagcauauuuccauauuuacaacucaccuaagaaggguuaucucucaauuauuuaguuagaauauccuugaugauuggcuguuuuauugcguauagcccuuuuggcagagaaagaauaggcagaggagaauauugguucauuauuuuuuagucuuuugaauuguuuagucauccucagcugacuagauggcuuucugagguauuuagaaccaggaagacaaauuucacaguuaauugugauuauuuugauagaaauuggagugcuuucagaaguagagaacaugcagccuuuacauuuguaaaaauaauuugagauaaucuuugcaugguucacacugaggcagaaaagaauuauuagcaaaaucauagcuagguuuuauuuuuauacuuuugcccauugccauuauugacugccuaucgguggaugguaagacuauuuaaaauuuccaugauuguguagagguguuuuuuucuuuuucuuuuuuuuuuuaaacaguagagaaacuccagucacuauuguucauauauggacucuuguaauggugguuauaggucuuuacaauagagcuauaaggaauacucuagcuugugaauuuacuaaugagucucaguugaggcacaaaugaacugauggaguuuaaauggugauuuuuauaaggccaagaauugaagccuuuguauaauuugugccaugcccuuuuauuuuaccucuuguaauccagauagcugaccaguuuuuacuuuggguauaauucccaauuguguuucauuuaguaaacaaacaagugaugccaauacuggaaaacuaauaaucuuuaguaauauugccuuaauuuaacagcucuacauuaaucauacuccuccaccacuguccaagaguaaggagagagaaauggacaagaaagauuuggacaagucaagggaaagauccagagaaagagagaaaaaagaugaaaaggacaggaaagagcggaaaaggguuuguaaaauuuuuuuuaaacuaguuuggaaagcucauuaucauguacaccaguguguauguugccuuuuaaaaaauacuaguuuguuccauaguagucuguuauuucaugauuuuauugauauuuuuacccugaaguguuugcauuuucuacguuaauaaggaucuucagccuaguaaucucugucagcucugcuugucuuucaugccauuuuaccaaguaugugaaacuacugcaaauacucuccauugcuaguuagcugugcccuucucauauaaaaguaauacuuuaaaacaaaaacagaagcccuuggucaauguaguucacaauucuugguucuaggaucacucaaacaacgaccgugaagugccaccggacuuaaccaagagacguaaagaggagaauggaacaaguagguagacuuauucauaucuuugaagauaucaucgaagugaauuggaaaaggcuuucaugauuuucuuuuguaauuuuaguggggguuucaaaacauaaaagugaaaguccuugugaaucuccuuauccaaaugagaaagacaaggaaaaaaauaagucaaaaucuucaggcaaagaaaaaggcagugauucauuuaaaucugagaagauggauaaaaucuccuccgguggcaaaaagguaaauuaggaaaauaaaggaauaauaugcuuuaucuuaaaaaaaucaauccugaaaauuuagcaaauauugaauuuuuuuccuaguccuauagucuuuuguucauuauuuaggagugggaagaagagguauugagggagggcauuccguuuggggaauuugagucaguucagucccagauuaccaggaggguagaguuaguauaccucugagauuccuuuccccucuccauuccauucccaccuacuucuguugauugaguuucagcuguucuuugcauuuucuuuuuucuccaccaacucuuugcuuuuaguuucucuuuauuccugagauuaaaauauggucacauguauucucucugaccaucauagcaucauaaagucuugauugugauuugaaacauuuuuguaacguuuucuccuaauaaacucauuuguuugauacuuguauuugauuuaaaaauugaguauaagauacauucucuuacauauuaaugguugauauuuaaagugaaucucacgcaucugccauaaaguaauaagcaagccauuacuaaaguauaaauuguuuccaaaacauuguuauauauauugaaaauauaugccauuuauucauaguucauaaaaacagcucuagaaaauuauauaaugaacauuuuaauucuaugcuuuaaaagauaggcuguucuuuuagguguuuuuuaauugagguaaaauucaaauaacauaaaauuaaucauuuuacagguguacauuuaagugacauuuaguauauucacaguauuguguaaucaucucuaucuaguuccaaaacauuuuuaucaccuccaagagaaaacucuauacccauuuaaacagucacucccauuuccccuucucagccccugggaaccauaaaucuguuuucuuuauggauucacucauucugaauauuuuauauaaaugaaauaguacaauaaugugcccuuuugugucugaugucuuucacuuagcauaauguuuuugaaguucuuccauguuguagcaugugucauuuacuucauuucuuuuuauagcuaaguaauauuucauuauaugaauauaccacauuuguuuauccauuuuucaguugauggacuuuugaauuguuuccacguuuuggcuauugugaauagugcugcugugaacauuuguguggggcuauaaguauuuguucaaacaccuauuuuuaauuaucuuggauauaugcccaagaauggaauuucuggguuauaugguaauucuauguuuaacuuuuugaggaaccaccaaaaucuuuuagacaguggcuguacaguuuacauuucuaccaacaaaguaucagagugcagauuucucuacaucuuugucaacacugguuauuuucuguuuuuguuuuuuauuauagccauuccaguaagugugaaguggugucucauugugguuuugauuugcauuuucuuaauaacuaaugaugcugaacaucuuuucaugugcuuauuggccauuuguuuaucuuucaagaaaucuguucagauaccuugaccauuuuuuauuuugaggguuuguguuuuuguugcucaguuguaagaguucuuuauguacuuuggauacuagauccuuaugagauaggugauuugcaaauuuuuucuccaguucuauagguugucuuuucacuuucuugauaguguucuuugaugcaugaauguuuuuacuuuugaugaaguucaauguaucuauuuuuuuccuuuuguugcuuaugcuuuuggugucauguuaaguaaguuuuugaagacaaauauagcucgcgggugaugaaaagggguuuugagcuggcuuuuauauuuggcuuucccuuccccagcuaauucuacuauuucuuauaggaguccaggcaugauaaagaaaagauagaaaagaaagagaaacgggacaguucaggaggaaaggaagagaagaaacaauauccuuuucauuuugauguuuucaguuaguguaguagaaagcuuugauacuggucauguuuacaauuguacucuuuuaguaugugguuuauaugcuuaagggcugauuaguuuugaaauggucuuuccaguuaacucucaaaaugugugaaaucuggaagugggauacuugauguucuugauauuuaaaaauacuucuguggugacugagauguuuuaugccacuaagggauuuauagucuuucagguuauauuaucacagagaggaagaaagggaacagagagucccuagggcuggggacauugggaauagaagggcaaaaugaugagucagacaagcagagcugguagaguuugaggcuaccaggcuggucagagcccauuuaggccugcaaccugaggugcuguacuaaaaggggagaugcuguucuuuccgccauucccaaaaguuguuuucccuuaauuugucaucuacucauaaguccucggacaagcacagauaaugaagacuuuccaucaaggugaguguucucucaccaccuuuucacuuaaugauagaaacauaaaaugaguucugauaauguugaaaaacuagaugcauuuuacaagcuacaacuacuuguuuuuuucaccuaaauauaacgaccaagucuucggguauagaugcaaaacaagauucagaguuauuuuuaagcuguuuucauuuuaagcuugcugauuagccacacauuuuuuuuuuaagcaccaagauauauuuaagaacaucuggcuuucucuucaccacuuauucccaucuucucuggauaauuaauuauguuuuuaaaguccuuauugccuuguaaauggugguagugguaucugcauuuuauaagugaagaaacagacucugagagguuaaguugaagagggucauaaagauauuagucaacagagccaguugacuauccucagucuuucuauccuuuaguguucucuguuccuuuugcuuucucaugcugaugucuuauccaaagauuuuuaaguuuucgugccauuuuuuuuuuuuuuaccacugcccauguuuugcaacagaaaauauggucuguguuuuuaguucuggaauuuacaauguguaacuuuuuuuuucuuuuuuuuucuuuuuuuagguaaugcacuuaaugcuuuaugugagauuuaaaaaguauuuuacccaucuuaaauaaauuguguuuccaucauaguggauacaguguucagacccuaacaucgccuuuuuugagcacuuaagauaaucugaauaguuacuguuuggugaugccuuaguauuauugaaguacguaggacaauuugcccccuaaauguaaugguuccagacagcuguguuuugaggcuguugauucugccuuuauuuuuuuauuuuuauuuuuuuuugagacagagucucacucugucgcccaggcuggagugcaguggcgcgaucucagcucacugcaaccucugccgcccagguccaagcgauucuccugccucagccuccugaguagcugggauuagaggcgccugccaccgcgcccggcuaauuuuuguauuuuuaguagagaugggguuucaccauguuggcuaggcuggucuugaacucuugaccucgugauccaccugccucagccucccgaagugcugggauuacaugugugagccacugugccuggccgacucugcuuuuuuauagcccguuuucuugcuuccauguuagccaucauuucuuaauauauuaaguauacuugcuuuucuauacuucguuaauauauuaauuaauuaaguauccuugcuugucuauaccuccccccuaauauuauuggaugcuucuaaucuuuuaugagaccagauagauaaccaaggcuguuuaccaguguuuaaauuacaagugagaaaugucugagagccaguucuguauaaggguaugggcuuaaagguauggauuuugucaucuuuauuuuggcugcaaagcagggauucgagagguugccuuauagucaacacaugaugaauggugugcuuuuccugcuuuuuuggugcuugcuauguaaguagauuaggguaaaguaggguaaaugagaguuauaaaagaacauuucgaauuuaauagauuuaaaaggaaauauuacugcuaauucuucaauucuagcugcuccuacccccaucccaaccuuacaacuaucuucucuggugagccauaaacucuuaauccucauuuuaaccuuucuuuuaaucuggcauuuugcugucacauguggucucccuauuaaaagaaaaacaaaaagcccaccuuucauaucuucaugaggaaugagccagccauugucacugacaacuuucacagugauuuuauauaucucuguuuacucaguacccaaauauuauucuuuuguaugugaagguuaugcuacagauuugaguuuuucuugcacugaccaugaauuuguauuuuaccccucuguguaaucucuuaggaacaaagggaugacaaaacuggucaggguuagauauuuggcucguggucuuauagcaaaacuucuagauucagauguucuuuuaaaaguaugucuagcuggauguccauccuguugaauuccucauugacaacuuuguacgauacuuucuucuuggguagacucuuaauuuugugagacucugguugauaguuucuuuucuuuugagacaaagaagucucgcuguuuugcccaggcuggaguguaauggugcgaucuuggaucacugcaaccucugccuuccaggugauucuccuggugauucuucaagagauucuccugccucauccuccugaguagcugggauuacaggcacgcaccaccauaccuggcuaauuuuuguauuuuuaguagagacaagguuucaccauguuggccaggcuggucuugaacuccugaccucaggugauccaccugccuuggccucccaaagugcugggauuacaggucugagccacugugcugggccaucuggcugauaguuucuuuuuuuuuuuguuuguuuguuuugagauggagucucacucugucgcccaggcuggagugcaauggugcaaucuugguucacugcaaucucuaccucucggguucaagcgauucuccugccucacccucccuaguaguugggacuacaagcacgugccaccacgccuggcuaauuuuuguauuuuuaguagagacgggguuucacaauguuggccaggcuggucuugaacuccugaccucaggugauccaccugccucggccucccaaagugcuggcauuacagacgugagccacuguaccuggccgauaguuuauuuuaaaacaaaaaaaaauuuuaaauggaaacgggguuucgccauguugcccaggcuggucugaaacuccuggacucaagccaucugcuugacuuggucucccaaugugcugggauuguaggcaugagcugccaugccuggcugauaguuucuuuuucuggcuguugacugcuacuuucuauuuggauacauuccaggguuggucaggucuguuuuucuuccuuuucuuuaagaauguuaucauaucugauuggaaccgucuauuuacaggcuacuuugaaaucugcugcccucccccacucaccuuuuauuuucuauucuauagaaaggacagcucuuacauaugucauauuuccaugauugaaagaugucguuacuuguaagauuucauuauuguuuuuagaacaguuuuuuuaaggaggguugguagagaaaugacagugauuuguaaguaucauccugauuuucacaaacauuaaaauaaucacauuagaauuaagauacaaggccaggcaugguggcucaugccuguaauccuaacacuguaggaggcugaggcaagaggauugcuugaggccaggaauuugagaucagccugggcaacauagugagaccccauuucuaauaaauaaauaaauaaauaaauaaauaaauaaauaaauaaaacuuagcuaggcaugguaguaugcaccuguaguaccagcuccuugagagucugaggcaggaggauuuccugagcacaggaguucgaggcugcaguaagucaugauuaugccacugcacuccagcaugggugacagagcaagacucugucucuuaagaauuaagaagauaacaguauauaaauaugaccauaauuaaauuccuuccagucuucugucaucuuuucucgucuucuguuuuugguugcaaaacucuguuccuucucugcaucuucuguugcccuuaaagucuuuguacaaauucaucuugccucuccuugauuuagucucuugaagauuacuaguuccuuugccuuuaaccuuccuuccuacuuuaacuuuuuuuuuuuuaauuccugcuuauaaaauuguccucugagaaccaccacccuuuggcuucucaauuuuaacuugauauaugugauccucaacucagggauguugaguucagcaaacuuuugaaaguccuuuugugaaccaaaugcugugcuaagcugacauuugcucccaggccuugagauacucagucuccuugcuuuuuauuauuuuggauguaggacuuugauuuuaaagaacauuagcaguuagcacuacuuauucauaaucuguauuuuuaaucuacuacauuccuauucuaauccuccauuccaagaaggccaaauauauuugcagguccauuccuuccagucucacauguguaaccuaauuuuuauccucuaaauccuacguugcaaauuaucagcccuugggcagaaugugggauguuaaauguacuuuauuuuauuuuucauuucauuucauuucauuucauuuuugagacagagucucucucugucacccaugcuggagugcaguggugcgaucuuggcucacugcaaccucuacccccuggguucaagcgauucucaugccucagucucccgaguagcugggauuacaggcaugugccaccaugccuggcuaauuuuuuuguauuuucaguauagacgggguuucaccacguuggccaggcuggucucaaacuccugaccucaagugaaccgcccuccuuggccucccaaaaugcugggauuacaggugugagccaccacgcccggccugucuuucuuucuuucuuucuuuuuuuuuuuuuuuguagagacgaggucucacuauauugcccaggcugguauugaacucaugggcucaaguaauccuccugccucugccucucaaagugguacgauuacacaugugagccaccaccgccagcaaaaugcaccuucuuaaccucacacaauauuucaaaauuuuaaaaaucuguuuguuuuuaaaaaucagaauugacaaaauccaaauuucaguuuuucuugaaggauuggaacaucugguaacauuguguucugauuucugcauagcaucauuauguccugauuucagcuagacuugucuaggugcugccccccuuuagaauagagcaagggccuuuuuaaaaacaguucaccuccgucaguccccacucagcucguuucuuuuguuuucaucacguucuuggccuuuguagacaauugauuuuguaauuccagcucuaagccuuuuuuuguuuguuuguuuucccuucaguucauacuuggaaacugaccuccuaagcuccugaagauuucuuguuuuaggaaugcauugccauucugaggcuuauuccuagauguugacgauagguauugguaaaggguaugggauagggaacucaucaauguucacauugaugccagagaaacauuuaauaucucuguauaagugcaacauugacuuuuuuugccaccaaacacaccauuuuauaggaagggaaccuauacugauuaaaagagcuugcuuauuugcugcagcauauuuuuugagggcagauuuaauaugcucucauuuuggucuguauguaguaaccauuaaauguauacuagacucuuguaaggagcuugaaaugacagacacaaaucauuucugucuucauuaucaacuuuuauacuuaaaaaaaauacugaguauagguuuugugcacugauauucauaggcaugaaaaguugaagagggcaggagaaauuuucuauuuccuugcucuuccacuuacgguagagcaaauauucauuuauaugcuguuuuuuaaaauuuugacaugggcaugagcacuuauaaaaggcuuccauacaacauuugcccugagugugucuuuccccuacacacauaauuauccugaaaagcaucccugggugcaguuaaguuucagcucaacagaauccacgucuuaacucuguuacauuuuauccacguggaacaucucaggaacucuguuugcuauaaagaauuccuagguugcaguauaaggguaaaugaaggaguaaaguggauuuaggauggcuguccccaugucuuucucauaacuucuuucuuccuuauaaauauuuguuugacuuuuuaaaugucaaguucaucuuuauaugccuuucuaccugggguuuaugugaaaagaacgagagaaugagaauaaaauccugacaguuucagacacuaguaaaaaugcauggaaugcaguucugggaugcuuccugugaagugaagacacuuaaccaaaaauaauauauuauuuuggugggcuugauuuuauaguuucucuuaaaaauuguuugguugccauccagagggcucuuuuaugaagaaucuauauaaacuacuaaaacauuucuuaggaccuuuuuggugaauuugaucauaaaauuaaaaagcguguauguguuuuauaaaggcauaccucuguuaagaaggcugguuuuauguuugccuuuucuucucuacuuugaucaccacccuagcuguuccuuucuccagaccaccuuacuuuucaaacuugauucuugcuaucacagcucucuguaacaucaguuaaaaucagcugccucaacucuuugaggauguuugugcauaggacggcauugugaaacauagggaaauggcagucuuacuaacaaaacaggaccuaucucuggccaaaaagaaaaaaaaaaaacaaacaacucaggagguccagauaauuaccaauauaaaauggcguucacacauauaaucuugucucagcagaguaggaaggccaucuucuguugagauguguccuacaaaugugguaugugauauuaccaauacagcuuauagcaccaauaggugucugugauggagaacagcagacuaugaacugagccuggaguagaaaauuuuugagaagcagcaacaguccuagaugugaaaaagauagaucugugugaucccuuacauucagaacuuacacuuucuuauuuacaaugguuaaagcaguacauauuaaaaaauaguuaauaaaacacuuaggagaauguugcagguaaugugguauaaauguuaauaagaagaaaaauacugcuuugcugaaaauagaguccugaaggcugaguuuggcacugcuucaucacuaugcaacuuucuucuugaugacagcuagcucuuucugaaguucaguaaacuugggggcaguuuucaaguuuguaauccuaacaccucagcauuauuuuauuaaaauacucuguggacacugccaagagacugacauccaguaucuucuuuccacuugcucuugugguugcugauuugucauuccaggcuauggacagacccccuaagccgaaagucucccagaggaggaugccaaagcuccgugcgucacucucagaaugauaucucccauaauuaagagcuucuggugcuguccauuuaaugggaaucugcuuuaagucagaagaugaguacacaccaccauccucuugacgagacauuccaaagucacugauuuucagaacauuauuuucaccuccaggcaguuucuuacagcaaggucccuguguauacauuuuuuacucgagauacaccauccagaaucagcaucuaaugaaaauuucacugaguuuuaguucauucuucuuucucugaaaggagaggaaaucgccuccaggaaccaguuccuuaaugacguagauaggccgucuuugugugugaacuccuauacuuuugacauuacugggaugauuauauugcuugaggauuuuggcuucuaguaaaaauuuuaauuucaguuccuggggaagacguucuugacguguuuuaacagcaacagcaauuuuauccuuuaaugugaccuuaaaugugucaccaaaauuucccuugccucuuguaacguggcaccuuuaugauugagaacccauuucuuauucuccuaauggccauacugugauaccaugaugcucuuaauuggaacauugacuuuuuuuuuuuuugcaauuuaaacaauugagauaaaauucauauaacaucaaauuuaccuuucacuuuuuuuuuuuucuuuuggagaccaagucucgcuguugucucccaggcuggagugcaguggcgcgaucucggcucacugugaccuccgccuccuggguucaagcaauucuccuuccucagccuccugaguagcugggacuacaggcgugcaccaccacgccuggcuaauuuuuguauuuuuaguagagauagggguuucaccguguuagccaggauggucucgaucuccugaccuggugauccaccugccucggccucccaaaguguugggauuauaagcgugagccaugacgccuggccucaaacuugccauuuuuaaaguguacaauucaaugguuuuuaguauauccacuauguugugcaagcaucaccgcugucuaauuccagagcauuucugucaccccaaaaagaaacuccaugccuauuagcagucacucccaguucuucccuuccucggccccuggaaaccaguaauguacuuucugucucugugauuuugccuguuuuggacauuucauuuaaauggaauuaugcaauaauuuguggccuuuuguguuuggcuuucacuuagcaucauguucucaaggcucauccauguuguggcauguaucaguacugcauuccuuuuuauggcuaaaugauguuucauuguaugaguguguaccacauuuuauuuauccauucagcaauuaauggacaggaacaauggcuuuuaaguauuaaauuguaaguucaacauuaaauguauccacaguuauugauaauaucaagauuauacauggugugaacagaaugcugugucgaaaugguauguaaauuauuugucagcauuucauguaagugauuauuuucuaaggacccuucuagcccugguuuuaagaaauaugugaauguaguauuuucaucaauaaaguuuaaugcauuaagcauuagcuuaaaauuugaaugaaggcagaugugaagauauuugccacauguuguaauaaucauguuuugaaauuauuucaauaugaaguauuugaaaaaugucaauacauaaaggaaaggaaaugaguauaauuaagucaauauauuuuuaaagcaauuuuuauaauuuagcagacacugcaucuuaauauaaguuacuauuaaaauuguguccuugugaaaaaugugaugucauuuuccuuuuuuuguugaucauguaaaauagguuacuuuucuuugcuacauuuucuauuuaauaagcuauugcuugccguuguggaauguuuuacuuguugcuccauuuuuuucucccuacccccaccccucucucccacacgcacacaauguucaauuuuuuuuuuaagucaucauuaguguguuuaucuuuaauggauucuaagaauggacaaaaagaaacacacaaauauuucauccuuuucuggggacucaagucuuuguuaccgauggaacucauuaacuucuuguucuuucuuaaaucuuccucccuccuuaccuuuuccucuccuuccuucucuucuucuuccuuucuucuccccucccucccucccucccuucuucccucccuccuccuuucauucuccuucucuccuucucccuuccuuuucuccuaccuccuuugacuaagccucccuccccuacucccuccuuuccuuccuuccuuccuucuucucuaucaauauaaucacuuuguuucuuucaggugagaucggacuggaacuguucggcugcgaccagaaauuuauuuuccugaguaaauugccgagaauuaagaaugaagagggccauuugcaucuccuuaaauuauucaguuaccugcuuuauugcuccauguggaaaacuuaaaauuguuaaguugugcauuacuguauuuuaacuuguugcuuaguuucuacauguuuauuuucaguaauggcugaaaguguuaacuguuccauacuuuuagcacaaugugcugcauaagguuaccuguguacagaguuuuacuuuagauuaacuaaauauugccuggguucaguuuuuauuuccauucugaaaugcuuccuuuuuauuguuugaaacugaaaauaaacaauuguugaacccuuuugauuuuaccucauuuuaaaacuguuuuaauuuauuauuuggcuuguucuuaauauuagucacuaaaagcagugggagcauugucuuaugaaaugcuuaggaaucauuuuauauaguacauguacaacauuaaacguguuuaaaaaagaaaaagguaccagcgaucacuugucccuugccauuuuuucuuguaauuauguuagacaaaucuuggcggcggggggaucaaaacauaauuguuuuaauucuacagcuguaggagcuuuguauugcugaacuuucaucuggaaaaguuucacagugacauuuuuaaaagagaauuuuuuuaucugccgaauucuaccaguguaaccuuuuuucuaaauaaacaauaguuuucucaaaugguugua

SEQ ID NO: 192821 - RNA, 11375 nt, Homo sapiens
gcgcaugcgcugcgcugccuuucccgggcgcugauuccugagugcugagcgcgaacccgaggagaugaaguaaggcgucagcuuccuuuugaggaaggagcagcgggccacugggggugguccaccgggacuggugugguagagcgucugcggggccgaggggcgggagcggcgcggggacuggaacagcucguccccuaguuuugcucuuccucagcuccggccgguucgcacuuacuugucugcuuuucugccuacccuccccaccccccccgccaccgugaagcccuuuaacuaaggugaagcugaucaacgagcugaaugaacgagagguccagcuugggguggccgauaagguguccuggcacuccgaguacaaggacagcgccuggaucuuccugggugagguccacaucuuucuuccucagugcucuccagauucuccugcucgguuuccgacuauuucggcauuuucacccuucacuccugcuuacauucaucgcccaccuucauauccaucugcugucugcccgggaauccguguuacaucucuuuucugccccauuuuuaguuuuccuucccugccaaaucagugcucaugagaguuacuguuugccauuugcugugcuaagguucagggacuguuguuauuucucucucacccucugacccauuauacugcugaggaaauuggggugcagagaaguuaagggacuuccuuaaggucacauagcuaguaagcgcaacaggcagaacuauagcauucuagaacucuuggucuuagccacagcuccauauugcuaccaccacccucccccauuccccuucccuuccagaauucacuuugcuccucuagcuccugcuuucuaguccauggccacguuaccauuacuguauucacuuuauaucacaaucaguaauuguacaaguuugaugcuucaaagagguuauuguaccaaacauugugcuaagcacuuuauauacaucguuuuauuuaacucuuauaauaaucuugcgaguuacgugcuaauauccccaucuuacaaaugaggaaauaaauauuuggaggggaaauuauucccuaggaaaugcuuaacagugucuuuauaaccuuugucuauguguaggugggguuaaucaugacauauguagacugauuuuguaucauagcuguaaauuuguggguaaugagcagaugaauucaacauguuuguggaagcagagguuugugauggaaacuaucugcuuuguccauaggauuuuggguggcaggaggacugagugaucagauuaguuucguuaguggugaccccgacuuccacucaaaauuaauuacuccuuuuucuguacuacuggcaccuuacauguacuucugucauugagucagacuuaauuucuuucuuucuuucuuuuuuuugagcuggaguuucacucuugucgcccaggcuggagugcaauggcacgaucucggcgcacuacaaccucugccuccuggguucaagcgagucuccugcuucagccuccugaguagcugggauuacaggugcccgccaccucaccuggcugauuuuuuuuuguauuuuuaguagagccgggguuucgccauguuggacaggcuggucucgaacaccugaccucaggugauccacccuccucagccucccaaaguguugggauuacaggcgugagccacggugcccagcccagacuugauuucuuuaagggcagggccuguugcuuacuguuuccaccccuagugccuggccuagugcgugguauguaguaaacacuugguaaauguugguggaacugaaaugugguuuucucuucuaggagggcuuccuuaugaacugacugaaggggacaucaucuguguguucucacaguaaguguccuuucauuuccugccuccugagucgacagaguacuuuguuucuguaauacauuuuguggcaucacaaaaaccacuuauuuucacucuaggcugaauggcaucccugcauggggagggcuggagcuucuguucuagaucagucccaggacaugguucuagaauguucugugggagauccaagagguuuguuaauuugggagggcaucuuggggauccuagucuauuucuguuguuuuucacugaggcuuguucagccugggccuagacuggaacagacuggacuccuugggcucuugcaaacuagggguaacccauggucacagggcccuucuggcccuuaccuguguggcgucauacgauuggggcaaagcacagaggaaauugggguaaaaaacagaaggucguaguuugcuuucuuuguuucucgaugaguguaagguuagugagcaaaggcaaucucugccuggaggcugagaaucacagcccgaagggaacaagaaugaauaggagaccuguauauucuucauucugcugagguguuagcagcagcauuucaugggagaggguguuggcagcucauacugguaguagcagcugguaggagaggggcugggcagcuggccugcaaccccagagcuaaacagcacaguuaguccacagggcuagaggaccuuggcacaggugcagaggaccacuacguuuggguuuuguaguccuuggaagcauaguacuguuucagagaaguuggacagcauguacagguagcggaccauggcaaaaggggcuggccaagcgaacaccgguagcauacacuggcagagggauugcuaugggaccauccauggacagagggcccuggccgagugguugagccacuuauggggcagcaagacaugggaaaggaauugggcaauacccgugagaagaaggcugugauagagaaccugggcaacccacacagguggagggcccuggcagggacaaagauugcuuccuccaacuucuggauguugggaaguucacagcaggugcagccuauaauuucuaccccuuugugguacuucuacucagccuuccaucuuggagcuguucuacuugcauuaaguaaugaugagcuaacgugugcauguuuguuuauucuaauuaucuauucucuauucugguuacgcacguugcucuccaugaagauugccuuugccgcugauaacagugccuuucaaaaaacuacuuuguuggcugggugcgguggcucacgcuuguaaucccagcacuuugggaggcugaggugggcagaucaccugaggucaggaguuugagaccagcauggccaacauggggaaacccugucucuacuaaaaauacaaaaauuagccaggcaugguggugcgcgccuguaaucccagcuacucgggagguugaggcaggagaauugcuugaauccgggagguggagguugcagugagccaggauugcgccauugcacuccagccugggggauagagcaagacucccccaucucaaaaaaaaagaaaaaagaaaaaaaaacuacuuuguuuucugauuuuggaagguaauacauagucauuauagaacauuuggcaaaauaaaguauaaagaagaaaauagaacauacucuuaaggaaaaccuuaauguuuuggcauaucucuuuaucauuuuuaaaaaaauguuggacauuauuuccaaugguuugcuauuaugaauuauacugcaauguacauuauaguauauaaauuuuuguaugcaucccucauggucucuuuagugaaagaggaauauggaucaauauguuagcauuuuaaagauguuuuauaaacauugccaaauugcucuccaaaagguuguaccaauuuccacacucauuagaaugcccauuuuucugaauccugauuaacagugacuauuuuaaaaaauauuugccaaagggcuucucauuauuacuuugcuuugccuuuuuuuuuuuuuuuuuuuuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuuguauuuuuaguagagacgggguuucaccguuuuagccgggauggucucgaucucuugaccucgugauccgcccgccucggccucccaaagugcugggauuacaggugugagccaccgcgcccggccugcuuugccuuuauuucaucaucagugagguugaacaucuguuuauagauuugcagcccauuauuuuucuuuguaaauugucuauucauauccuuugccaacuuucuucuacaaguauuuuccuuauuuucuuguugauuuuacaugagcccuucauguaugaaggauauuaacucuuugcaguacuuuguuguguauuguauuacagguugaauaucccuuauccaaaaugcuuggggccaggcacgguggcucacgccuguaauccuagcacauugggaggccgaggcagguggauugccugagcucaggaguuugagaccagccugggccauauggugaaaccccaucucuacuaaaauacaaaaaguagccaggugugguggugggugccuguagucccagcuacucuggaggccaaggcaggagaaucacuugaaucgggaagguggagguugcagugagcugagauaguaccauugcacuccagccugggcaacagagugagacucugucuccaaaaaaaaaaaaaaaagaacaaaaugcuugggaccagaggaccagaaguguuuccaauuuguauaaauguaaugaucuaucuuggggcugggacccagaucuaaacauaaaauucauuuauguuucauauacaccuuauacacauagacugaggguaauuuuauacccucaauauuuucaguaauuuugugugugaaacaaaguuuguguacauugaaccauuagaaauuaaaggugucagauauggaauuuuccacuugugauaccauguuggugcucaaaauguuucagacuuuggagcauuuugaauuuuggauuuucagauuagggaugcucagccuguacuauggacuuauuuuuucuuaauuugauauguuauacuuaucauuauucuuucuugaugcucaaauuuucccuauuugagggucaacaugaguuccuucaagccagugccuguauucuuuuuuuuuuuuuaauucuuguuuugaaauaauuucaggcuuaauacaggaacauuaucaaauggcauaaagaauaccuguaucuccuucacccagaucccccagcuguuagcauuuuaauuuaguugauuguucugagaaagggccuugcucugacacccacgcuggagugcaguguuaagaccguagcucacuguagccuugagcucuugggcuacugucauauguaaucuacagaaagguaguguuacuuccuuuuuucauuucuuguaucuguuuuaucuaauugcauuggccuauaccuccaauuuaguauuaaauaguuccuaaacuuaguugaauuggcucuaguauuucucauuaaguaggaugcuggauuuugggcugaaguguauguaugugauuauguaacauaucuaucaauuccuauuuucuuuuuaugacuuuauuuuuaaauuuauaaaccucuaacuuaccuggaauuuaucuuuuuguaaggcguaagguaguuuguuuuucuaauguuuuuucuuuuuuuuuuuuugaaacagggucucucuugcucagguuuggagugcaguggcaugauccuagcucacugcagccucgaacuccugggcucaagugauccgccccacgcacccuccugaauggcugggacuacaggugcacacuaugccuggcuaauuaaaaaaaauuuuuuuuguagagacaggggucuggccguauuguccaggcuggucucaaacuccuggcaucaagugauccuauggccucggcuucccaaagugcugguauuaugcacgugagccaccgugccugaucuuuuuuuucuauuuccuuuuuguuuuccuauuucuaucuuccuuuuuguuuguuugcuuuuuuuagagacagggucuuguucuguugcccaggcuggucucgaacuacuggccucaauccuccugccucccaaagugcugguauuacaggugugagccaccaugccuggccuuuuuuuuucuauuuaauucugccuucuuguuuguuuguuuguuuguuuuagagacaggaucuuguucuguugcccaggcuggucuugaacugcuggccucaaacagcccucccaccuuggccucccaaaaugcugggauuacaggcaugagccaccaugccgagccuaauuucugcuuuuaucucuauuaacugccaucugcuuucauuagguuugcuuucuuccuuuauguucauccuuucucuucacaauaaaauucuuuuaaaauuacaaauuuuccugaguaugacguuagccacauuucauaaguuuugguguauauucucauuuuugcuauuuucuaaauagucugccauuuauuuuuuuuuaauuuugcuucgucuucucuuucaugcuguuguuaggagaguagcuuucaaguucuaguuagguaacuuuuuuuuauuuaaaauaucauuuccagcuuuauaacauuauaacuggaaacauggucuguucuguuuuuuguaguauaauuauugagguuuacauugagaccuaauccauagucaauuuuaauacaugcuucauggauucuugaaaaugucaucuuguaggauucaaagauaucuauguaucuaauaguccuacauuaauauuuguuauuauaacagaguaauuauguauauuaauuaaucugauuuuaguuuauuucuguccacuuugugcgugauaaacuucaaagugauguguuaaauucucccauaacuuucucuauuaguuucuuuuugcauuucaaauagcuuuuuuaauuaaaauuuuugauuucuuaauuggcucauaacguuuuccuggcuuauaccuuuguuguguauuuaggccuuuuucaguguaaaauaaucuucuuagucucaugugauauuuuuauuuuggccuugaauuagucuuugcucuggauauugccacccauuuuuuaauuggggguuccuguucuugucugacuuuuucuuugcaaccuuucuaugucaucuuguucuagaugcaucucuuguauacacuauauuauuugaauuuuguuuuauuaccuuaucugcauguuuuugccuuuuaagucaacagugucuuacucuuuuauaaaauaaauagauauggggagauuguuaacauuaaucucgugcgggacaagaaaacugggaaauccaaaggauucuguuuccucugcuaugaagaccagaggagcacaauucuggccgucgacaauuuuaaugggaucaaggugagugugcuuauuaagcagguugguuggacuuuuuucccauguauagggguuucguuuucuaccugguucccgcagacacaagggcagcacuugugagcuugguguguugcgggggcugcagagauguggagacacuggucaagaagagauuccaggaaauaauucuguuggcucaugguccugcaggacuugcuucuuuuccccaucuguuaacaaaccaucuccccaggagcauaggcaccaggccugccucucauccaggccucuguuuuucaccuuucuuuuauugucuacugucaucucugguguacuggaggaugaagagacuagcaaacauugcucuuccauauuguuguguguuggggguuuugggcuucaucauggccucauaaucuaguacauagccauguaugucugucauauaucuccagugaccuagcauauugggcccuagaaauucucuaguuaaaaucugauggcagauucuacaaaaguaauuucauccugaaauuuucuccccccaguucccucucauuuccacugucauaagugaggcacugaguucuuagaaggagauagcgcaagucaggcuuauugaugcuccaugugguugcugcacucauuuaggaaaagagcugcaguugaacagugucacagaguugguggggggaggcuugaguuggagaguuugucacugauucacgaguauggaauagcuggagauuauagaacagaguggaacaagguucuaggcuugauguuuaaggaagccagcagucagagggcaucacuguaaaaggaagguuuuccaaaguguuucaaaauggagaagaggauacaugacagaagccacuuaggccuuaagguaaaaauaaaaaucugcucuuguauuggaacaauaaaagccaaacuuuaaauuuuggaugacuuugccuagggaguaagucuguaucugccuaaaaauagaauauuuuuauuuuaagugagguguuaauuuuuuggggggugggggagggggacagggucucacucuguugcccugguuggagugcaguggcguggucuuggaucaccacaaccucuguugccuggguucaagugauucuccugucucagccuccugaguagcuggaauuacaggugugcaccaccaugcccggcaaauuuuuguauuuuuaguagagaugggguuucaccauauuggccaggcuggucucguacuucugaccucaagugauccacccgcuuuggccuccuaaagugcugggauuacaggugugagccacugcgcccggccagagggguuaauauuuuguuguuguucaucuggagagaugugauucguugugcaagaaucagcgugagcugauuguuccaguaugguggggcuagagcaaggugugagggcuuaagaaaaaagcaagugcccuuuucuugauuccuuucucccuccaaacuauuggucugacuuugccuccuaauuacuggguggagaaagcaguuguagcauuaagcuagauuucaagaauuccuucuaguugccagaccuuccuaggguauguuucacuguaaacuuagguuacagaucaagggugauucauugugcaucuaaaucucagucuucccugaugcuugugcuuugagguaguuuuccuagucuuuuucauuuuauggcacauacagaacaugaagauauuuguaugcugccccagaguaaagugaugaggcugcugguacaacugccccaggccucaucuggcugcacugagagcugaauguauuaauauuuagguguacaugcuaugacacaccaguuggacaggucugcuuuagugacagaauuuaacaagaagguaaaggauguaguucaaaucaugguucucuguagcuuguguucaaauaguuugacaguuugguaugagggcugucuucacugaagcaucgccugucuugcuuagaucaaaggaagaacuauccgaguggaucaugugucuaacuaucgggcuccuaaggacucagaagaaauagaugaugugaccagacaacuccaggagaagggcuguggggcucguacccccucaccaaguuugucugagagcucugaagaugaaaaaccaacaaaaaagcacaaaaaagguaaagcauuaagacuuaagagaagauucuggguggucuuaaugucugcucuuccuugcauucacugauaguugauaaucaacucaagugugaaaggggaagguguggggaagcauaguuuaauugggaaagcagggaguaucaguggaaggcuggugcuaugggcagaauugugucucuccccaaguuaauauggugaaauccuaacccucagcaccucagaaugcgacuguauuuggagauaaggucuuugaagagguaacucaggaugggaauuaccuuguacagccacucgacauaucaaaggugacagacauccaaguuggcuucucggaggcacucuccuggaggccuagacaguggcugcuucaugcugcugccaagguuguucuccuuaugcacauuccccacuuccuagcaugugaaaguuucugucgcccaggcuggagugcaguggcacgaucucggcucacuguaagcuccgccucccgaguucaugccauucuccugccucagccuucugaguagcugggacuagaagcacccgccaccacacccggcuaauuuuuuuuuuuuuuuuuuaguagagacgggguuucaccguguuagccaggauggucuugaucuccugaccucgugauccgccugucuuggccucccaaagugcugggauuacaggcgugagccaccgcacccggcugugaauguuuuugaacuguagcaccugugguugauguaacguauucagaaaagaaaggugcuuuuuuuuuuuuuaagggaguucuuuuauuuuuuucccuuuucuuauuuacugcuucuuucuuuuauccuccagacaaaaaggaaaaaaagaaaaaaaagaaagaaaaagagaaagccgaccgggagguacaggcagagcaaccauccucuucgucacccagacgcaagacaguaaaggaaaaggaugacacuggcccuaagaagcacagcagcaagaacucagagagagcucagaagucagagcccagggaggggcagaagcuccccaaauccaggacggccuacucugguggagcagaggaccuagagagggagcugaagaaggagaaacccaagcacgagcacaaguccucaagcaggagggaggcaagagaagaaaagaccaggauuagggacagagggcggagcucagaugcacauucuagcugguauaaugggcguucugaagggcguaguuauagaaguagaaguaggagccgagauaaaucccauaggcauaaaagggcccgacgcucccgggagcgggagucuucgaaucccagugaccguuggcgucacugaagacuucagcugcacaguagauuuggaaauaauuauguuuuuuaaaugcagucaaauucaguugggugguuacuauuuuuguaucuaaaacuucuggggcuggauucuuuuaaucccuugacuauuuagagucauugggagggcugcaguuucaacagcuagauauccuggauauuguuugcaccauccauugucccuguaccagaguauguauccugaacuuugguucauaaauauggcucuugaacccauagaccccaguugaagauggaauuuucaggaaagggaaaauacuagauaauucuagaauucuagucuucguguuagauguuuauagcccagcaucuugggaccuuuccaguuacuagguuuggacagcuugaugugaacgaaugggauaggauuuuuaaaaucagccagcuccaugcccaaaccuuccuguuugcagaacuuuuuaaugucuuuucuuuuucauuaaaacuuuuuuguucgaua

SEQ ID NO: 192822 - RNA, 2794 nt, Homo sapiens
cuucaagauuaucaauaaucggagauacguauauuuuauuuguaaagaaaacauggcugcccuauuccuacgugguuuuguccaaauagggaacugcaagacugggauaucuaagucaaaagaagcauucauugaagcaguggaaagaaagaagaaagauagacuggugcuguauuucaaaaguggaaaauauagcacuuuucggcuaagugauaauauucaaaauguaguccuuaaauccuauagaggaaaccaaaaucaccugcauuuaacuuuacaaaauaauaauggcuuguuuauugaaggauuauccuccacagaugcugaacaauugaagauauucuuggacagaguucaucaaaacgagguucagccaccugugagaccugguaagggugggagugucuuuucuagcacaacacagaaggaaaucaacaaaacuucauuccacaaaguugaugagaaaucaaguagcaaaucuuuugagauagcaaaaggaagugggacagguguccuucagaggaugccuuugcuuacaucaaaauugacacuuacuugcggagaguuaucagaaaaucagcacaagaagaggaaaagaaugcucucaucuagcucagagaugaaugaggaauucuugaaagaaaauaauucuguagaauacaagaaauccaaggcagauuguucgagguguguaagcuauaaucgagagaaacaauugaaguuaaaagaguuagaagagaauaagaaauuggaaugugaaucuucaugcaucaugaacgccacuggaaauccuuaccuagaugacauuggucuucuccaagcucucacugagaaaaugguuuugguauuucuguuacaacaaggguauagugacgguuacacaaagugggauaaauuaaaacuauuuuuugaauuauuuccagagaaaauaugccacggccuccccaauuugggaaacaccuguuauaugaaugcaguguuacagucucuacuuucaaucccaucguuugcugaugauuuacuuaaucagaguuucccaugggguaaaauuccccuuaaugcucuuaccaugugcuuggcacggcuacuuuuuuuuaaagauaccuauaauauagaaaucaaggagauguuacucuugaaucuuaaaaaggccauuucagcagcugcagagauauuccauggcaaugcacagaacgaugcucaugaguuuuuagcucacuguuuagaucaacugaaagauaacauggaaaaacucaacacaauuuggaagccuaaaagugaauuuggggaagauaauuuuccuaaacagguuuuugcugaugauccugacaccaguggguuuucuugcccugucauuacuaauuuugaguuagaguuguugcacuccauugcuuguaaagcuuguggucagguuauucucaagacagaacugaauaauuaccucuccaucaaccuuccccaaagaauaaaagcacauccuucaucuauucagucuacuuuugaucuuuuuuuuggagcagaagagcuugaguauaaaugugcaaaaugugagcacaagacuuccguuggagugcacucauucaguaggcuaccuagaauccuuauuguucaccucaaacgcuauagcuugaaugaguuuugugcauuaaagaagaaugaccaggaagucaucauuuccaaauauuuaaaggugucuucucauugcaaugaaggcaccagaccaccucuucccuugagugaggauggagaaauuacagauuuccaauuauuaaaaguuauucgaaagaugacuucuggaaacaucaguguaucauggccugcaacaaaggaauccaaagauauccuggcuccacacauuggaucagauaaggagucugaacaaaaaaaaggccagacagucuuuaaaggggcaagcagaagacagcagcaaaaguaccuuggaaaaaauucuaaaccaaaugagcuagaaucuguauacucaggagaucgagcauucauugaaaaagaaccguuagcucacuuaaugacguaucuggaagauaccucacuuugucaguuccacaaagcuggagguaaaccugccagcagcccaggcacaccucucucaaaaguugacuuucaaacagugcccgaaaauccaaaacgaaagaaauaugugaaaaccaguaaguuuguagcuuuugauaggauuaucaauccuacuaaagauuuguaugaagauaaaaauaucagaauuccagaaagauuccaaaaagugucugaacagacucagcagugugacgguaugagaaucugugaacaagccccucagcaggcacugccucaaagcuuuccaaagccaggcacccaggggcacacaaagaaccuccuaagaccuacaaaauuaaaucuacagaagucuaacaggaauucccuacuugcacuggguuccaauaagaauccaagaaacaaagacauuuuagauaagauaaaaucuaaagccaaggaaacaaaaagaaaugaugauaagggagaucauaccuaccggcucauuaguguugucagccaucuugggaagacucuaaagucaggccauuauaucugugaugccuaugacuuugagaaacagaucugguucacuuacgaugauaugcggguguuagguauccaggaggcccagaugcaggaggauaggcguugcacuggguacaucuucuuuuacaugcauaaugagaucuuugaagagauguugaaaagagaagagaaugcccagcuuaauagcaaggagguagaggagacccuucagaaggaauaa

SEQ ID NO: 192823 - RNA, 40524 nt, Homo sapiens
ggcggggccugcuucuccucagcuucaggcggcugcgacgagcccucaggcgaaccucucggcuuucccgcgcggcgccgccucuugcugcgccuccgccuccuccucugcuccgccaccggcuuccuccuccugagcagucagcccgcgcgccggccggcuccguuauggcgacccgcagcccuggcgucguggugagcagcucggccugccggcccuggccgguucaggcccacgcggcagguggcggccgggcccugaggcgcgggauccgcagugcgggcucgggcggccgggcccagggaaccccgcaggcgggggcggccaguuucccggguucggcuuuacgucacgcgagggcggcagggaggacggaauggcgggguuuggggugggucccuccucgggggagcccugggaaaagaggacugcgugugggaagagaagguggaaauggcguuuugguugacaugugccgccugcgagcgugcugcggggaggggccgagggcagauucgggaaugauggcgcggggugggggcgugggggcuuucucgggagaggcccuucccuggaaguuuggggugcgauggugagguucucggggcaccucuggaggggccucggcacggaaagcgaccaccugggagggcguguggggaccagguuuugccuuuaguuuugcacacacuguaguucaucuuuauggagaugcucauggccucauugaagccccacuacagcucugguagcgguaaccaugcguauuugacacacgaaggaacuagggaaaaggcauuaggucauuucaagccgaaauucacaugugcuagaauccagauuccaugcugaccgaugccccaggauauagaaaaugagaaucugguccuuaccuucaagaacauucuuaaccguaaucagccucugguaucuuagcuccacccucacugguuuuuucuuguuuguugaaccggccaagcugcuggccucccuccucaaccguucugaucaugcuugcuaaaauagucaaaaccccggccaguuaaauaugcuuuagccugcuuuauuaugauuauuuuuguuguuuuggcaaugaccugguuaccuguuguuucucccacuaaaacuuuuuaagggcaggaaucaccgccguaacucuagcacuuagcacaguacuuggcuuguaagagguccucgaugaugguuuguugaaugaauacauuaaauaauuaaccacuugaacccuaagaaagaagcgauucuauuucauauuaggcauuguaaugacuuaagguaaagagcagugcuauuaacggagucuaacugggaauccagcuuguuugggcuauuuacuaguuguguggcugugggcaacuuacuucaccucucugggcuuaagucauuuuauguauaucugaggugcuggcuaccucuuggaguuauugagaggauuauaagacagucuaugugaaucagcaacccuugcauggccccuggcggggaacaguaauaauagccaucaucauguuuacuuacauaguccuaauuagucuucaaaacagcccuguagcaaugguaugauuauuaccauuuuacagaugaggaaccuuugaagccucagagaggcuaacagacauacccuaggucauacaguuauuaagagaaggagcucugucucgaaccuagcucucucucucucgaguaauaccaguuaaaaaauaggcuacaaauagguacucaaaaaaaugguaguggcuguuguuuuuauucaguugcugaggaaaaaauguugauuuuucaucucuaaacaucaacuuacuuaauucugccaauuucuuuuuuuugagacagggucucacucugucaccuaggauggagugcaguggcacaaucacugcucacugcagccucgacuucccgggcucgggugauucuccccaggcucaggggauucucccacuucagccucccaaguagcugggacuacaggugcgcaccaccaucccuggcuaauauuuguacuuuauuuuauuuauuuauuuauuuauuuuuugagauggaguuucgcucuuguugcccgggcuggaguacaguggcaugaucucggcucagugcaaccucugccucccggguucaagcgauucuccuaccucaucccccugaguagcugggauuacaggcgccugccaccaugccuggcuaauuuuuuguauuuuuaauagagacgagguuucaccauguuggccaggcuacucucgaacuccugaucucaggugauccacccgccuuggccucccaaagugcugggauuacaggcgugagccacugcgcccggccuaauauuuguauuuuuuguagagaugguguuuugccauguuguccaggcuggucuugaacuccugagcucaagcgaucugcccgccucugcuucccaaagugcugggauuacaggcaugagccaccgugccuggccuagguagacgcuuuuagcuuuggggugugaugccugccccaguauauagugaauuuaauuauugcuagagcuggcuguuuguuaguuuucuuugaacauaagauacucauuguuuuuaguuugcaaaucccucuuccuuuuuaaaaaauuucuuucccuuaaauuguuugcauguuagcaauaacaaaugcuuaaauggugcuaugugcuagauacucuucuaagcccuguuauguauauuaacuaauuuuuuaaauuacacaaaucagagagguuaaguaacuugcccaagauuacccaacaauacuaggauuugaaccuaaguuugucucaccccagauucugcucuuaaucucuaaacuuuuaaguuaguagugacaauaguagguauuuauugaauacuuaacuauguuuuaggcguugaaguaaauauuuugcaggcauuaucuaauguaaacacccuaaaguuacauaacagguacccuuuagguaaauaaacacuaguaugaccuuggaggcacagauaguugaaguaacuugcccaauaucacuuacaugaaauuggcccucaaaugugucugauacaacccaugcugcuuguaacuaucguuuuaaacugccaggguaaacuuggacacacuugagcuaagaaaaagcuuuuagauuuuugcaaauuaaugugaaagauaugcuuuauguggauauaauaucuucuaaauuucggggaugguaguccuagaaauguaauccugcccuagccgagcuuacccugccaauaauuuuuuacagaauugguaaaacggagcaccuuuuuuuuguccuuggccacacuguuaucaacaggguguagauugacaucaaucuguagguguaaaccagaauuacucuuugugaccaccaggaaauagagcaguucaguucagggguuucuuucugugaauuuagcacugugaccugcauacuacaagucuacuuuguuuucuauccauuguuuguaucuggguauugcaaaagguaggaaaaggaccaaccagaucagcagagaagaguugccuuggaguuuucuuuuaguuuucugcaguucauuagauaguaacuaggccaugucauuuuacucccuuguagugaagauauguugaaguuguacugguauacucuucuaccuuucuguaauuuuauauuguguagacuugauaaaauuuaugugucaaucaccaccauuaauaucaauauugagccucaauucuuauuuuucugcccaguggcugccaaauuacuaacauuuacaauaauucacuacuacuaagauaaucuacuaguucgaucacauacuucaaauuguuauggaacuacugucuucagcauugugcuucugauaacugauaaguauaauuuuuuuuuuguccagagugaacaugucuauucuuccacuguacacacuaauaaaaggaaaaauuguaauauuggguaaauucauguccuuacacauguaguaguuaugagcccaugucccuagaaugaguaauaauuuaucccucccuugguugaauagucaagaaugcugauuuuaauucuucuaacagcuuuaucccucagaagggaaggcaagcaaguuauauauguaguuuauuuguaagacugauaugaaauuggaagaugaaucuacuauuagcuuuaauuauuuuuacauuuaggaauauugcaucaguaacucauaauuuugguuuucuguuauccugaguuaacacaaauuauccaaggagauggcggaucaucugcuuugagguguuuuuuuuugagaauuuuaauguaucugaauauaaaagguaaaaauaugccaacuagcaauuucugcccauuccagaaguuuggaaauauuacucauuacuaggaauuaaauaaaauaugguuuaucuauuguuauaccucuuuuaauucacauagcucauuuuuaucuuuuauuuuuguuuguuuuuuuugagauggagucuugcucugucaccaggcaggagugcagugaugcaaucucggcucacucuagccaccgacucccugguucaagcgauucuccugccugagccuucugaguagcugggauuacaggcaggcaccaccacgcccagcuaauuuuuguagagacaggauuucaccguguuggccaggauggucuccaucuccugaccucaugaucugccugcuucggccucccaaagugcugggauuacaggugggagccacuacgccuggcccacauagcucauuuuuagacucacuuccauuaagucuuguuuggacccacgaacauugucuuuuuuuuuuuaagauggaguuucacuuuuguugcccagacuguagugcaauggugcaaucucagcucacugcaaucucugccuccuggguucuagcaauucuccugccucagccucccgaguagcuggaauuacaggcgcccgccaccacgcccagcuaauuuuuguguuuuuaguagagacgggguuucaccauguugggcaggccaggggugauccgcccaccucagccucccaaagugcugggauuacaggugugagccaccgcaucuggccaacaugucuuuuuuuuuuuuuuccuuuuuaaccacaaagagacuuaagcaguccuugucacagaugaugaauugauguugcaaguauugucuuagcuuggauuaauuuucuugcuuacuguaauuuuagauaauauagcuuuguaauuagagauuuuauguguaaaccacaaaaauguuuacaugaaggccauuauuacagaugugacgugcauaauuauuaguaauuuguauguuuacaugggucagucuggcaaaaaauuaugaaguuuuaaaaauuaaaaaaaauuauaaugccaguuuuacuggaaaguaaaauuauuucaguaaucgauuauagcaaaaguauugauuuucauuccagacaaaagucagaaugaaagguaauuucucaauacucuuucagauuaauaaaaguaccuguagcgauuuuuaucauucacaaguauaucacaaguaaguuagaauuugagaacuguguucuagaucucugaggagaugcagucagauuucugaacugucucagcaaaugguaaguaacuuagagcuaguaauuaauaaccuguccuuugauuucugauucagccaagaauggccauauuugggaaaggcagaucuggagaguaaccacguuuucauucauuuaccacuucuaggccccuccagagcucucagauauuuugggguugagcccuuccccaaagccauacaggaccuuuuuuuugugaucuguucuagccauuuuuauguugggugcuuguuauggacugagcauuuauguccucccacaccccccccauaccuuuuuugaaguccuaacccccagugugaugguauuuggagacagggccuuuggaagguaauuacaguuagaagaagucgggaggguugggcccaggucugauuggauuagugcccuuauaugaaaagacaccaggacgggcgcaguggcucacaccuguaaucccagcacuuugggaggccaagguggguggaucacgaggucaggaguuugagaccagccuggccaauguagugaaacaccaucucuacuaaaaauacaaaaauuagcugggugugguagcgggcuccugucauccaagcuacucgggagggugaggcaugagaaucacuugaacccgggaguuggagguugcagugagcccagauugugccacuguacuccagccugggugacagagugagacucugucucaaaaaagaaaaaaaaaaaaaaagagacaccagagagcuuguuagaagaggucaugugagcacacaguuagaagaccuucaagccaaagaagaggccugagauugaaaccuaccuugcagguaccuuaauuuuggacuucccagccuccaaaacugugagaaauaaguuucuguuaagucacucagucugugguauuuuguuauggcagccugagcagguaguuguucuuucagaagguguugauaauaaccacaugcaacaccaagucacaaauaauaaaacagauguaacuuauauucauacagaaaguugggcacugccauugccuuguugguuuacacggcugugcuaguucaguagcagaaaggugcuggucuccuuuacucaguuuacaaucuaggcaguagaauguaaucacugcuuuaaacuugauacugcuuagggagagaaucauuggugcuggguaacuuuggguucuagguuuacuuuuuguguauauauaacuguuuuugguaaaucacaaguuucugggcuugucgaauuagauuuuguuacagauuaugagcuuuauuaugcuauacaguuaguuguauguauauaugccuuucccacuagauuuuaagcuuuuuuuuuuuuuuuuuuuuugugacggagucuugcucuugucgcccaggcugaaguggagugcaguggcacaaucucggcucacugcagccuccaccuccuagguucaagcgauucuccugccucggccucccaaguaacugggacuacaggcacgugccaccacacccggcuaauuuuuguauuuuuuguagagacaggguuucgccauguuggcuaggcuggucuugaacuucuggccucaggugauccacccgccucagccucccaaagugcugggauuuacaggcaugagccaccacgcccagcuauaagcucuuuaaggguuguaaauuuauaaucauucuuuuacucuccugcaaauucuguugcacacugccuuaaucaagguagaugcugaaugcauuuuuguauaauugaauauguugcaauccccaacucucuccaacuguuccugucaaagcagccacuggauuguuaacuaauccauauuagaugggguuaauuaauaucagaugggacaaguaagggcuaauaagauuauaggccaccaaguagauuucugucuagcucuuauagagauugaguuuauuggaccuguuugauaggaaguuuugguguuugggaugauuaaaacugaaguuccuauuuauugaauuauaccuauuuauauuauuucauaucagugguccacaugcaagugaggcuucugagacagaguuugaguucucucuucaacuaccauaacacuuaaccuguaucuuuuuuuuuuuuuuuuuuuuuagacggagucucgcucugucacucaggcuggaguguagugguaugaucucggcucacuguaaccucugccuccuggauucaagcaguucuccaugucucagccucccuaguagcugggauuacaggccugugccaccaugccuggcuaauuuuuuuuuuguauuuuuaguagagacgggguuuuaccacguuggccaggcuggucucgaacucuugaccucgagcgaucaacuugccuuggccucccaaagugcugggauuacaggcaugagccacagcgcccagccgucuuuuuuuuuaaauagcaauuuaacacuguucacaguuacucauguacaugucaugccaucuauuacacuguaaguucugugaggguagcuguaucaaauuuaucuaacucucucuaguaugcaugacauaguaaguauucaauaaauauuugcauauuagugauaaggauacagguucugaauaguggguccuuaccauuuaagaauuaguauuugauggccgggcgggguggcucacgccuguaaucccagcacuuugggaggcugaggcgggcggaucaugagaucaggagaucgagaccauccuggcuaacauggugaaaucccgucuuuacaaaaaaaauacaaaagaauuaaccaagugugguggugggugccuguagucccagcuacugcuuugugaggcugaggcaggcagaucaccugaggugggaaauucaagaccagccugaccaacauggagaaaccccaucucuacuaaaaauacaaaauuagccgggcgugguggcgcaugucuguaaucccagcuacucgggaggcugaggcaggagaauggcgugaacccgggaggcggagcuugcagugagccaggaucgcgccacugcacuccagccugggcgacagagcgagacuccgucucaaaaaaaaaaaaaaaaaaaaaauuaguauuugauauuugaucauuaaauaugaauuaagaggacuuagacuuuuuguuaaaugucaagcugggaaaaguugucauuuaaaugaauugccucuuauuuaauuucgucugaugauacauuuuguuuuuauuuuguaaaaaauuauuuuuuuucuuuuuggagacagggucuugcucuguugcccaggcuggucacaaacuccugaccucaagcaauccuccugccuuagccucccaaaaugcugggauuacaggcgugagccaccucgcccggccuuguauuaugauacauuuugaacaacuacaaguagacuugguauaaugaaccugcacguacccauugccaaguucugacaacugucugucuauagccaauuaugcauuucuuaaauuagaacccccccaauauacccaaauauauauauaugugugcauauauauaguaaguuguaacaaaguugugaauucauaccugaaguaucucaagugaugcaaguuuuaugaauuuuuguuuaugccuuuugggaagaguuguauugacaaauuuuuuaugcuuaaaguaaaccauaaaucaaaaaaauaaaaucuaggaugcaauaaaacaaaacaacuucuugacauaaguaugguauguaaaucuguuuugauuggaaaucaauuuguuauauugccagaauuccuguuuuagaauacaucucugcugaucugucuguauucuuagacugcauaucugggaugaacucugggcagaauucacaugggcuuccuuugaaauaaacaagacuuuucaaauucuuagucgaucugcagaaccuguagccaggcacugaaccauuuugauagaugcaguaaucguugcaaguguauauuucaaggaguucuggcuggguccuaguuuaugcuuguggcagaagcagugaguaacugggaggaaguuggugaguaagcuucaaggaagaagucauuuuuaguacucuggaucuuccugauuuuaaagcacuacaaaauggugcauuuucauucuugucaagugauaacagauauauucugaugagccugaaaugaauauauauuguaucauuuuuauaauaucuagcaagguuuguauuuuccuagaacuugaacuaaauuucaguucauaaaauuuauaaaauacuuaguuguuguaaaauauuuuuggaauguucacauaggugacacacaaaugucccauuuucauucuuucuauaguaaauauguucugauaugugaagguuuagcagaugcaucagcauuuaauccuagaggaucuggcauaaucuuuucccccaagaauagaaauuuuuucugcuuaugaaaguaguacauguuucuuuaaaaacaaaucaauauugacuucugccugcuguauagcacuaugccuccaccuggccaugaccaggggcauguccugguccaccuaccugaaaauguuugcaaccagccuccuggccaugugcacaggggcugaaguugucccacagguauuacgggccaaccugacaauacaugaaguuccaccaaagucugagaacucagaacugagcuuuggggacugaaagacagcacaaaccucaaauuucucagcacuggaaaccucaaaauauaacugaauuccauaaauaagauuuuaagucuuaaauauguauuuuuaaauguauuaaaagucaagcugcuuguauuuaagcaccuaauacaaugcuuagguuguaaaaggagaugcucaauagguacuaacugauauauugagauuuaauuaugguuugaccaauauuuauuggaaaccgccaaagcuuaaaucaucagcuucuugaaugugauuugaaagguaauuuaguauugaauagcaugugagcuagaguauuucauucuuucugguuuauuucuucaaauagacuuugaauauaauggugaauggguauuauaaauuaacuaauaaaaaugacauugaaaaugaaaaaauauauauauuaaaguguagaaagugaccaggcgugguggcucacaccuguaauccaagcaccuugggaggcugaggcaggaggaucucuugaucccaggaguucaagaccagccugggcaacauagcgagacuucgucucuaaaaaaaaaaaagagagagaaaaaaauuuuuuuuauuuaaaaaaaguguagaaagugucaagaccccacuucuuaccauuauuugguauauuucucuauacccacccacccuuccuccuuacucccucccucccuucccaaucuuuuuaucuuuuuguauucugauuuuuuguuuguauauuuugcuuuaauuuaauguauccuuuaaaaauuucccauacauuuuauauguauauauaaaaacgcaugcugccaaagauaauuuauaagaaagaccauugaauuuuuuuaaaagugauauauauucauugaaaaaaauuuagaauauauagcaaagcaauaaagaacuaaauaaaauugcuguaacuccucuuucaaagauaagugcuuuuaugauuuuguuguauuuuuuucuguauauagguacauauauaguauuuauaaagcuguacucauaguacauuuucacaucacagguaccauaucaguguuauuaaauauuuuguaugccaggggcuagacauaccaagacaaccaauaugugguucuacuuaaauaauauuagaguaucuuuuaugaugacacuucaugaguugacuauaauaaucuuagacuucuaagaguuuggguuuucaaaagaucacuuagcuuuuuugggugauuuuucccccuuacugugagaugagagaggcuguuuggauuugggauugggguagcggggacagcaacuuuucuuuucuuuuucuuuuuuauuuugagguaggguauugcugugucacccaggcuggagugcaguggugugaucucggcucacugcaaccuccaccucccgggcucaggugauccuccugcuucagccuccccaguaacugggacuacaggcgcgugccacaugccuggcuaauuuuguauuuuuaguagagaugggguuucaccauguuggccaggcuggucucuaacuccugaccucaggugauacgcccaccugggccucccaaaauacugggauuacaggcaugagccgcugcaucagccagcaguuuuucuugugguuuuuuuuguuuguuuuguuuuguuuuguuuuugagauagggucuuacucuguuguccacgcuggagugcugugguaugaucguagcucacugcagccucaaacuccugggcucaagugauuccuucugccuccgccucccgaguagcugggacuacagguaugcaccaccauaccuggcaaauuuuuacaaaguuuuuuguagggacggggucuugcuacauuccccaugucggucuugaacuccuggccucaagcaacucuccugucucagccucccaaagcacugggauuacaagugugagccaccacaccaugccaguuuuuccuguucagugugauauuuuaucuuguuagacuacaguguguuaaaacuuguuuuacuaaauuuucaaacauacucaaaaguggagagaauaguauaaugaauacccguauguucaucacccauguuuagaauauuauuaaauauaaagauuuugcugcguuugucuuagcucuuuaaaauuuuucuuuuucucuuugugaccuaaaggaaauuccauaucuuaucacuuuacuucuacauucuugacuaagaugacuaagacauauaguuacaugguuuuuuguuuuguuuuuuguuuuuuaaagacgaaaucucgcucuugucccccaggcuggagugcaauggugccaucucagcucagugcaaccucugccuucuggguacaagcgauucuccugccucagccucccaaguagcugggauuacaggcuccugccaccacgccuggcuaauuuuuguauuuuuaguagagacggcggggggagguuucaccauguugacaaggcuggucuggaacuccugaccucaggugauccacccgccucggccucccaaagugcugggauuacaggcgugagccaccgcgcccagccuguuuuuuuguuuguuuguuuuguuuuuuuugagacagagucuugcucuguuucccaggcuggagugaaguggcgcauucuuggcucacugcaaccuucaccucccagguucaagugauucuccugccucagccucccaaguagcugggacuacaggcaugugucaccacacccggcuaauuuuuuuguauuuuuaguagagacgggauuucaccguguugcccaggcuggucucgaacuccugagcucaggcagucugccugccucagccucccaaagugcugggauuacacgugugaaccaacccgcccggccuguuguuuucuuacauaauucauuaucauaccuacaaaguuaacaguuacuaauaucaucuuacaccuaaauuucucugauagacuaagguuauuuuuuaacaucuuaauccaaucaaauguuuguauccuguaaugcucucauugaaacagcuauauuucuuuuucagauuagugaugaugaaccagguuaugaccuugauuuauuuugcauaccuaaucauuaugcugaggauuuggaaaggguguuuauuccucauggacuaauuauggacagguaaguaagaucuuaaaaugagguuuuuuacuuuuucuuguguuaauuucaaacaucagcagcuguucugaguacuugcuauuugaacauaaacuaggccaacuuauuaaauaacugaugcuuucuaaaaucuucuuuauuaaaaauaaaagaggagggccuuacuaauuacuuaguaucaguugugguauagugggacucuguagggaccagaacaaaguaaacauugaagggagauggaagaaggaacucuagccagagucuugcauuucucaguccuaaacaggguaauggacuggggcugaaucacaugaaggcaaggucagauuuuuauuauuaugcacaucuagcuugaaaauuuucuguuaagucaauuacagugaaaaaccuuaccugguauugaaugcuugcauuguaugucuggcuauucuguguuuuuauuuuaaaauuauaauaucaaaauauuuguguuauaaaauauucuaacuauggaggccauaaacaagaagacuaaaguucucuccuuucagccuucuguacacauuucuucucaagcacuggcuaugcauguauacuauaugcaaaaguacauauauacauuuauauuuuaacguaugaguauaguuuuaaauguuauuggacacuuuuaauauuagugugucuagagcuaucuaauauauuuuaaagguugcauagcauucugucuuauggagauaccauaacugauuuaaccaguccacuauugauagacacuauuuuguucuuaccgacuguacuagaagaaacauucuuuuacauguuugguacuuguucagcuuuauucaaguggaauuucugggucaaggggaaagaguuuauugaauauuuugguauugccaaauuuuccucuaagaaguugaaucauuuuauacuccugauguuauaugagaguaccuuucucuucacaauuugucucuuuuuuuuuuuuuuuugagacaaggucucuguugcccaggcuggggugcagugcagcagaaugaucacaguucacugcagucucaaccuccuggguucaagcgauccuuccaccucagccuccugaguagcugggacuauaggugugcgccaccacucccagcuaauauuuuuauuuuguagaaacaggguucgccauguuacccagccucccaaagugcugggauuacaggcaugagccacuggcccaguuucuacagucucucuuaauauuguauauuauccaagaaauuucauuuaaucagaaccugccagucugauaggugaaaaugguaucuuguuuuuauuugcauuuaaaaaaaauuaugauagugguaugcuugguuuuuuugaagguaucaaauuuuuuaccuuaugaaacaugagggcaaaggauguguuacguggaagauuuaaaaaaaauuuuuaaugcauuuuuuugagacaaggucuugcucuauuguccaggcuggagugcaguggcacaaucacaguucacuccagccucaacauccugcacuaaagugauuuucccaccucaccucucaaguagcugggacuacagguacaugcuaccaugccuggcuaauuuuuuuuuuuuugcaggcauggggucucacuguauugcccagguugguguggaaguuuaaugacuaagagguguuuguuauaaaguuuaauguaugaaacuuucuauuaaauuccugauuuuauuucuguaggacugaacgucuugcucgagaugugaugaaggagaugggaggccaucacauuguagcccucugugugcucaaggggggcuauaaauucuuugcugaccugcuggauuacaucaaagcacugaauagaaauagugauagauccauuccuaugacuguagauuuuaucagacugaagagcuauugugugaguauauuuaauauaugauucuuuuuaguggcaacaguagguuuucuuauauuuucuuugaaucucugcaaaccauacuugcuuucauuucacuugguuacagugagauuuuucuaacauauucacuaguacuuuacaucaaagccaauacuguuuuuuuaaaacuagucaccuuggaggauauauacuuauuuuacaggugugugugguuuuuuaaauaaacuccuuuuaggaauugcuguugggacuugggauacuuuuuucacuauacauacuggugacagauacccucucuugagcuacaucgguuuguggggagucaaaaguccuuuggagcuagguuugacaaauaagguggguuaacacuuguuuccuagaaagcacauggagagcuagaguauuggcgaauugaagaaaucccccuuuuuuuuuaacacacuuaagaaaggggacugcagguauacucaagagaguaagucgcaccagaaaccacuuuugauccacagucugccugugucacacaauugaaaugcaucacaacauugacacuguggaugaaacaaaaucagugugaauuuuaguagugaauuucauucauaauuugaucgugcaaacguuugauuuuuauuacuuuagacuauuguuucugauuuuauguuggguugguauuuccugugaguuacuguuuuccuuuaaaauaggaauuuuucauacucuucaaagauuagaacaaauguccaguuuuugcuguuucaugaaugaguccuguccaucuuuguagaaacucgccuuauguucacauuuuuauugagaauaagaccacuuaucuacauuuaacuaucaaccucauccucuccauuaaucaucuauuuuagugacccaaguuuuugaccuuuuccauguuuacaucaauccuguaggugauugggcagccauuuaaguauuauuauagacauuuucacuaucccauuaaaacccuuuaugcccauacaucauaacacuacuuccuacccauaagcuccuuuuaacuuguuaaagucuugcuugaauuaaagacuuguuuaaacacaaaauuuagacuuuuacucaacaaaagugauugauugauugauugauugauugaugguuuacaguaggacuucauucuagucauuauagcugcuggcaguauaacuggccagccuuuaauacauugcugcuuagagucaaagcauguacuuagaguugguaugauuuaucuuuuuggucuucuauagccuccuuccccauccccaucagucuuaaucagucuuguuacguuaugacuaaucuuuggggauuugugcagaauguuauuuuagauaagcaaaaacgagcaaaauaggggaguuuaacuuuaauauuuucuuuuaaaaagcauuucauguuauaagaucaauucugagugguagaaaugcuuugacauuuuauuuccauuuucuacuuuuaguuuuuuuccuauuuguuuaagaucuuagaggauuauuaagcugaacuccucaacugauaaaaagcaugacaucuuaaacauaagcaaagcauauuuuuagguuaauuuucacauagaaaacaguuuauuuuaugugaaauucuauguagauauacuauuuuuuugguauuuauugauauguuuauuuuauuuuauuuuauuuuauuuuauuuuauuuuauuuuauuuauuuauuuuuuuuuuugagacagagucucacucuguugcccaggcuggagugcaguggcaugaucguagcucacugcaaccuccaccucccggguucaagcaauucuucugucucagccucccgaguagcugggacuacaggugccugccacuaugcccggcuaauuuuuguguuuuuaguagagaugggguuucaccuuguuggucaggcuggucucgaaccccugaccucaggugauccacccaccucagccucccaaagugcugggauuauaggcaugagccaccgugcccggccgacauguuaauuuuuuaaaaaaggcuuuacugggguauauuuuauauaauauaauaaucacauguuuuaacuauacaauuccaagcuuuuuaguauauuuauagggcuaugcaaggaagauauacuguuaaacaguagaaauugagaaagcucuucugauaauaucucuugauuugaugauggcucaugccuguaaucucagugcuuuggaaggccaagacagcagaaucacuugaggccagggguucgagaccagccugggcaacacagcaauacccuaucuuuacaaauaauaaaaauaucuguugauuugaaguaaaguuuuuuuuuaaagacaaggucucauucugucacccaggcuggaaugcaguagcaagaucacagcucacuguggccuugaccuucugggcucaagugauucucccacuucggccucccgaguagcugggacuaacaggugugcaccaccauggcuggcuaauuuuuuuuuauguuuguagagauugggucuuacuguguugcccaggcugaucccgaacuccugggcucaagcagucuuccugccucagccucuaaaauugcugggauuacaggcuugagucaccaugcccagccugaaguagcauuucuacccuguuuaauaauucagcagcuugucauguaagauauucauauaugcauauaaaacauuaggcagcuuaauuugguaaaacuguaaaauggaaauuuuaaauuguuugcagcaucaauaacauugaugucaguaugauuuuuacaugcugaucuugaccaauuugaaacagugaguuaaaaucuggcugauccguacuaauccuaaagaaauauucuaugaacuauuaaauguuuccagaauauauaaagaaacauuaugaugucaacacacccaucuauuuuuuuuuggaaauaaaaacuccauuuuucuuauuaaagaaaacaugcuuauuagaaaacauacggcugggugcaguggcacacauguaauuccagugcuuugggagaucgaggugggagaaucacuugaggccaggaguuugagaccagccuagacaacauaaugagacccccucucuacacaaaaagaauuaguugugcaugguggcgugcaccuguagucccagcuacuugggaggcagaggcaggagcaucccuugagccuaggaguuugagacugcaggaguucgagacugaguggaaugcaguggaacugcauuccagccugagugacagagggagacccugucuuaaaaaaauaagaaagaaaacacaacugcagaaaauuauaaaggauuuaagucauuccaaauaucacugccacuuuuuauuuagaauauucuaaagaauucucucucuguguacacacacacauaugcguacucuuaauccaaguagcuugguaggauuuuauuuaccuagugccuagaugggaaauugccuggggauuccaaauaccuauuucauuaaauuaaagaugucacugauuuuaagacuuaacacuauuuuucauacugccaagaaagaaaacacuaccaguuauaaauguaaauugccaucaauuguaauacaucaauuuuagagcuauuauuaauaaaaugugaaugugcaucuuagagcaaugaaauauaguacuauauauuugaugaccuuuucugcccugugauauucagaaagugaaaguuaaauaugggcugagcaugguggcucacaccuguaaucccaguacuuugggaagucaagacgggaggcuggcuugaacccaggaguucaagaccagccuaggcaauguagcgagacgccaucucaaaauauuaaaaauaaguaaauaaguaaauaaaaagaagguuaaguauacaaauguauuuccuuuguugugaauuuauuucaauuuuauagugauuuuuuuuuuuugagacgaagucucacucuugucccccaggcuggagugcgauggcgugaucucagcucacugcaaccucugccucccagguucaagcuauacuccugccuuggccccccgaguagcugggauuacaggcgccugcuaccaugccuggcuaauuuuuguauuuuuaguugagaugggguuucaccauguuggccaggcuggucuagaacucuugaccucuggugauccacccgccucggacucccaaaaugcugggauuacaggcgugagccaccgugccuggccagugguuuuuuguuguuguuguuguuguuguuuuguuuuuguuuuuguuuuuguuuugagacaggaucuugcucugucacccaggcuggagugcaguggugccaucuugguucacugcaaccucugcgugggcucaagcaauccucccaccucccuuuccagaguagcggggaccacaggugugugccaccacaccugacuaauuuuugcauuuuuuuuuguagaaacaggguuuugccauguugcccagguuggucugaaacuccugagcucaaacaauccaacugccuuggcuucccuaagugaaauuacaggcaugggccacuguacccagucuagugauuuuuuuauuuuuauuuuuauuuuauuuuauuuuauuuuuuuaccaaaaaaacaacaaagccucaggaggaaaaguugauacacaaguaaauuuuauuggaaauguuuuuguguggaccuuaagcagagggaaaauuagucugcauuaugguguauccagacuaaaugacugauauuaaaaugaaauuauucuuaggauuugcaaucuuagagaaaacuuuuucauuuuuauuuuuuugaguuacaaauuaucuucauuuacauuugagaacagugagucacagagggauuaaguaacuuacucaagaucauacaagucuuugauuugaacccaaucuuuuaacucugcagaacucagagucacucuuauuuggaaaaacuuuuuaacugauguggauccucuaauaugggcuuccuauuauucauucucuauuagucagaaguuuugcaagcagacagaauucauuuugccaauuacgggauuuucccucaguugcagucaagguucauaaaacuauaacucuuuaucuuuaauuagaaauguuuuuuuuuuugagacaaggucuugcucuguugcccagacuggaaugcaguggcauaguggcccauugcagcuuugaacuccugggcucaagggauccucugccucagccucccaaguaucugagacuacaagugcgugccaucacccauggcuauuuuaaaaaaaaaaaaaauuguagagauagggucuugcuguguugcccaggcuggucucaaacuccuggucucaagcaauccuucugccuuggucucccaaagugcugagauuacaggugucagccguugcaccuggccaaaacgauaacuuaaaauacacacacacacacacacacacaaacacauauguguauuugugugugugugugugugugugugucucaaaagguaucaaaagagaauagcuauaacuuuaguguugaucuugauagugacuugauuaggcucuguuuaacaucaaagaugcaaauuaauacuuucuuugaacauauuaaaaaugcagaaaauauuggaguauuuuauuuuaaauaaauuguauucuguauauuuaagguauacaacaugauguuaugggauacauauaggugguuaaaagauuacugcagugaagcaaauuaacguaucccucaacucacauaguuacccauuuuuuuuuuguuuugguggcaagaggagcuuaaaaucucauuuagugugaaucccaaauacagcacaauuuuauuaccuauauacuucauguuguacauuauauuucuagacuuguucauccuacauaucugcuacuuuguauccucugagcuacaucuccccauuuucucacuugccccccaaguaguuucuuaaagugucucauguaagagggcaguagcuuucagcuuaaacuuuuucucuguauguagucgauuucuuugagguauacuuuucucuccagaauaguuagauguagguauaccacuuugauguugacacuaguuuaccuagaacuuaucuucuguaaaucugucucuauuuccaucucugucuccaucuuugucucuaucucuaucugucuaucucuaucuaucuaucuaucuaucuaucuaucuaucuaucuaucuaucuaucuaucuaaagcaaauucaugcccuucuccuauuuauugaaucgagaccauagacaggggugagagaaagaauuuggcaggaauggggauguguauuaucuguggcauaaggaaacuuuacagaacuagguucaaaaguauacuuucuaguucuuucccauggcuuuucacuuugauguaguccuuaucagguaacugagguuuuauauaaguccccugauucuuagaacaugaagguguaguagucaagguuggucccuugaaaccacaaauuuugugaaaaaaaauuaagaaaauugaauaauuuccucagcaaauacauauugaucaucuguuauacagccaugagaagugguucuguugcacacguuuauuuuaucagauccuaaucccaaaccaggcauaaaauggaaaccaugaagauaggaugaaauaacuucugaauguuugaauguuugaaaauaguguacuuaaaaauaccaggugguuuuuguuuguuuuuuguuuuuuucuuuuuuugagacagggucucacucugucacccaggcuggaguguaguggugcaaucucaucucauugcagucuugaccucccaggcucagguuaucucccaccucagccucccaaguagcugggacuacaggcacaugccaccacgcccagcuaauuuuuuguauuuuuuguagagacgggguuucacccuguugcccaggcuggucuagaacuccugggcuuaagcgauccucccaccucagccucccaaagugcuaggauuacaggcaugagccaccaugccuggcagaaaauaccagguuuuuaaguaucagcacuuacucuucaaucuuuucuauuacuauguugugcuaaaugguauuuuuuauuuaauuagagcaaugcuguucaauagaacuuucuuugaggauggaaaucuuuuauguuucugcuaugugguacagagccacuagugacauguggcuuuugagcgcuugacacaucuugugcaacacaggaacugaauuuuuaaguaauuuauauugccacauguggcuaccguaugggacaguguaguacuagaugaucuguaagggcugugcuucaucagugucguuuuuuaacugacaaaaaccuuuaguuuuuuuuuuaguaauguguuuauuuaaaagaauucauaaaauacaaguaaacaaauuaacuuguuaccugagcauauguccuuucauacuuauuuuuucugcauacauauuuuggaaaauggaauaucugcccuuuuuuuuuaucugagauacagucuaccucuaaaaauacaugauucuaacauucucacuuuuguuggcauuugaucaggguauagaaaaacaguuaaaaggacagagaaugguugagagauuaugauaugaagagaaaaugugauugagugugguagacuuggggccugcuugaauguugagagaaugacuguuuuccgauaaaaaaaaaaaguccauucuaggauccuaaaagaagggucugaaguucacugcagaaagcaagcuacauaguacuaagccacuaaggggacauggagcccuuaguaauuccuaccuuaguaauagucucaucaugcccucuugggaacccagccuuguugauuagccucucugcuuucucuccuuauaguucaaccucccuguuuguuccaagcaguucuuuuccugcccauuuauuaugcauuucuauacagcuuuccuccucuuuuucuauaccaugcugcaguucuuauugcuaccuagagguuuucaaaauuccuaggggcggauaaguaggcauaaacaaaguucuucccuauuauccuuccuauuuuuucaccuagacugaagagguagacaaaauagaaauaaagacauuaaggguauguguuuguagucccaaagagcuucucuggcaauuuuauguaguugacagugacgcucugaguucaggacagauuggacuccuuggcugagaggagugaggagauaggacgguagaggagaggguagagcaacucuggaggaagcuuuccccucaccuuugccaguccuguuauccuagacuuaaccauaauuaaagaugagggaggcacucaguaaagggaucuagugggaagcuuguuccagacagccaaggagggagguucgcgcaguuccuuuggccacccaggugggguaauugauccauguaugccauucauguacaauguaggcacuuauaccuguauuccaauguagugaacuauaccauuacucuuaaauuaauauucuuuauuagcuuccaugguggcuauaggccaggcaagagaguuaagaaaaaauaaauagccagguauggugacucaagccuguaaucucggcacuuuaggaggccgaggcaggaggaucgcuugaguccaggaguucaagaccagccugagcaaaauagugagauccugucucuauuuuuuaaaaaagccuuggggcaaacaggaguauggagguuuggaugcuaauagaacagcagugucuuacugcuuggaguucucuuguuucuuguccuaucaccguagccuuuggaucacagcaauuuuuccaugacuccauacuuuucaguucuugaauauuuuuuccuuuauuccucuugucucuguaaagacaucaacuggaguuggacuguaauaccagguaucuccagaagauggcacuauuuaacagauuuuauaaauaauuugaugugagucacugucaucugaagcuuguugccuuuucuuucuuucuucuuucuuuuuuuuccccaucaauucuguauguuugaaaugcuggguuuuaaguuaguuagaauaagggaugucuguaauuucccuaaauugagaaguaauaugcaaagguugauaucagaagucauaugcucaccuugcaacaccaaauaauacuggcccauuugugauuuuugaaaguaacacuccauaauaaauggauguauauauagaagcauaacaaaaauagaagcacauaaaagugaaaagucucauaaacgccauugucacuacucauguaauugcuguuacaaauuuguuuaaauguugaauaaaaauggugucauaggcaacacaguguuccacuacuugguguuuuuaauagcauuauucugucucagugugcuuuggauuaucaggugcuuuuuaauaguugcaugguauuacauuguguagaugaacuugauuaauuuaaaugguucccuguuaauggacauguugguuuguuuuugugaacaacugauacagugaacauuuauuuuuuaaauaaaaaaaagagagacagggucuugcuguguuucucgggcuggccuugaacuccuggggucaagcgaucgucuugccucugccucccugggauuacaggcaugaagccaccgcacccggcccagugaacacucuugaauguaucuuuguauacuugucaguguuuuuguagcauugauucccagaagugggauuacuggauuaagugacaugcauguuugcaauuuuaacagguauugcuaugucauuuucaaaagaagcuaugccaauuaauacucucaccaacaagagugcuuauuuccccucagcauauuaucaggcuuaaguuuugccaguaugggugggagaacaguagaaucacauuguuuuaguguuuguuucucagauagauauaauuuuacaccuuauaaccuucucuucuauaaauugucuauuuguguucauucuccauuuuccuauggguucuuauuguuggagcccaauauauaaaaggggguauuuguuacagaaccucuucaguuuugguucaugucaugccuggguuuuuacccuuucuacggauguuaaaaaaaauucucuauuuucuuccaguccacuuauggcuuuauuuuuuacauuuagauuuuaauccgucuggaauuuauuuuuguguaugcugugagguagggaccauacuuuuauuuuuucccaaauggguuacuaguuggccaaacaucauuuauugaauaauucaucuuuucccuacugacucgaaauaccaucuuuauuguauacuaaauccucauauaguucugggucuguuucugggcucuacuuuguucauuuacugugcugguacugcaccguuguaauugcuguggcuuugugguaugguauggcuugcucucugcuagggcaagucgaagcucuuuuguucaccugcucuuucacccaaauuuucuguccugaauccagcacagccaaauuauggucauugucaccaccaacuacaguggguguugagcauuucccauugaaucuccuguaaggguuuuauuggauucugugauagcaguaaaaugggagccuaagagguauuccuuaaaggacuacuaaucagaccugguuucccagaugaugcugaagaugacggggccugggcuagacuuuugagggacauauccuugggguugggugugauauagaccagcccuuacaauuugcuugacucaugggaaucguacagggccagaaccagacaccugucaugcuaauaacuucccucacaauucagaaaucacugugauugaagauggguggcuguuauaauacuacccacuuaaaaauggauguaacccauuuuuuaggacucuuaaaaacaucaaaucaguaauggccgauuaggacuuuuuaauuuuuacuaaucucuacuugaaaguuuucuagucauucauuucaggaaaccuaauucuuauaauucauaucauuuagaauaucauaaugcuauggauauuagcuagcuaacuucucaaaucuucuaguucucauuuaauuugaaguuuguguguguacauaaggauauacauauacauauguguguguagauauauauauauauaguuuuuuuuuuuuuuaacuagaaugaccagucaacaggggacauaaaaguaauugguggagaugaucucucaacuuuaacuggaaagguauguaucuugaaagggaagaaaaaaaagcacuucauaccgagucaauuaguaacagugugcuuucaaucaaucacuaagagauaauuuacauaguauaacuaaauggguuauuuaacccuuggaagcagucuagguuaauuaucguucccuaggucauguaguaaaaagacaguagaauccaacauuaaccuuaaauguccauauugucaaguacugcugucugccucugugggacucuaauuugggauccuucaaaaaacauugaugggggaaaagauagccuuuaaaaaaaaaaaaaaaacaaaccuaugugagucuaugugagguagacucacauaguuuccuaaaagauagcaaagcaguauuauguaguggcugaaagugugaguuccggagccugacaacugauucaaagcauggcuuaguacuuccuaacucugaccuugggcaaguuacuuaaccucucugugucccauaugugauuagggugagguugauaauagcagccauagaguuaagaggauuaagugcuauaaugcaaguagagcucuuacaacaguuucugguaaaucacucaauaaauucagacauacuauuauuuuaagaaaucucaaagaguuuucuuguaccuuaaaauucuccuagugugaaccauugguuuugguauauugugcuuccauguaguuuaauaucaagauguuuuuagauuucccuuuuaauuuauuuguugacccauugguuguucaggagcaugcuguuuaccugaaaauaauggagauauuaagguauuugaauauuuaucuucuaguacauugaaaaacuuuuugagaguaaccaauaauaaaugauggaaugcuacugcuuuuuuuuuuugaagcugccaguuauuguuuacuuacacuaugccaaauauaaaggcauuaaucucauaaaaguuucacaacaauccugugagggagacgauauccccauuuuacaaaucaggaaauuaagacuuaauaagguuaaaagacuugcccaaagucacagaaccaguaagugguagagcuugaauuugaauacagaccugacucuaaagcucuuuucuuucuuuagauuuuaguguucauugcuuacuugaaugaguaucuauaagaaaacuuuaacauguaaaacuucugugaaauuaucuugucccauaucagggucaugucaaacuaauguccuccucagcaucuuuggaaaacuucagaggagaaaugagcuuugccccuccuguucauuucauauaccacuguuagaccuguccuucccuuucagcaugcuuuguccauauuuagaagcuguugaagccauuacuugucuggucaguuuuuagugcuggaauggaccuagccuuuuaggccuucugagauuuaguuugaucucgucuuucccaccuaauggcucuguucuacuacauagauuugaucugaaacaguucucuguuucuaaaauaacuuucuuuucaugauagucacaguaaaguacauuuauuauggaaaaaucaauaaguauaacgagugaaaguuauuucuuggugguaagauuaugggauuauuugaacuuucuguuucauuguauuuuauuuauuuauuuauuuuugugauggagucucacucugcugcccaggcuggagugcaguaguacgaucuuggcucacugcaaccuccccuucccaguucaagugauucuccugccucagacucccaaguagcugggauuacaggcgcacgccaccaugccuggcuaauuuuuuuaucuuuaguagagacaggguuucaccauguugaccaggcugaucuccaacuccugaucucagguauccaccugccucagccucccaaaguaccgggauuacgggugugagccacccugccuggccucauuuugucuuuuggggguauuuuugugugcagauauauauguauauaaauauuuuucccucuuuuccccaguuaguauuugagcagaugaacuuuggacccgaauaccuguauucaagucucuaauaccacuucuuggcuauuuucauuuuaucaaauggccucuuauccucguuuuucucauuuauuaaguagagauguaacuacuugauauaauucaaaaacucaauaauggcauucuuuuguuuuuuagacucuagugucuguacucguuguaccaugcugggauucauuugaacaauugcauggcuuuuuuaguguauuauuaaauuugcaguuuacuuagaauuuacugggaccucauacaaaugggaaaaaaacauaacuguguuacucauuugcugugugccuuuggauugacccuauuuuuuguauucauuuucuccccauguccugaguuccacuuugaauaaaaaguaauuuuuuuccugccuguaaaauaggcuaccaauaggcugcaguugucuauaguagcugcuucacugaggagagcucagcaugagagaaauaguaugaauugcuugccacaaguuaugggcuagccuuacuucauucuguacuuggaccuguuuaggcuucuaagagaucuuaccuccaacaauaaacugcuuugagacaugaaaagguggaagcuuuacuugguuauaacuuuacuuuuaauaccuagaacagugagucuucaaacuuguauuugcaugcccaauuuauaaaaaguuuccugagcauuuaccccuaauauaugcauuuuaaauuauauaugauuuaugguaauaauaauauauauguuacaaaauacauacaaaaauauagauuaaacaaggugagguaaaaaauuuaaaaguucuaaucuuucuugcaaaccaguggaucuuuugugccuuacucugguaaacacugucuuagaagaauauauagaacauuaaaaucuuaaugcuauaguuauaugacagaguaugaugagagcuacagauaaacaacacaucaugaaucuucuuguggcaguguuuauaaccauuaugugaaaugcugccucauucuuauaacuagcauaagaacagauaggacuuucucgauuuugagggguaauuauuagaugguauuuucuguuaaggacucuuccagcuauaaaauucuuaaauguagaaagcgaagugaggguuuauggugagaggaagcauugguaucauguuuuaguguaguccaagaauauggacacauccagaaaaugcagaucaaguuuagccuaaugagaaaauauauuuuggaguccauaugguaaauuaaauuaugugauuuuugaguuauuguacaaauauaauucuuagaauguuagagucaggagacuauaagagaccaacugcuucaaguuucauuuaacacaugggaaacuaaggccagagaaauuucaagacuugcccaagauuagaccucuuguuaaguaaugaaaguguuuuaaaaacaggugggucaaauucuguuuuuaaaauuuccauuaugaugaaaauuucaguauuacaggcuuccaaaucccagcagaugggccacuuguuuaaaggagaguuugauauaauaaagcaucuaaaaacaagaguuuggauaauuccuuaggguuguuaugaugugauuugacuuauaauuggaaauaccguuuuauucauuguacugauuuucauuucucuuuuucuucuagaaugucuugauuguggaaguaaguucacauuuacuuuuaauauaacauuuaugacuuuucuaacuuaguaugcaccauccuaaagguaagccagggagagaaauuccucugcaucaguuuuaauggugggcuuguguucuaaaggagugagauugguuuuuuguaaagacuacuuaguaauuuguuuuuaccaauaauggaaugguauacuuccuaccucucuuuuuuuaguuugaaguauuuucuuucuaaacauaacucucucucucuauuuaucuauauauaauauauacauauauaucuuauauuuuauguauauauauauauaucuugcuuagauuuugucuuauguaauauuugguacauaaaaaauaauauuuauaauuuauagacuauuuuccauguguuauuaugugcuaaaguauuuuguaucuuagcaccgagaggcuaagcaguuuccuaggguuaccagcuaguaaacuaagggaaaccuuuacuuccuuuagcucagugguucucaaaaugugguucccuagaccaaaaguauuaauaucagacaagaaccuaccgaaucaaaauaucugugaugaggcccagcaagcuaugcuuuaacaaguuuccgagugauucugaugcaugcuaagguuuaggaucccuuguuuuuacucauaagucacuuucucauuaaggccuucccuggccauccuauauaaaaucucauguuuucacaccgucaacuucguauuccuccucaauacuuuuauuuuccugaucacuuaucacuaacagccucucucucucucucucucucucucuauguauauauauauauauaucacuuaucacugucuaacagccucucuuuauauauauauaaucuauagauuauauauauaugcagcauugugcaaucauuaucacgcucaauuuuaaaacauuuucauugccccacaaagaaacccaauccccuuagccaucacuccccauuuccccuucccccagcaccuagcaaacugaucaucuaccuacuugcugucuauaagauuugccuauucuggacauuuuguauaaauagaaucauacaauauguggccuuuuguaucuggcuucucucacuuaauguuuucaagguucauucauguuguggaguauaucugcacucauuuccuuuuuauugccaaauuguauggauagacagguguuccucaacuguguccugauaaacccaucugaaguugaaaauaucauaaguugaaaauggauuuacuacuuugauaaaucuauccuaaagucagaaaaaucucauguugaaccaucguaaguuggauaccaucugaauuacauuuuuguuauccauucacugguugacagacguuagguuguuuccacuguuugcuccuuauuucucguaccugaaauguccuuauucccucccuucuuaucccauguuuaagucauuuaagacccagcucaaacgucaccuccacaaaaccuuccuugauaccccuuuccucuucaauucacuuggaccuuuugcauuuaauuuuaauuuuuauuuuuuuuaagacagagucucacucugucaccaggcuggagugcagugguaugaucucagcucacuaacuacucugccucccagguucaagcaauucucaugucucagccucccaaguagcugggacuacaggugugcgccaccaugccuggcuaauuguguguguguguguguguauguauguauguauauauguguguguguguauauauauauauacacacacauauauaaauauauauacauauauauauauacacacauauauaaauauauauacauauauauauauacacacacacacacauauauauauauauaguuuuuuuuuuuuuuaaguagagaugggguuuugccauguuggccaggcuggucuggccucaagccauccucccaccucggccucgcaaagugcugguauuauaggcaugagccacugugccuggccugcauuucauuuuaauuauaaaauauuuugaacucagaaaaaaggguaugcugaauaccuacguacccacaaaaguauuaacauuuugccauauuugcuucugaucuuauuuuuuuugagaaauuaaagaucauaauacaacuaaagccccauuucuuucccuucauucccagaaguaugacaauuauccuuaaaguugauauauaucauucccaugcauguuuuuuauacuucccuaguacaaguuagcuguauccucugcucaggggcucaucaagcugaaucaagggacucaugauccucuucaaaguuccuucagguuguuggcagaauuuaguuccuugugauuguaggacugagggcccguuuucucacuggcugcuggccagggguugcucccagauauuuaaaggcucaugcccuagcccaugacagucucacaacauggcagcugacuucuucaaaaccagcaggagaaucuugcucuagucuaccacauaaccuaaucacaggagcggcuaucccguuauuuucacagauccuggucacauucaaggggagggaacccuucuguguguguacaccaggaggcaggaauuuuuuuuuucuuuuucuuuuuuguuaaaaagucuuaaagucuuuuaucccuaaaggaggcaggaauuuugagagccaucagaauucugccuaccacagcccagaaaucugcauuuuucacaagucuccagccaugauguuucugauggcucacacugcuuuauuccauuuuuaaagaguauuuuuauugaaaagcauuaggguuaugguuuaaaaaauauuuucccuaacaaagauggguuuguuuagaguccuacuuuugacuaaauagcugagauucacuuuuauguaaagucauuuuauagcguuauuaauuugggugccuuuaaaaauaguauaaagcauguuucucgaguguagucuguuagccaccuauauuggagaguugggaggagagagucucuaucuugaauuuaugggaaaaauucuaaaauacuuuuuauaaugaaggacaacaucauaacucccuaauaaaaugugcauguauauauucaaauuugcugucauugauccugcaccuacaaaauccaguccugggggcuggcauucuuacugcuugcugagggccagaugauauagauuccagaauaucuccauguagauuuuggugagaauuacugugcugaaaagaaugacaguauugcaguuauacauggggguuuugguacuuuauauugugacucugaauuuaaagcuaugcaaugucuucuuuuuugaaaggauauaauugacacuggcaaaacaaugcagacuuugcuuuccuuggucaggcaguauaauccaaagauggucaaggucgcaagguauguaugacauuuugacacagaauauuuuccucauuugaagggggauuaagugauugcuucuuuuuaaggauaaauguuuucaacugucauuuuaucuucgaaaaguaauguaaucucauauaagacuuaagauauaauccuuuuaaauaauuuugucauguguuaauaaagcucauaauuacagucacuuccuugccuaauauuaacauuugguuuuucagcaugcuaauuauaucaguuuguccugaauagcauggcagaggauuuugggcccccuugcaaaauuaagaauaaggauuccaaagcgggugaggaagugauaggaaggggugggcccugaagaucuggaccuccuggaauugagugaugaaugcugcaucuucuuugugucuguagugaaauuuuauaaugccugcuuccuuuuuuauuaagucggccucaccuccucaccuuaccuaugcuguuuuacuuuugcuuuuauaguucuaccuguguuuauuucucauuuucguuucaucucucaacaacucugggguggcauuauuauucccacuuuucagauaagguuacugaggcauagggaauuguccaaagguacagagcuaguccgcuauagagaugagauuugaacccagggaaccuggcucacaguuuaugcuuuugcuaccuuaaguuuuuaauagagugacaucaaacaaacauuuaagaauauguuuuucuuuuccuuuuauaauuucauuaaaaacauuaagucucugaucagucugcaguuuuuauguaggggucagguaauguucuaacuucugcuuuuuccuaagugauuaacagguuuuuauaagcccuuuugaaaaaaucacgguaucugucgagcaucuuugaaucagaguaagccuucuagugagucauaugucagcaguuugacuguaugggcuuuucuaauauccaguucaaguguuuaucagugaguuuuucuuuuaaauagauuugggacagguacuaugagaguauauaagugauacguuauaggacacuaacuaguauccuaugaaauggcaaaaacugcaaucacuuuugcaccaaccaaauagaaacuaaucagugcacuugcuuauuuuucuacaugcucuuuaggguuuuaaaugucaaccuacuguggcauagacuuuaauccucuggguauucuuuuguuguucuuuccugguauaugcuguggaauugagauagacugguucgugagcgagagauuuuguguugccacagguaggacaugcucaaacaauacuugggucauuucuugacccaagucaucuauucaccauaguuuuguagcaccgaucuugcauacauuucauguaucuucuuugaaccccacgucagugcugcuuauaugauacucagaaauuaaacacuaaggaauaagauuuucagguaggauugaguuuuggagggucacaaaucuuguaaugucuaauauuuccacucucccugcugagaauuaguuuuggcuuccuuggaggugauaucgccucuguugaguauaaguggccuacugugaucacaccacugcacuccagccugggugacagagugagacccugucucagaaaaaaaaaaaaaaaaaaagaaugcauggccuagaugacuucuaagguuuuucccacccaguuccaguuuucauguucuaggcagagcaguaaagugagaaacacauggacuugggaguuuagucucgcauuucacugccacuuaaucugagcgacuauuccauauuuaaucucucugaauguauuuacucaucuuuaaaggggaaugauuauuaacaucuuuuucucagggaaacuauaugagucaaggagauaauauauuugaaaaucuuuuuaacugcaaagcgcuguuucacuguugguuauaaugugauugaucucauuguagugagcagcugcuuaauugcguuuuagaauguagggaagauaguaauauuuuucacauuauauauguagcugguucuggaacuguaaacauacuccuuuuuuauggagaucugagucacguaccauaaaauucacucuuuuaaaguuguacaauccagugguuuuugauauauucagaguugugcaucugcuaccacuauuucauuuuggaacccaaagaaaccuuguacccauuagcagucauucucccuucucccagccccuggcaacuacuaaucuacuuucuacagaaaguccguacagauuuguguauuauggacauuccauauaaauggacucaugcaauauccugucuucuuucacuuagcauaguguuuucaagguucaucuagguuggggcauguaucaguacuucaucccuuguuuuggcugaauaauauuucauuguacaaauauaucacauuuugcuuauccaucuguuggugaacauuugaguuucuaccuguuggcuuuuaugaauaauguugauuugaauguuuguguacaaguaugaauaccuguuuucaggucucuugaguauauaguugcuaggucauauaguaacucuguguuuaacauuuugaggaauugcccgacuauuuaacaagguauauguacuguuuuacaccaguaacauaugaggguuccaauaucuccacauccuugacaacacuuguuacuguccuuuuuauuguagccauccuaguggcuaugaugugguaucucauugugguuuugauuuguguuucucugaugcugaugauguugaacauguuuucaucugcuuauuggccauuuacauauaucuucuuaagaacgguuacccauuuacaguauggaaaaugcuucagaugcaacucuagucaugccuuagagauggagcuuuauuaaacauucagaucucuaggcauaugaagugcugaguucucuugaacuccuaauacagauugcacugaguuuagugauaccuuuucuggagcauuccugaguucagguagggagaaggguuuuugcugugauuggcuuguuauguucuuucuaaauggaaauagaauugaagugucuccucucuccauuuauuggaagagucaugagggacauaauuagaugaucccuuggagucuccggcuuaggucagugguuaucuacuuaggcugcacauuggaaucaccugagaguuaaaaaaccaggauaaccucugccugugucucaucuccagcaauucugauguaauuggucagggcuguggcccgaguaggugaguucugguuuuuuaaagcucccaggugauucugaugugcaauccagguugagaucacuuugggcccuuuccagcucuuuaaacauauauauuuaucuaggaagguaugaaagcauaaguuuucuugagacugccuuuaacaucuguaaaggcuuucaaagcagcuucuguaguuuuuuuuaaauggcugaauauuuuucaacaggcagcauuuggguuauaaaauuagcuuuugguagaguugacuuauaccaccuccagcuuuuguuccaaaaauaaauacugguucuuuuggcacacuaguuguuuuacccuaaaguuccucuuuguaagccaguuauuaaaaguugugaugcagccagggcgaagugguacacaucuguagucccagcuacucggaaggcugaggggggaggaucgcuagagcccaagaagucaaggcugcagugaacugugauuacaccacugcacugcagccugggccacagagcgagacucaucucuuuaaaaaaaagaauguugugaggccgggcgcaguggcucacgccugugaucccagcacuuugggaggccgagguggacggaucaccugagguugggaguucgagaccagccugaccaacauggagaaacccugucucuacuaaaaaaaauacaaaauuagccgggcgugguggcacaugccuguagucccagcuacucggcaggcugaggcaggagaaucgcuugaaccugggaggcagagguuguggugaguugggcgagccauugcacuccagccugggcaacaagagcaaaacuccaucucaaaaaaaagaaaagaaaagaaaagaauguuguggccaggcgcgguggcuuacgccuguaauuucagcacuuugggagaccgaggugggcggaucacgaggucaggagaucaagaccauccuggcuaacacaguaaaaccccaucucuacuaaauacaaaaaaaaauuagccgggagugcuggcgggugccuguagucccagcuacucaggaggcugaggcgggagaauggcgugaacccaggaggcagagcuugcagugagcggagaucgcgccacugcacuccagccugggcaacagagcgagauuccgucuaaaaaaaaaaaaaaagaauguugugauaaaaggugaugcucaccucucccacacccuuuuauaguuuagggauuguauuuccaagguuucuagacugagagcccuuuucaucuuugcucauugacacucuguacccauuaauccuccuuauuagcuccccuucaauggacacauggguagucagggugcaggucucagaacuguccuucagguuccaggugaucaaccaagugccuugucuguagugucaacucauugcugccccuuccuaguaauccccauaauuuagcucuccauuucauagucuuuccuuggguguguuaaaagugaccaugguacacucagcacggaugaaaugaaacaguguuuagaaacgucagucuucucuuuuguaaugcccuguagucucucuguauguuauaugucacauuuuguaauuaacagcuugcuggugaaaaggaccccacgaaguguuggauauaagccagacuguaagugaauuacuuuuuuugucaaucauuuaaccaucuuuaaccuaaaagaguuuuaugugaaauggcuuauaauugcuuagagaauauuuguagagaggcacauuugccaguauuagauuuaaaagugauguuuucuuuaucuaaaugaugaauuaugauucuuuuuaguuguuggauuugaaauuccagacaaguuuguuguaggauaugcccuugacuauaaugaauacuucagggauuugaauguaaguaauugcuucuuuuucucacucauuuuucaaaacacgcauaaaaauuuaggaaagagaauuguuuucuccuuccagcaccucauaauuugaacagacugaugguucccauuagucacauaaagcuguagucuaguacagacguccuuagaacuggaaccuggccaggcuagggugacacuucuuguuggcugaaauaguugaacagcuuuaauauacaauaauuguugcauuauuauuucagaugauaaauguggucauaaguaagaaauaaaugaucgaguuuagucuuuuaauucacuguccuuugaauaccugccucuuacucuggaggcagaagucccauggauguguuuaugaacaugguugaggaagauuuaggaagacugcaacaguacacuaccuaaagcagguuuuuuacuccaucuuuuuuugccacguacacuggccucccacuuugauaugcuugaaauuaucuccuugauuugucuuucaaaacuacauauugaggcugguugcgguggcucacaccuguaauccuagcacuuugggaggccaagccggacagaucacuugaggucaggaguucgagaccagccuggcaaacaugaugaaaccccaccuuuacuaaaaauacaaaaauuagccaggcguaguggugugugccuguaacccagcuaccugggaggcugaggcaggagaaucacuggaacccgggaggcagaggcuacagugagccaacaucacgccacugcacuccagccugggugacagagcaagacucugucucaaaacaaaacaaaaaacaaaaaacuacguauuaagacaagaaacagacugggcgcgguggcucacgccuguaaucccagcacuuugggaggcugaggcgggcggaucacaaggucaggagaucgagaccauccuggcuaacacggugaaaccccgucucuacuaaaaaauagaaaaaauuagcuggggugguggcgggcgccuauagucucagcuacucgggaggcugaggcaggagaauggcgugaacccgggaggcagagcuugcagugagcagagaucgugccacugcacuccagucugggugacagagcaagacuccgucucaaaaaaaaaaacaaaaacaagaaacaaauuaaacuaaugugauagacuacugcuuuguuuucaaaagauacacuccccaaaaguuacugaucuaaaauacaguaguacuaucucuguuuaguaagaacccugacaacuaauaguguucuuauauguaaaaugcuauucuugccuuucauuucagaauauacuuuuuaaaugugaauuucuggauuuuuuuuuauagcauguuugugucauuagugaaacuggaaaagcaaaauacaaagccuaagaugagaguucaaguugaguuuggaaacaucuggaguccuauugacaucgccaguaaaauuaucaauguucuaguucuguggccaucugcuuaguagagcuuuuugcauguaucuucuaagaauuuuaucuguuuuguacuuuagaaaugucaguugcugcauuccuaaacuguuuauuugcacuaugagccuauagacuaucaguucccuuugggcggauuguuguuuaacuuguaaaugaaaaaauucucuuaaaccacagcacuauugagugaaacauugaacucauaucuguaagaaauaaagagaagauauauuaguuuuuuaauugguauuuuaauuuuuauauaugcaggaaagaauagaagugauugaauauuguuaauuauaccaccguguguuagaaaaguaagaagcagucaauuuucacaucaaagacagcaucuaagaaguuuuguucuguccuggaauuauuuuaguaguguuucaguaauguugacuguauuuuccaacuuguucaaauuauuaccagugaaucuuugucagcaguucccuuuuaaaugcaaaucaauaaauucccaaaaauuuaa

SEQ ID NO: 192824 - RNA, 40524 nt, Homo sapiens
uuaaauuuuugggaauuuauugauuugcauuuaaaagggaacugcugacaaagauucacugguaauaauuugaacaaguuggaaaauacagucaacauuacugaaacacuacuaaaauaauuccaggacagaacaaaacuucuuagaugcugucuuugaugugaaaauugacugcuucuuacuuuucuaacacacggugguauaauuaacaauauucaaucacuucuauucuuuccugcauauauaaaaauuaaaauaccaauuaaaaaacuaauauaucuucucuuuauuucuuacagauaugaguucaauguuucacucaauagugcugugguuuaagagaauuuuuucauuuacaaguuaaacaacaauccgcccaaagggaacugauagucuauaggcucauagugcaaauaaacaguuuaggaaugcagcaacugacauuucuaaaguacaaaacagauaaaauucuuagaagauacaugcaaaaagcucuacuaagcagauggccacagaacuagaacauugauaauuuuacuggcgaugucaauaggacuccagauguuuccaaacucaacuugaacucucaucuuaggcuuuguauuuugcuuuuccaguuucacuaaugacacaaacaugcuauaaaaaaaaauccagaaauucacauuuaaaaaguauauucugaaaugaaaggcaagaauagcauuuuacauauaagaacacuauuaguugucaggguucuuacuaaacagagauaguacuacuguauuuuagaucaguaacuuuuggggaguguaucuuuugaaaacaaagcaguagucuaucacauuaguuuaauuuguuucuuguuuuuguuuuuuuuuuugagacggagucuugcucugucacccagacuggagugcaguggcacgaucucugcucacugcaagcucugccucccggguucacgccauucuccugccucagccucccgaguagcugagacuauaggcgcccgccaccaccccagcuaauuuuuucuauuuuuuaguagagacgggguuucaccguguuagccaggauggucucgaucuccugaccuugugauccgcccgccucagccucccaaagugcugggauuacaggcgugagccaccgcgcccagucuguuucuugucuuaauacguaguuuuuuguuuuuuguuuuguuuugagacagagucuugcucugucacccaggcuggagugcaguggcgugauguuggcucacuguagccucugccucccggguuccagugauucuccugccucagccucccagguagcuggguuacaggcacacaccacuacgccuggcuaauuuuuguauuuuuaguaaaggugggguuucaucauguuugccaggcuggucucgaacuccugaccucaagugaucuguccggcuuggccucccaaagugcuaggauuacaggugugagccaccgcaaccagccucaauauguaguuuugaaagacaaaucaaggagauaauuucaagcauaucaaagugggaggccaguguacguggcaaaaaaagauggaguaaaaaaccugcuuuagguaguguacuguugcagucuuccuaaaucuuccucaaccauguucauaaacacauccaugggacuucugccuccagaguaagaggcagguauucaaaggacagugaauuaaaagacuaaacucgaucauuuauuucuuacuuaugaccacauuuaucaucugaaauaauaaugcaacaauuauuguauauuaaagcuguucaacuauuucagccaacaagaagugucacccuagccuggccagguuccaguucuaaggacgucuguacuagacuacagcuuuaugugacuaaugggaaccaucagucuguucaaauuaugaggugcuggaaggagaaaacaauucucuuuccuaaauuuuuaugcguguuuugaaaaaugagugagaaaaagaagcaauuacuuacauucaaaucccugaaguauucauuauagucaagggcauauccuacaacaaacuugucuggaauuucaaauccaacaacuaaaaagaaucauaauucaucauuuagauaaagaaaacaucacuuuuaaaucuaauacuggcaaaugugccucucuacaaauauucucuaagcaauuauaagccauuucacauaaaacucuuuuagguuaaagaugguuaaaugauugacaaaaaaaguaauucacuuacagucuggcuuauauccaacacuucgugggguccuuuucaccagcaagcuguuaauuacaaaaugugacauauaacauacagagagacuacagggcauuacaaaagagaagacugacguuucuaaacacuguuucauuucauccgugcugaguguaccauggucacuuuuaacacacccaaggaaagacuaugaaauggagagcuaaauuauggggauuacuaggaaggggcagcaaugaguugacacuacagacaaggcacuugguugaucaccuggaaccugaaggacaguucugagaccugcacccugacuacccauguguccauugaaggggagcuaauaaggaggauuaauggguacagagugucaaugagcaaagaugaaaagggcucucagucuagaaaccuuggaaauacaaucccuaaacuauaaaagggugugggagaggugagcaucaccuuuuaucacaacauucuuuuuuuuuuuuuuuagacggaaucucgcucuguugcccaggcuggagugcaguggcgcgaucuccgcucacugcaagcucugccuccuggguucacgccauucucccgccucagccuccugaguagcugggacuacaggcacccgccagcacucccggcuaauuuuuuuuuguauuuaguagagaugggguuuuacuguguuagccaggauggucuugaucuccugaccucgugauccgcccaccucggucucccaaagugcugaaauuacaggcguaagccaccgcgccuggccacaacauucuuuucuuuucuuuucuuuuuuuugagauggaguuuugcucuuguugcccaggcuggagugcaauggcucgcccaacucaccacaaccucugccucccagguucaagcgauucuccugccucagccugccgaguagcugggacuacaggcaugugccaccacgcccggcuaauuuuguauuuuuuuuaguagagacaggguuucuccauguuggucaggcuggucucgaacucccaaccucaggugauccguccaccucggccucccaaagugcugggaucacaggcgugagccacugcgcccggccucacaacauucuuuuuuuuaaagagaugagucucgcucuguggcccaggcugcagugcagugguguaaucacaguucacugcagccuugacuucuugggcucuagcgauccuccccccucagccuuccgaguagcugggacuacagauguguaccacuucgcccuggcugcaucacaacuuuuaauaacuggcuuacaaagaggaacuuuaggguaaaacaacuagugugccaaaagaaccaguauuuauuuuuggaacaaaagcuggaggugguauaagucaacucuaccaaaagcuaauuuuauaacccaaaugcugccuguugaaaaauauucagccauuuaaaaaaaacuacagaagcugcuuugaaagccuuuacagauguuaaaggcagucucaagaaaacuuaugcuuucauaccuuccuagauaaauauauauguuuaaagagcuggaaagggcccaaagugaucucaaccuggauugcacaucagaaucaccugggagcuuuaaaaaaccagaacucaccuacucgggccacagcccugaccaauuacaucagaauugcuggagaugagacacaggcagagguuauccugguuuuuuaacucucaggugauuccaaugugcagccuaaguagauaaccacugaccuaagccggagacuccaagggaucaucuaauuaugucccucaugacucuuccaauaaauggagagaggagacacuucaauucuauuuccauuuagaaagaacauaacaagccaaucacagcaaaaacccuucucccuaccugaacucaggaaugcuccagaaaagguaucacuaaacucagugcaaucuguauuaggaguucaagagaacucagcacuucauaugccuagagaucugaauguuuaauaaagcuccaucucuaaggcaugacuagaguugcaucugaagcauuuuccauacuguaaauggguaaccguucuuaagaagauauauguaaauggccaauaagcagaugaaaacauguucaacaucaucagcaucagagaaacacaaaucaaaaccacaaugagauaccacaucauagccacuaggauggcuacaauaaaaaggacaguaacaaguguugucaaggauguggagauauuggaacccucauauguuacugguguaaaacaguacauauaccuuguuaaauagucgggcaauuccucaaaauguuaaacacagaguuacuauaugaccuagcaacuauauacucaagagaccugaaaacagguauucauacuuguacacaaacauucaaaucaacauuauucauaaaagccaacagguagaaacucaaauguucaccaacagauggauaagcaaaaugugauauauuuguacaaugaaauauuauucagccaaaacaagggaugaaguacugauacaugccccaaccuagaugaaccuugaaaacacuaugcuaagugaaagaagacaggauauugcaugaguccauuuauauggaauguccauaauacacaaaucuguacggacuuucuguagaaaguagauuaguaguugccaggggcugggagaagggagaaugacugcuaauggguacaagguuucuuuggguuccaaaaugaaauagugguagcagaugcacaacucugaauauaucaaaaaccacuggauuguacaacuuuaaaagagugaauuuuaugguacgugacucagaucuccauaaaaaaggaguauguuuacaguuccagaaccagcuacauauauaaugugaaaaauauuacuaucuucccuacauucuaaaacgcaauuaagcagcugcucacuacaaugagaucaaucacauuauaaccaacagugaaacagcgcuuugcaguuaaaaagauuuucaaauauauuaucuccuugacucauauaguuucccugagaaaaagauguuaauaaucauuccccuuuaaagaugaguaaauacauucagagagauuaaauauggaauagucgcucagauuaaguggcagugaaaugcgagacuaaacucccaaguccauguguuucucacuuuacugcucugccuagaacaugaaaacuggaacugggugggaaaaaccuuagaagucaucuaggccaugcauucuuuuuuuuuuuuuuuuuuucugagacagggucucacucugucacccaggcuggagugcaguggugugaucacaguaggccacuuauacucaacagaggcgauaucaccuccaaggaagccaaaacuaauucucagcagggagaguggaaauauuagacauuacaagauuugugacccuccaaaacucaauccuaccugaaaaucuuauuccuuaguguuuaauuucugaguaucauauaagcagcacugacgugggguucaaagaagauacaugaaauguaugcaagaucggugcuacaaaacuauggugaauagaugacuugggucaagaaaugacccaaguauuguuugagcauguccuaccuguggcaacacaaaaucucucgcucacgaaccagucuaucucaauuccacagcauauaccaggaaagaacaacaaaagaauacccagaggauuaaagucuaugccacaguagguugacauuuaaaacccuaaagagcauguagaaaaauaagcaagugcacugauuaguuucuauuugguuggugcaaaagugauugcaguuuuugccauuucauaggauacuaguuaguguccuauaacguaucacuuauauacucucauaguaccugucccaaaucuauuuaaaagaaaaacucacugauaaacacuugaacuggauauuagaaaagcccauacagucaaacugcugacauaugacucacuagaaggcuuacucugauucaaagaugcucgacagauaccgugauuuuuucaaaagggcuuauaaaaaccuguuaaucacuuaggaaaaagcagaaguuagaacauuaccugaccccuacauaaaaacugcagacugaucagagacuuaauguuuuuaaugaaauuauaaaaggaaaagaaaaacauauucuuaaauguuuguuugaugucacucuauuaaaaacuuaagguagcaaaagcauaaacugugagccagguucccuggguucaaaucucaucucuauagcggacuagcucuguaccuuuggacaauucccuaugccucaguaaccuuaucugaaaagugggaauaauaaugccaccccagaguuguugagagaugaaacgaaaaugagaaauaaacacagguagaacuauaaaagcaaaaguaaaacagcauagguaaggugaggaggugaggccgacuuaauaaaaaaggaagcaggcauuauaaaauuucacuacagacacaaagaagaugcagcauucaucacucaauuccaggagguccagaucuucagggcccaccccuuccuaucacuuccucacccgcuuuggaauccuuauucuuaauuuugcaagggggcccaaaauccucugccaugcuauucaggacaaacugauauaauuagcaugcugaaaaaccaaauguuaauauuaggcaaggaagugacuguaauuaugagcuuuauuaacacaugacaaaauuauuuaaaaggauuauaucuuaagucuuauaugagauuacauuacuuuucgaagauaaaaugacaguugaaaacauuuauccuuaaaaagaagcaaucacuuaaucccccuucaaaugaggaaaauauucugugucaaaaugucauacauaccuugcgaccuugaccaucuuuggauuauacugccugaccaaggaaagcaaagucugcauuguuuugccagugucaauuauauccuuucaaaaaagaagacauugcauagcuuuaaauucagagucacaauauaaaguaccaaaacccccauguauaacugcaauacugucauucuuuucagcacaguaauucucaccaaaaucuacauggagauauucuggaaucuauaucaucuggcccucagcaagcaguaagaaugccagcccccaggacuggauuuuguaggugcaggaucaaugacagcaaauuugaauauauacaugcacauuuuauuagggaguuaugauguuguccuucauuauaaaaaguauuuuagaauuuuucccauaaauucaagauagagacucucuccucccaacucuccaauauagguggcuaacagacuacacucgagaaacaugcuuuauacuauuuuuaaaggcacccaaauuaauaacgcuauaaaaugacuuuacauaaaagugaaucucagcuauuuagucaaaaguaggacucuaaacaaacccaucuuuguuagggaaaauauuuuuuaaaccauaacccuaaugcuuuucaauaaaaauacucuuuaaaaauggaauaaagcagugugagccaucagaaacaucauggcuggagacuugugaaaaaugcagauuucugggcugugguaggcagaauucugauggcucucaaaauuccugccuccuuuagggauaaaagacuuuaagacuuuuuaacaaaaaagaaaaagaaaaaaaaaauuccugccuccugguguacacacacagaaggguucccuccccuugaaugugaccaggaucugugaaaauaacgggauagccgcuccugugauuagguuaugugguagacuagagcaagauucuccugcugguuuugaagaagucagcugccauguugugagacugucaugggcuagggcaugagccuuuaaauaucugggagcaaccccuggccagcagccagugagaaaacgggcccucaguccuacaaucacaaggaacuaaauucugccaacaaccugaaggaacuuugaagaggaucaugagucccuugauucagcuugaugagccccugagcagaggauacagcuaacuuguacuagggaaguauaaaaaacaugcaugggaaugauauauaucaacuuuaaggauaauugucauacuucugggaaugaagggaaagaaauggggcuuuaguuguauuaugaucuuuaauuucucaaaaaaaauaagaucagaagcaaauauggcaaaauguuaauacuuuuguggguacguagguauucagcauacccuuuuuucugaguucaaaauauuuuauaauuaaaaugaaaugcaggccaggcacaguggcucaugccuauaauaccagcacuuugcgaggccgaggugggaggauggcuugaggccagaccagccuggccaacauggcaaaaccccaucucuacuuaaaaaaaaaaaaaacuauauauauauauauguguguguguguguauauauauauauguauauauauuuauauauguguguauauauauauauguauauauauuuauauauguguguguauauauauauauacacacacacacauauauacauacauacauacacacacacacacacacaauuagccaggcaugguggcgcacaccuguagucccagcuacuugggaggcugagacaugagaauugcuugaaccugggaggcagaguaguuagugagcugagaucauaccacugcacuccagccuggugacagagugagacucugucuuaaaaaaaauaaaaauuaaaauuaaaugcaaaagguccaagugaauugaagaggaaagggguaucaaggaagguuuuguggaggugacguuugagcugggucuuaaaugacuuaaacaugggauaagaagggagggaauaaggacauuucagguacgagaaauaaggagcaaacaguggaaacaaccuaacgucugucaaccagugaauggauaacaaaaauguaauucagaugguauccaacuuacgaugguucaacaugagauuuuucugacuuuaggauagauuuaucaaaguaguaaauccauuuucaacuuaugauauuuucaacuucagauggguuuaucaggacacaguugaggaacaccugucuauccauacaauuuggcaauaaaaaggaaaugagugcagauauacuccacaacaugaaugaaccuugaaaacauuaagugagagaagccagauacaaaaggccacauauuguaugauucuauuuauacaaaauguccagaauaggcaaaucuuauagacagcaaguagguagaugaucaguuugcuaggugcugggggaaggggaaauggggagugauggcuaaggggauuggguuucuuuguggggcaaugaaaauguuuuaaaauugagcgugauaaugauugcacaaugcugcauauauauauaaucuauagauuauauauauauaaagagaggcuguuagacagugauaagugauauauauauauauauacauagagagagagagagagagagagagaggcuguuagugauaagugaucaggaaaauaaaaguauugaggaggaauacgaaguugacggugugaaaacaugagauuuuauauaggauggccagggaaggccuuaaugagaaagugacuuaugaguaaaaacaagggauccuaaaccuuagcaugcaucagaaucacucggaaacuuguuaaagcauagcuugcugggccucaucacagauauuuugauucgguagguucuugucugauauuaauacuuuuggucuagggaaccacauuuugagaaccacugagcuaaaggaaguaaagguuucccuuaguuuacuagcugguaacccuaggaaacugcuuagccucucggugcuaagauacaaaauacuuuagcacauaauaacacauggaaaauagucuauaaauuauaaauauuauuuuuuauguaccaaauauuacauaagacaaaaucuaagcaagauauauauauauauacauaaaauauaagauauauauguauauauuauauauagauaaauagagagagagaguuauguuuagaaagaaaauacuucaaacuaaaaaaagagagguaggaaguauaccauuccauuauugguaaaaacaaauuacuaaguagucuuuacaaaaaaccaaucucacuccuuuagaacacaagcccaccauuaaaacugaugcagaggaauuucucucccuggcuuaccuuuaggauggugcauacuaaguuagaaaagucauaaauguuauauuaaaaguaaaugugaacuuacuuccacaaucaagacauucuagaagaaaaagagaaaugaaaaucaguacaaugaauaaaacgguauuuccaauuauaagucaaaucacaucauaacaacccuaaggaauuauccaaacucuuguuuuuagaugcuuuauuauaucaaacucuccuuuaaacaaguggcccaucugcugggauuuggaagccuguaauacugaaauuuucaucauaauggaaauuuuaaaaacagaauuugacccaccuguuuuuaaaacacuuucauuacuuaacaagaggucuaaucuugggcaagucuugaaauuucucuggccuuaguuucccauguguuaaaugaaacuugaagcaguuggucucuuauagucuccugacucuaacauucuaagaauuauauuuguacaauaacucaaaaaucacauaauuuaauuuaccauauggacuccaaaauauauuuucucauuaggcuaaacuugaucugcauuuucuggauguguccauauucuuggacuacacuaaaacaugauaccaaugcuuccucucaccauaaacccucacuucgcuuucuacauuuaagaauuuuauagcuggaagaguccuuaacagaaaauaccaucuaauaauuaccccucaaaaucgagaaaguccuaucuguucuuaugcuaguuauaagaaugaggcagcauuucacauaaugguuauaaacacugccacaagaagauucaugauguguuguuuaucuguagcucucaucauacucugucauauaacuauagcauuaagauuuuaauguucuauauauucuucuaagacaguguuuaccagaguaaggcacaaaagauccacugguuugcaagaaagauuagaacuuuuaaauuuuuuaccucaccuuguuuaaucuauauuuuuguauguauuuuguaacauauauauuauuauuaccauaaaucauauauaauuuaaaaugcauauauuagggguaaaugcucaggaaacuuuuuauaaauugggcaugcaaauacaaguuugaagacucacuguucuagguauuaaaaguaaaguuauaaccaaguaaagcuuccaccuuuucaugucucaaagcaguuuauuguuggagguaagaucucuuagaagccuaaacagguccaaguacagaaugaaguaaggcuagcccauaacuuguggcaagcaauucauacuauuucucucaugcugagcucuccucagugaagcagcuacuauagacaacugcagccuauugguagccuauuuuacaggcaggaaaaaaauuacuuuuuauucaaaguggaacucaggacauggggagaaaaugaauacaaaaaauagggucaauccaaaggcacacagcaaaugaguaacacaguuauguuuuuuucccauuuguaugaggucccaguaaauucuaaguaaacugcaaauuuaauaauacacuaaaaaagccaugcaauuguucaaaugaaucccagcaugguacaacgaguacagacacuagagucuaaaaaacaaaagaaugccauuauugaguuuuugaauuauaucaaguaguuacaucucuacuuaauaaaugagaaaaacgaggauaagaggccauuugauaaaaugaaaauagccaagaagugguauuagagacuugaauacagguauucggguccaaaguucaucugcucaaauacuaacuggggaaaagagggaaaaauauuuauauacauauauaucugcacacaaaaauacccccaaaagacaaaaugaggccaggcaggguggcucacacccguaaucccgguacuuugggaggcugaggcagguggauaccugagaucaggaguuggagaucagccuggucaacauggugaaacccugucucuacuaaagauaaaaaaauuagccaggcaugguggcgugcgccuguaaucccagcuacuugggagucugaggcaggagaaucacuugaacugggaaggggagguugcagugagccaagaucguacuacugcacuccagccugggcagcagagugagacuccaucacaaaaauaaauaaauaaauaaaauacaaugaaacagaaaguucaaauaaucccauaaucuuaccaccaagaaauaacuuucacucguuauacuuauugauuuuuccauaauaaauguacuuuacugugacuaucaugaaaagaaaguuauuuuagaaacagagaacuguuucagaucaaaucuauguaguagaacagagccauuaggugggaaagacgagaucaaacuaaaucucagaaggccuaaaaggcuagguccauuccagcacuaaaaacugaccagacaaguaauggcuucaacagcuucuaaauauggacaaagcaugcugaaagggaaggacaggucuaacagugguauaugaaaugaacaggaggggcaaagcucauuucuccucugaaguuuuccaaagaugcugaggaggacauuaguuugacaugacccugauaugggacaagauaauuucacagaaguuuuacauguuaaaguuuucuuauagauacucauucaaguaagcaaugaacacuaaaaucuaaagaaagaaaagagcuuuagagucaggucuguauucaaauucaagcucuaccacuuacugguucugugacuuugggcaagucuuuuaaccuuauuaagucuuaauuuccugauuuguaaaauggggauaucgucucccucacaggauuguugugaaacuuuuaugagauuaaugccuuuauauuuggcauaguguaaguaaacaauaacuggcagcuucaaaaaaaaaaagcaguagcauuccaucauuuauuauugguuacucucaaaaaguuuuucaauguacuagaagauaaauauucaaauaccuuaauaucuccauuauuuucagguaaacagcaugcuccugaacaaccaaugggucaacaaauaaauuaaaagggaaaucuaaaaacaucuugauauuaaacuacauggaagcacaauauaccaaaaccaaugguucacacuaggagaauuuuaagguacaagaaaacucuuugagauuucuuaaaauaauaguaugucugaauuuauugagugauuuaccagaaacuguuguaagagcucuacuugcauuauagcacuuaauccucuuaacucuauggcugcuauuaucaaccucacccuaaucacauaugggacacagagagguuaaguaacuugcccaaggucagaguuaggaaguacuaagccaugcuuugaaucaguugucaggcuccggaacucacacuuucagccacuacauaauacugcuuugcuaucuuuuaggaaacuaugugagucuaccucacauagacucacauagguuuguuuuuuuuuuuuuuuuaaaggcuaucuuuucccccaucaauguuuuuugaaggaucccaaauuagagucccacagaggcagacagcaguacuugacaauauggacauuuaagguuaauguuggauucuacugucuuuuuacuacaugaccuagggaacgauaauuaaccuagacugcuuccaaggguuaaauaacccauuuaguuauacuauguaaauuaucucuuagugauugauugaaagcacacuguuacuaauugacucgguaugaagugcuuuuuuuucuucccuuucaagauacauaccuuuccaguuaaaguugagagaucaucuccaccaauuacuuuuauguccccuguugacuggucauucuaguuaaaaaaaaaaaaaacuauauauauauauaucuacacacacauauguauauguauauccuuauguacacacacaaacuucaaauuaaaugagaacuagaagauuugagaaguuagcuagcuaauauccauagcauuaugauauucuaaaugauaugaauuauaagaauuagguuuccugaaaugaaugacuagaaaacuuucaaguagagauuaguaaaaauuaaaaaguccuaaucggccauuacugauuugauguuuuuaagaguccuaaaaaauggguuacauccauuuuuaaguggguaguauuauaacagccacccaucuucaaucacagugauuucugaauugugagggaaguuauuagcaugacaggugucugguucuggcccuguacgauucccaugagucaagcaaauuguaagggcuggucuauaucacacccaaccccaaggauaugucccucaaaagucuagcccaggccccgucaucuucagcaucaucugggaaaccaggucugauuaguaguccuuuaaggaauaccucuuaggcucccauuuuacugcuaucacagaauccaauaaaacccuuacaggagauucaaugggaaaugcucaacacccacuguaguugguggugacaaugaccauaauuuggcugugcuggauucaggacagaaaauuugggugaaagagcaggugaacaaaagagcuucgacuugcccuagcagagagcaagccauaccauaccacaaagccacagcaauuacaacggugcaguaccagcacaguaaaugaacaaaguagagcccagaaacagacccagaacuauaugaggauuuaguauacaauaaagaugguauuucgagucaguagggaaaagaugaauuauucaauaaaugauguuuggccaacuaguaacccauuugggaaaaaauaaaaguauggucccuaccucacagcauacacaaaaauaaauuccagacggauuaaaaucuaaauguaaaaaauaaagccauaaguggacuggaagaaaauagagaauuuuuuuuaacauccguagaaaggguaaaaacccaggcaugacaugaaccaaaacugaagagguucuguaacaaauacccccuuuuauauauugggcuccaacaauaagaacccauaggaaaauggagaaugaacacaaauagacaauuuauagaagagaagguuauaagguguaaaauuauaucuaucugagaaacaaacacuaaaacaaugugauucuacuguucucccacccauacuggcaaaacuuaagccugauaauaugcugaggggaaauaagcacucuuguuggugagaguauuaauuggcauagcuucuuuugaaaaugacauagcaauaccuguuaaaauugcaaacaugcaugucacuuaauccaguaaucccacuucugggaaucaaugcuacaaaaacacugacaaguauacaaagauacauucaagaguguucacugggccgggugcgguggcuucaugccuguaaucccagggaggcagaggcaagacgaucgcuugaccccaggaguucaaggccagcccgagaaacacagcaagacccugucucucuuuuuuuuauuuaaaaaauaaauguucacuguaucaguuguucacaaaaacaaaccaacauguccauuaacagggaaccauuuaaauuaaucaaguucaucuacacaauguaauaccaugcaacuauuaaaaagcaccugauaauccaaagcacacugagacagaauaaugcuauuaaaaacaccaaguaguggaacacuguguugccuaugacaccauuuuuauucaacauuuaaacaaauuuguaacagcaauuacaugaguagugacaauggcguuuaugagacuuuucacuuuuaugugcuucuauuuuuguuaugcuucuauauauacauccauuuauuauggaguguuacuuucaaaaaucacaaaugggccaguauuauuugguguugcaaggugagcauaugacuucugauaucaaccuuugcauauuacuucucaauuuagggaaauuacagacaucccuuauucuaacuaacuuaaaacccagcauuucaaacauacagaauugauggggaaaaaaaagaaagaagaaagaaagaaaaggcaacaagcuucagaugacagugacucacaucaaauuauuuauaaaaucuguuaaauagugccaucuucuggagauaccugguauuacaguccaacuccaguugaugucuuuacagagacaagaggaauaaaggaaaaaauauucaagaacugaaaaguauggagucauggaaaaauugcugugauccaaaggcuacggugauaggacaagaaacaagagaacuccaagcaguaagacacugcuguucuauuagcauccaaaccuccauacuccuguuugccccaaggcuuuuuuaaaaaauagagacaggaucucacuauuuugcucaggcuggucuugaacuccuggacucaagcgauccuccugccucggccuccuaaagugccgagauuacaggcuugagucaccauaccuggcuauuuauuuuuucuuaacucucuugccuggccuauagccaccauggaagcuaauaaagaauauuaauuuaagaguaaugguauaguucacuacauuggaauacagguauaagugccuacauuguacaugaauggcauacauggaucaauuaccccaccuggguggccaaaggaacugcgcgaaccucccuccuuggcugucuggaacaagcuucccacuagaucccuuuacugagugccucccucaucuuuaauuaugguuaagucuaggauaacaggacuggcaaaggugaggggaaagcuuccuccagaguugcucuacccucuccucuaccguccuaucuccucacuccucucagccaaggaguccaaucuguccugaacucagagcgucacugucaacuacauaaaauugccagagaagcucuuugggacuacaaacacauacccuuaaugucuuuauuucuauuuugucuaccucuucagucuaggugaaaaaauaggaaggauaauagggaagaacuuuguuuaugccuacuuauccgccccuaggaauuuugaaaaccucuagguagcaauaagaacugcagcaugguauagaaaaagaggaggaaagcuguauagaaaugcauaauaaaugggcaggaaaagaacugcuuggaacaaacagggagguugaacuauaaggagagaaagcagagaggcuaaucaacaaggcuggguucccaagagggcaugaugagacuauuacuaagguaggaauuacuaagggcuccauguccccuuaguggcuuaguacuauguagcuugcuuucugcagugaacuucagacccuucuuuuaggauccuagaauggacuuuuuuuuuuuaucggaaaacagucauucucucaacauucaagcaggccccaagucuaccacacucaaucacauuuucucuucauaucauaaucucucaaccauucucuguccuuuuaacuguuuuucuauacccugaucaaaugccaacaaaagugagaauguuagaaucauguauuuuuagagguagacuguaucucagauaaaaaaaaagggcagauauuccauuuuccaaaauauguaugcagaaaaaauaaguaugaaaggacauaugcucagguaacaaguuaauuuguuuacuuguauuuuaugaauucuuuuaaauaaacacauuacuaaaaaaaaaacuaaagguuuuugucaguuaaaaaacgacacugaugaagcacagcccuuacagaucaucuaguacuacacugucccauacgguagccacauguggcaauauaaauuacuuaaaaauucaguuccuguguugcacaagaugugucaagcgcucaaaagccacaugucacuaguggcucuguaccacauagcagaaacauaaaagauuuccauccucaaagaaaguucuauugaacagcauugcucuaauuaaauaaaaaauaccauuuagcacaacauaguaauagaaaagauugaagaguaagugcugauacuuaaaaaccugguauuuucugccaggcaugguggcucaugccuguaauccuagcacuuugggaggcugaggugggaggaucgcuuaagcccaggaguucuagaccagccugggcaacagggugaaaccccgucucuacaaaaaauacaaaaaauuagcugggcgugguggcaugugccuguagucccagcuacuugggaggcugaggugggagauaaccugagccugggaggucaagacugcaaugagaugagauugcaccacuacacuccagccugggugacagagugagacccugucucaaaaaaagaaaaaaacaaaaaacaaacaaaaaccaccugguauuuuuaaguacacuauuuucaaacauucaaacauucagaaguuauuucauccuaucuucaugguuuccauuuuaugccugguuugggauuaggaucugauaaaauaaacgugugcaacagaaccacuucucauggcuguauaacagaugaucaauauguauuugcugaggaaauuauucaauuuucuuaauuuuuuuucacaaaauuugugguuucaagggaccaaccuugacuacuacaccuucauguucuaagaaucaggggacuuauauaaaaccucaguuaccugauaaggacuacaucaaagugaaaagccaugggaaagaacuagaaaguauacuuuugaaccuaguucuguaaaguuuccuuaugccacagauaauacacauccccauuccugccaaauucuuucucucaccccugucuauggucucgauucaauaaauaggagaagggcaugaauuugcuuuagauagauagauagauagauagauagauagauagauagauagauagauagauagagauagacagauagagauagagacaaagauggagacagagauggaaauagagacagauuuacagaagauaaguucuagguaaacuagugucaacaucaaagugguauaccuacaucuaacuauucuggagagaaaaguauaccucaaagaaaucgacuacauacagagaaaaaguuuaagcugaaagcuacugcccucuuacaugagacacuuuaagaaacuacuuggggggcaagugagaaaauggggagauguagcucagaggauacaaaguagcagauauguaggaugaacaagucuagaaauauaauguacaacaugaaguauauagguaauaaaauugugcuguauuugggauucacacuaaaugagauuuuaagcuccucuugccaccaaaacaaaaaaaaaauggguaacuaugugaguugagggauacguuaauuugcuucacugcaguaaucuuuuaaccaccuauauguaucccauaacaucauguuguauaccuuaaauauacagaauacaauuuauuuaaaauaaaauacuccaauauuuucugcauuuuuaauauguucaaagaaaguauuaauuugcaucuuugauguuaaacagagccuaaucaagucacuaucaagaucaacacuaaaguuauagcuauucucuuuugauaccuuuugagacacacacacacacacacacacacaaauacacauauguguuuguguguguguguguguguguguauuuuaaguuaucguuuuggccaggugcaacggcugacaccuguaaucucagcacuuugggagaccaaggcagaaggauugcuugagaccaggaguuugagaccagccugggcaacacagcaagacccuaucucuacaauuuuuuuuuuuuuuaaaauagccaugggugauggcacgcacuuguagucucagauacuugggaggcugaggcagaggaucccuugagcccaggaguucaaagcugcaaugggccacuaugccacugcauuccagucugggcaacagagcaagaccuugucucaaaaaaaaaaacauuucuaauuaaagauaaagaguuauaguuuuaugaaccuugacugcaacugagggaaaaucccguaauuggcaaaaugaauucugucugcuugcaaaacuucugacuaauagagaaugaauaauaggaagcccauauuagaggauccacaucaguuaaaaaguuuuuccaaauaagagugacucugaguucugcagaguuaaaagauuggguucaaaucaaagacuuguaugaucuugaguaaguuacuuaaucccucugugacucacuguucucaaauguaaaugaagauaauuuguaacucaaaaaaauaaaaaugaaaaaguuuucucuaagauugcaaauccuaagaauaauuucauuuuaauaucagucauuuagucuggauacaccauaaugcagacuaauuuucccucugcuuaagguccacacaaaaacauuuccaauaaaauuuacuuguguaucaacuuuuccuccugaggcuuuguuguuuuuuugguaaaaaaauaaaauaaaauaaaauaaaaauaaaaauaaaaaaaucacuagacuggguacaguggcccaugccuguaauuucacuuagggaagccaaggcaguuggauuguuugagcucaggaguuucagaccaaccugggcaacauggcaaaacccuguuucuacaaaaaaaaaugcaaaaauuagucaggugugguggcacacaccugugguccccgcuacucuggaaagggaggugggaggauugcuugagcccacgcagagguugcagugaaccaagauggcaccacugcacuccagccugggugacagagcaagauccugucucaaaacaaaaacaaaaacaaaaacaaaacaacaacaacaacaacaacaaaaaaccacuggccaggcacgguggcucacgccuguaaucccagcauuuugggaguccgaggcggguggaucaccagaggucaagaguucuagaccagccuggccaacauggugaaaccccaucucaacuaaaaauacaaaaauuagccaggcaugguagcaggcgccuguaaucccagcuacucggggggccaaggcaggaguauagcuugaaccugggaggcagagguugcagugagcugagaucacgccaucgcacuccagccugggggacaagagugagacuucgucucaaaaaaaaaaaaucacuauaaaauugaaauaaauucacaacaaaggaaauacauuuguauacuuaaccuucuuuuuauuuacuuauuuacuuauuuuuaauauuuugagauggcgucucgcuacauugccuaggcuggucuugaacuccuggguucaagccagccucccgucuugacuucccaaaguacugggauuacaggugugagccaccaugcucagcccauauuuaacuuucacuuucugaauaucacagggcagaaaaggucaucaaauauauaguacuauauuucauugcucuaagaugcacauucacauuuuauuaauaauagcucuaaaauugauguauuacaauugauggcaauuuacauuuauaacugguaguguuuucuuucuuggcaguaugaaaaauaguguuaagucuuaaaaucagugacaucuuuaauuuaaugaaauagguauuuggaauccccaggcaauuucccaucuaggcacuagguaaauaaaauccuaccaagcuacuuggauuaagaguacgcauauguguguguguacacagagagagaauucuuuagaauauucuaaauaaaaaguggcagugauauuuggaaugacuuaaauccuuuauaauuuucugcaguuguguuuucuuucuuauuuuuuuaagacagggucucccucugucacucaggcuggaaugcaguuccacugcauuccacucagucucgaacuccugcagucucaaacuccuaggcucaagggaugcuccugccucugccucccaaguagcugggacuacaggugcacgccaccaugcacaacuaauucuuuuuguguagagagggggucucauuauguugucuaggcuggucucaaacuccuggccucaagugauucucccaccucgaucucccaaagcacuggaauuacaugugugccacugcacccagccguauguuuucuaauaagcauguuuucuuuaauaagaaaaauggaguuuuuauuuccaaaaaaaaauagauggguguguugacaucauaauguuucuuuauauauucuggaaacauuuaauaguucauagaauauuucuuuaggauuaguacggaucagccagauuuuaacucacuguuucaaauuggucaagaucagcauguaaaaaucauacugacaucaauguuauugaugcugcaaacaauuuaaaauuuccauuuuacaguuuuaccaaauuaagcugccuaauguuuuauaugcauauaugaauaucuuacaugacaagcugcugaauuauuaaacaggguagaaaugcuacuucaggcugggcauggugacucaagccuguaaucccagcaauuuuagaggcugaggcaggaagacugcuugagcccaggaguucgggaucagccugggcaacacaguaagacccaaucucuacaaacauaaaaaaaaauuagccagccaugguggugcacaccuguuagucccagcuacucgggaggccgaagugggagaaucacuugagcccagaaggucaaggccacagugagcugugaucuugcuacugcauuccagccugggugacagaaugagaccuugucuuuaaaaaaaaacuuuacuucaaaucaacagauauuuuuauuauuuguaaagauaggguauugcuguguugcccaggcuggucucgaaccccuggccucaagugauucugcugucuuggccuuccaaagcacugagauuacaggcaugagccaucaucaaaucaagagauauuaucagaagagcuuucucaauuucuacuguuuaacaguauaucuuccuugcauagcccuauaaauauacuaaaaagcuuggaauuguauaguuaaaacaugugauuauuauauuauauaaaauauaccccaguaaagccuuuuuuaaaaaauuaacaugucggccgggcacgguggcucaugccuauaaucccagcacuuugggaggcugagguggguggaucaccugaggucagggguucgagaccagccugaccaacaaggugaaaccccaucucuacuaaaaacacaaaaauuagccgggcauaguggcaggcaccuguagucccagcuacucgggaggcugagacagaagaauugcuugaacccgggagguggagguugcagugagcuacgaucaugccacugcacuccagccugggcaacagagugagacucugucucaaaaaaaaaaauaaauaaauaaaauaaaauaaaauaaaauaaaauaaaauaaaauaaaauaaacauaucaauaaauaccaaaaaaauaguauaucuacauagaauuucacauaaaauaaacuguuuucuaugugaaaauuaaccuaaaaauaugcuuugcuuauguuuaagaugucaugcuuuuuaucaguugaggaguucagcuuaauaauccucuaagaucuuaaacaaauaggaaaaaaacuaaaaguagaaaauggaaauaaaaugucaaagcauuucuaccacucagaauugaucuuauaacaugaaaugcuuuuuaaaagaaaauauuaaaguuaaacuccccuauuuugcucguuuuugcuuaucuaaaauaacauucugcacaaauccccaaagauuagucauaacguaacaagacugauuaagacugauggggauggggaaggaggcuauagaagaccaaaaagauaaaucauaccaacucuaaguacaugcuuugacucuaagcagcaauguauuaaaggcuggccaguuauacugccagcagcuauaaugacuagaaugaaguccuacuguaaaccaucaaucaaucaaucaaucaaucaaucacuuuuguugaguaaaagucuaaauuuuguguuuaaacaagucuuuaauucaagcaagacuuuaacaaguuaaaaggagcuuauggguaggaaguaguguuaugauguaugggcauaaaggguuuuaaugggauagugaaaaugucuauaauaauacuuaaauggcugcccaaucaccuacaggauugauguaaacauggaaaaggucaaaaacuugggucacuaaaauagaugauuaauggagaggaugagguugauaguuaaauguagauaaguggucuuauucucaauaaaaaugugaacauaaggcgaguuucuacaaagauggacaggacucauucaugaaacagcaaaaacuggacauuuguucuaaucuuugaagaguaugaaaaauuccuauuuuaaaggaaaacaguaacucacaggaaauaccaacccaacauaaaaucagaaacaauagucuaaaguaauaaaaaucaaacguuugcacgaucaaauuaugaaugaaauucacuacuaaaauucacacugauuuuguuucauccacagugucaauguugugaugcauuucaauugugugacacaggcagacuguggaucaaaagugguuucuggugcgacuuacucucuugaguauaccugcaguccccuuucuuaaguguguuaaaaaaaaagggggauuucuucaauucgccaauacucuagcucuccaugugcuuucuaggaaacaaguguuaacccaccuuauuugucaaaccuagcuccaaaggacuuuugacuccccacaaaccgauguagcucaagagaggguaucugucaccaguauguauagugaaaaaaguaucccaagucccaacagcaauuccuaaaaggaguuuauuuaaaaaaccacacacaccuguaaaauaaguauauauccuccaaggugacuaguuuuaaaaaaacaguauuggcuuugauguaaaguacuagugaauauguuagaaaaaucucacuguaaccaagugaaaugaaagcaaguaugguuugcagagauucaaagaaaauauaagaaaaccuacuguugccacuaaaaagaaucauauauuaaauauacucacacaauagcucuucagucugauaaaaucuacagucauaggaauggaucuaucacuauuucuauucagugcuuugauguaauccagcaggucagcaaagaauuuauagccccccuugagcacacagagggcuacaaugugauggccucccaucuccuucaucacaucucgagcaagacguucaguccuacagaaauaaaaucaggaauuuaauagaaaguuucauacauuaaacuuuauaacaaacaccucuuagucauuaaacuuccacaccaaccugggcaauacagugagaccccaugccugcaaaaaaaaaaaaauuagccaggcaugguagcauguaccuguagucccagcuacuugagaggugaggugggaaaaucacuuuagugcaggauguugaggcuggagugaacugugauugugccacugcacuccagccuggacaauagagcaagaccuugucucaaaaaaaugcauuaaaaauuuuuuuuaaaucuuccacguaacacauccuuugcccucauguuucauaagguaaaaaauuugauaccuucaaaaaaaccaagcauaccacuaucauaauuuuuuuuaaaugcaaauaaaaacaagauaccauuuucaccuaucagacuggcagguucugauuaaaugaaauuucuuggauaauauacaauauuaagagagacuguagaaacugggccaguggcucaugccuguaaucccagcacuuugggaggcuggguaacauggcgaacccuguuucuacaaaauaaaaauauuagcugggagugguggcgcacaccuauagucccagcuacucaggaggcugagguggaaggaucgcuugaacccaggagguugagacugcagugaacugugaucauucugcugcacugcaccccagccugggcaacagagaccuugucucaaaaaaaaaaaaaaaagagacaaauugugaagagaaagguacucucauauaacaucaggaguauaaaaugauucaacuucuuagaggaaaauuuggcaauaccaaaauauucaauaaacucuuuccccuugacccagaaauuccacuugaauaaagcugaacaaguaccaaacauguaaaagaauguuucuucuaguacagucgguaagaacaaaauagugucuaucaauaguggacugguuaaaucaguuaugguaucuccauaagacagaaugcuaugcaaccuuuaaaauauauuagauagcucuagacacacuaauauuaaaaguguccaauaacauuuaaaacuauacucauacguuaaaauauaaauguauauauguacuuuugcauauaguauacaugcauagccagugcuugagaagaaauguguacagaaggcugaaaggagagaacuuuagucuucuuguuuauggccuccauaguuagaauauuuuauaacacaaauauuuugauauuauaauuuuaaaauaaaaacacagaauagccagacauacaaugcaagcauucaauaccagguaagguuuuucacuguaauugacuuaacagaaaauuuucaagcuagaugugcauaauaauaaaaaucugaccuugccuucaugugauucagccccaguccauuacccuguuuaggacugagaaaugcaagacucuggcuagaguuccuucuuccaucucccuucaauguuuacuuuguucuggucccuacagagucccacuauaccacaacugauacuaaguaauuaguaaggcccuccucuuuuauuuuuaauaaagaagauuuuagaaagcaucaguuauuuaauaaguuggccuaguuuauguucaaauagcaaguacucagaacagcugcugauguuugaaauuaacacaagaaaaaguaaaaaaccucauuuuaagaucuuacuuaccuguccauaauuaguccaugaggaauaaacacccuuuccaaauccucagcauaaugauuagguaugcaaaauaaaucaaggucauaaccugguucaucaucacuaaucugaaaaagaaauauagcuguuucaaugagagcauuacaggauacaaacauuugauuggauuaagauguuaaaaaauaaccuuagucuaucagagaaauuuagguguaagaugauauuaguaacuguuaacuuuguagguaugauaaugaauuauguaagaaaacaacaggccgggcggguugguucacacguguaaucccagcacuuugggaggcugaggcaggcagacugccugagcucaggaguucgagaccagccugggcaacacggugaaaucccgucucuacuaaaaauacaaaaaaauuagccggguguggugacacaugccuguagucccagcuacuugggaggcugaggcaggagaaucacuugaaccugggaggugaagguugcagugagccaagaaugcgccacuucacuccagccugggaaacagagcaagacucugucucaaaaaaaacaaaacaaacaaacaaaaaaacaggcugggcgcgguggcucacgccuguaaucccagcacuuugggaggccgaggcggguggaucaccugaggucaggaguuccagaccagccuugucaacauggugaaaccuccccccgccgucucuacuaaaaauacaaaaauuagccaggcgugguggcaggagccuguaaucccagcuacuugggaggcugaggcaggagaaucgcuuguacccagaaggcagagguugcacugagcugagauggcaccauugcacuccagccugggggacaagagcgagauuucgucuuuaaaaaacaaaaaacaaaacaaaaaaccauguaacuauaugucuuagucaucuuagucaagaauguagaaguaaagugauaagauauggaauuuccuuuaggucacaaagagaaaaagaaaaauuuuaaagagcuaagacaaacgcagcaaaaucuuuauauuuaauaauauucuaaacaugggugaugaacauacggguauucauuauacuauucucuccacuuuugaguauguuugaaaauuuaguaaaacaaguuuuaacacacuguagucuaacaagauaaaauaucacacugaacaggaaaaacuggcauggugugguggcucacacuuguaaucccagugcuuugggaggcugagacaggagaguugcuugaggccaggaguucaagaccgacauggggaauguagcaagaccccgucccuacaaaaaacuuuguaaaaauuugccagguaugguggugcauaccuguagucccagcuacucgggaggcggaggcagaaggaaucacuugagcccaggaguuugaggcugcagugagcuacgaucauaccacagcacuccagcguggacaacagaguaagacccuaucucaaaaacaaaacaaaacaaaacaaacaaaaaaaaccacaagaaaaacugcuggcugaugcagcggcucaugccuguaaucccaguauuuugggaggcccaggugggcguaucaccugaggucaggaguuagagaccagccuggccaacauggugaaaccccaucucuacuaaaaauacaaaauuagccaggcauguggcacgcgccuguagucccaguuacuggggaggcugaagcaggaggaucaccugagcccgggagguggagguugcagugagccgagaucacaccacugcacuccagccugggugacacagcaauacccuaccucaaaauaaaaaagaaaaagaaaagaaaaguugcuguccccgcuaccccaaucccaaauccaaacagccucucucaucucacaguaagggggaaaaaucacccaaaaaagcuaagugaucuuuugaaaacccaaacucuuagaagucuaagauuauuauagucaacucaugaagugucaucauaaaagauacucuaauauuauuuaaguagaaccacauauugguugucuugguaugucuagccccuggcauacaaaauauuuaauaacacugauaugguaccugugaugugaaaauguacuaugaguacagcuuuauaaauacuauauauguaccuauauacagaaaaaaauacaacaaaaucauaaaagcacuuaucuuugaaagaggaguuacagcaauuuuauuuaguucuuuauugcuuugcuauauauucuaaauuuuuuucaaugaauauauaucacuuuuaaaaaaauucaauggucuuucuuauaaauuaucuuuggcagcaugcguuuuuauauauacauauaaaauguaugggaaauuuuuaaaggauacauuaaauuaaagcaaaauauacaaacaaaaaaucagaauacaaaaagauaaaaagauugggaagggagggagggaguaaggaggaaggguggguggguauagagaaauauaccaaauaaugguaagaaguggggucuugacacuuucuacacuuuuuuuaaauaaaaaaaauuuuuuucucucucuuuuuuuuuuuuagagacgaagucucgcuauguugcccaggcuggucuugaacuccugggaucaagagauccuccugccucagccucccaaggugcuuggauuacaggugugagccaccacgccuggucacuuucuacacuuuaauauauauauuuuuucauuuucaaugucauuuuuauuaguuaauuuauaauacccauucaccauuauauucaaagucuauuugaagaaauaaaccagaaagaaugaaauacucuagcucacaugcuauucaauacuaaauuaccuuucaaaucacauucaagaagcugaugauuuaagcuuuggcgguuuccaauaaauauuggucaaaccauaauuaaaucucaauauaucaguuaguaccuauugagcaucuccuuuuacaaccuaagcauuguauuaggugcuuaaauacaagcagcuugacuuuuaauacauuuaaaaauacauauuuaagacuuaaaaucuuauuuauggaauucaguuauauuuugagguuuccagugcugagaaauuugagguuugugcugucuuucaguccccaaagcucaguucugaguucucagacuuugguggaacuucauguauugucagguuggcccguaauaccugugggacaacuucagccccugugcacauggccaggaggcugguugcaaacauuuucagguagguggaccaggacaugccccuggucauggccagguggaggcauagugcuauacagcaggcagaagucaauauugauuuguuuuuaaagaaacauguacuacuuucauaagcagaaaaaauuucuauucuugggggaaaagauuaugccagauccucuaggauuaaaugcugaugcaucugcuaaaccuucacauaucagaacauauuuacuauagaaagaaugaaaaugggacauuugugugucaccuaugugaacauuccaaaaauauuuuacaacaacuaaguauuuuauaaauuuuaugaacugaaauuuaguucaaguucuaggaaaauacaaaccuugcuagauauuauaaaaaugauacaauauauauucauuucaggcucaucagaauauaucuguuaucacuugacaagaaugaaaaugcaccauuuuguagugcuuuaaaaucaggaagauccagaguacuaaaaaugacuucuuccuugaagcuuacucaccaacuuccucccaguuacucacugcuucugccacaagcauaaacuaggacccagccagaacuccuugaaauauacacuugcaacgauuacugcaucuaucaaaaugguucagugccuggcuacagguucugcagaucgacuaagaauuugaaaagucuuguuuauuucaaaggaagcccaugugaauucugcccagaguucaucccagauaugcagucuaagaauacagacagaucagcagagauguauucuaaaacaggaauucuggcaauauaacaaauugauuuccaaucaaaacagauuuacauaccauacuuaugucaagaaguuguuuuguuuuauugcauccuagauuuuauuuuuuugauuuaugguuuacuuuaagcauaaaaaauuugucaauacaacucuucccaaaaggcauaaacaaaaauucauaaaacuugcaucacuugagauacuucagguaugaauucacaacuuuguuacaacuuacuauauauaugcacacauauauauauauuuggguauauuggggggguucuaauuuaagaaaugcauaauuggcuauagacagacaguugucagaacuuggcaauggguacgugcagguucauuauaccaagucuacuuguaguuguucaaaauguaucauaauacaaggccgggcgagguggcucacgccuguaaucccagcauuuugggaggcuaaggcaggaggauugcuugaggucaggaguuugugaccagccugggcaacagagcaagacccugucuccaaaaagaaaaaaaauaauuuuuuacaaaauaaaaacaaaauguaucaucagacgaaauuaaauaagaggcaauucauuuaaaugacaacuuuucccagcuugacauuuaacaaaaagucuaaguccucuuaauucauauuuaaugaucaaauaucaaauacuaauuuuuuuuuuuuuuuuuuuuuugagacggagucucgcucugucgcccaggcuggagugcaguggcgcgauccuggcucacugcaagcuccgccucccggguucacgccauucuccugccucagccucccgaguagcugggauuacagacaugcgccaccacgcccggcuaauuuuguauuuuuaguagagaugggguuucuccauguuggucaggcuggucuugaauuucccaccucaggugaucugccugccucagccucacaaagcaguagcugggacuacaggcacccaccaccacacuugguuaauucuuuuguauuuuuuuuguaaagacgggauuucaccauguuagccaggauggucucgaucuccugaucucaugauccgcccgccucagccucccaaagugcugggauuacaggcgugagccaccccgcccggccaucaaauacuaauucuuaaaugguaaggacccacuauucagaaccuguauccuuaucacuaauaugcaaauauuuauugaauacuuacuaugucaugcauacuagagagaguuagauaaauuugauacagcuacccucacagaacuuacaguguaauagauggcaugacauguacaugaguaacugugaacaguguuaaauugcuauuuaaaaaaaaagacggcugggcgcuguggcucaugccuguaaucccagcacuuugggaggccaaggcaaguugaucgcucgaggucaagaguucgagaccagccuggccaacgugguaaaaccccgucucuacuaaaaauacaaaaaaaaaauuagccaggcaugguggcacaggccuguaaucccagcuacuagggaggcugagacauggagaacugcuugaauccaggaggcagagguuacagugagccgagaucauaccacuacacuccagccugagugacagagcgagacuccgucuaaaaaaaaaaaaaaaaaaaaagauacagguuaaguguuaugguaguugaagagagaacucaaacucugucucagaagccucacuugcauguggaccacugauaugaaauaauauaaauagguauaauucaauaaauaggaacuucaguuuuaaucaucccaaacaccaaaacuuccuaucaaacagguccaauaaacucaaucucuauaagagcuagacagaaaucuacuugguggccuauaaucuuauuagcccuuacuugucccaucugauauuaauuaaccccaucuaauauggauuaguuaacaauccaguggcugcuuugacaggaacaguuggagagaguuggggauugcaacauauucaauuauacaaaaaugcauucagcaucuaccuugauuaaggcagugugcaacagaauuugcaggagaguaaaagaaugauuauaaauuuacaacccuuaaagagcuuauagcugggcgugguggcucaugccuguaaaucccagcacuuugggaggcugaggcggguggaucaccugaggccagaaguucaagaccagccuagccaacauggcgaaacccugucucuacaaaaaauacaaaaauuagccgggugugguggcacgugccuguagucccaguuacuugggaggccgaggcaggagaaucgcuugaaccuaggagguggaggcugcagugagccgagauugugccacugcacuccacuucagccugggcgacaagagcaagacuccgucacaaaaaaaaaaaaaaaaaaaaagcuuaaaaucuagugggaaaggcauauauacauacaacuaacuguauagcauaauaaagcucauaaucuguaacaaaaucuaauucgacaagcccagaaacuugugauuuaccaaaaacaguuauauauacacaaaaaguaaaccuagaacccaaaguuacccagcaccaaugauucucucccuaagcaguaucaaguuuaaagcagugauuacauucuacugccuagauuguaaacugaguaaaggagaccagcaccuuucugcuacugaacuagcacagccguguaaaccaacaaggcaauggcagugcccaacuuucuguaugaauauaaguuacaucuguuuuauuauuugugacuugguguugcaugugguuauuaucaacaccuucugaaagaacaacuaccugcucaggcugccauaacaaaauaccacagacugagugacuuaacagaaacuuauuucucacaguuuuggaggcugggaaguccaaaauuaagguaccugcaagguagguuucaaucucaggccucuucuuuggcuugaaggucuucuaacugugugcucacaugaccucuucuaacaagcucucuggugucucuuuuuuuuuuuuuuucuuuuuugagacagagucucacucugucacccaggcuggaguacaguggcacaaucugggcucacugcaaccuccaacucccggguucaagugauucucaugccucacccucccgaguagcuuggaugacaggagcccgcuaccacacccagcuaauuuuuguauuuuuaguagagaugguguuucacuacauuggccaggcuggucucaaacuccugaccucgugauccacccaccuuggccucccaaagugcugggauuacaggugugagccacugcgcccguccuggugucuuuucauauaagggcacuaauccaaucagaccugggcccaacccucccgacuucuucuaacuguaauuaccuuccaaaggcccugucuccaaauaccaucacacuggggguuaggacuucaaaaaagguauggggggggugugggaggacauaaaugcucaguccauaacaagcacccaacauaaaaauggcuagaacagaucacaaaaaaaagguccuguauggcuuuggggaagggcucaaccccaaaauaucugagagcucuggaggggccuagaagugguaaaugaaugaaaacgugguuacucuccagaucugccuuucccaaauauggccauucuuggcugaaucagaaaucaaaggacagguuauuaauuacuagcucuaaguuacuuaccauuugcugagacaguucagaaaucugacugcaucuccucagagaucuagaacacaguucucaaauucuaacuuacuugugauauacuugugaaugauaaaaaucgcuacagguacuuuuauuaaucugaaagaguauugagaaauuaccuuucauucugacuuuugucuggaaugaaaaucaauacuuuugcuauaaucgauuacugaaauaauuuuacuuuccaguaaaacuggcauuauaauuuuuuuuaauuuuuaaaacuucauaauuuuuugccagacugacccauguaaacauacaaauuacuaauaauuaugcacgucacaucuguaauaauggccuucauguaaacauuuuugugguuuacacauaaaaucucuaauuacaaagcuauauuaucuaaaauuacaguaagcaagaaaauuaauccaagcuaagacaauacuugcaacaucaauucaucaucugugacaaggacugcuuaagucucuuugugguuaaaaaggaaaaaaaaaaaaaagacauguuggccagaugcgguggcucacaccuguaaucccagcacuuugggaggcugaggugggcggaucaccccuggccugcccaacauggugaaaccccgucucuacuaaaaacacaaaaauuagcugggcgugguggcgggcgccuguaauuccagcuacucgggaggcugaggcaggagaauugcuagaacccaggaggcagagauugcagugagcugagauugcaccauugcacuacagucugggcaacaaaagugaaacuccaucuuaaaaaaaaaaagacaauguucguggguccaaacaagacuuaauggaagugagucuaaaaaugagcuaugugggccaggcguaguggcucccaccuguaaucccagcacuuugggaggccgaagcaggcagaucaugaggucaggagauggagaccauccuggccaacacggugaaauccugucucuacaaaaauuagcugggcgugguggugccugccuguaaucccagcuacucagaaggcucaggcaggagaaucgcuugaaccagggagucgguggcuagagugagccgagauugcaucacugcacuccugccuggugacagagcaagacuccaucucaaaaaaaacaaacaaaaauaaaagauaaaaaugagcuaugugaauuaaaagagguauaacaauagauaaaccauauuuuauuuaauuccuaguaaugaguaauauuuccaaacuucuggaaugggcagaaauugcuaguuggcauauuuuuaccuuuuauauucagauacauuaaaauucucaaaaaaaaacaccucaaagcagaugauccgccaucuccuuggauaauuuguguuaacucaggauaacagaaaaccaaaauuaugaguuacugaugcaauauuccuaaauguaaaaauaauuaaagcuaauaguagauucaucuuccaauuucauaucagucuuacaaauaaacuacauauauaacuugcuugccuucccuucugagggauaaagcuguuagaagaauuaaaaucagcauucuugacuauucaaccaagggagggauaaauuauuacucauucuagggacaugggcucauaacuacuacauguguaaggacaugaauuuacccaauauuacaauuuuuccuuuuauuaguguguacaguggaagaauagacauguucacucuggacaaaaaaaaaauuauacuuaucaguuaucagaagcacaaugcugaagacaguaguuccauaacaauuugaaguaugugaucgaacuaguagauuaucuuaguaguagugaauuauuguaaauguuaguaauuuggcagccacugggcagaaaaauaagaauugaggcucaauauugauauuaaugguggugauugacacauaaauuuuaucaagucuacacaauauaaaauuacagaaagguagaagaguauaccaguacaacuucaacauaucuucacuacaagggaguaaaaugacauggccuaguuacuaucuaaugaacugcagaaaacuaaaagaaaacuccaaggcaacucuucucugcugaucugguugguccuuuuccuaccuuuugcaauacccagauacaaacaauggauagaaaacaaaguagacuuguaguaugcaggucacagugcuaaauucacagaaagaaaccccugaacugaacugcucuauuuccugguggucacaaagaguaauucugguuuacaccuacagauugaugucaaucuacacccuguugauaacaguguggccaaggacaaaaaaaaggugcuccguuuuaccaauucuguaaaaaauuauuggcaggguaagcucggcuagggcaggauuacauuucuaggacuaccauccccgaaauuuagaagauauuauauccacauaaagcauaucuuucacauuaauuugcaaaaaucuaaaagcuuuuucuuagcucaaguguguccaaguuuacccuggcaguuuaaaacgauaguuacaagcagcauggguuguaucagacacauuugagggccaauuucauguaagugauauugggcaaguuacuucaacuaucugugccuccaaggucauacuaguguuuauuuaccuaaaggguaccuguuauguaacuuuaggguguuuacauuagauaaugccugcaaaauauuuacuucaacgccuaaaacauaguuaaguauucaauaaauaccuacuauugucacuacuaacuuaaaaguuuagagauuaagagcagaaucuggggugagacaaacuuagguucaaauccuaguauuguuggguaaucuugggcaaguuacuuaaccucucugauuuguguaauuuaaaaaauuaguuaauauacauaacagggcuuagaagaguaucuagcacauagcaccauuuaagcauuuguuauugcuaacaugcaaacaauuuaagggaaagaaauuuuuuaaaaaggaagagggauuugcaaacuaaaaacaaugaguaucuuauguucaaagaaaacuaacaaacagccagcucuagcaauaauuaaauucacuauauacuggggcaggcaucacaccccaaagcuaaaagcgucuaccuaggccaggcacgguggcucaugccuguaaucccagcacuuugggaagcagaggcgggcagaucgcuugagcucaggaguucaagaccagccuggacaacauggcaaaacaccaucucuacaaaaaauacaaauauuaggccgggcgcaguggcucacgccuguaaucccagcacuuugggaggccaaggcggguggaucaccugagaucaggaguucgagaguagccuggccaacauggugaaaccucgucucuauuaaaaauacaaaaaauuagccaggcaugguggcaggcgccuguaaucccagcuacucagggggaugagguaggagaaucgcuugaacccgggaggcagagguugcacugagccgagaucaugccacuguacuccagcccgggcaacaagagcgaaacuccaucucaaaaaauaaauaaauaaauaaauaaaauaaaguacaaauauuagccagggaugguggugcgcaccuguagucccagcuacuugggaggcugaagugggagaauccccugagccuggggagaaucacccgagcccgggaagucgaggcugcagugagcagugauugugccacugcacuccauccuaggugacagagugagacccugucucaaaaaaaagaaauuggcagaauuaaguaaguugauguuuagagaugaaaaaucaacauuuuuuccucagcaacugaauaaaaacaacagccacuaccauuuuuuugaguaccuauuuguagccuauuuuuuaacugguauuacucgagagagagagagcuagguucgagacagagcuccuucucuuaauaacuguaugaccuaggguaugucuguuagccucucugaggcuucaaagguuccucaucuguaaaaugguaauaaucauaccauugcuacagggcuguuuugaagacuaauuaggacuauguaaguaaacaugaugauggcuauuauuacuguuccccgccaggggccaugcaaggguugcugauucacauagacugucuuauaauccucucaauaacuccaagagguagccagcaccucagauauacauaaaaugacuuaagcccagagaggugaaguaaguugcccacagccacacaacuaguaaauagcccaaacaagcuggauucccaguuagacuccguuaauagcacugcucuuuaccuuaagucauuacaaugccuaauaugaaauagaaucgcuucuuucuuaggguucaagugguuaauuauuuaauguauucauucaacaaaccaucaucgaggaccucuuacaagccaaguacugugcuaagugcuagaguuacggcggugauuccugcccuuaaaaaguuuuagugggagaaacaacagguaaccaggucauugccaaaacaacaaaaauaaucauaauaaagcaggcuaaagcauauuuaacuggccgggguuuugacuauuuuagcaagcaugaucagaacgguugaggagggaggccagcagcuuggccgguucaacaaacaagaaaaaaccagugaggguggagcuaagauaccagaggcugauuacgguuaagaauguucuugaagguaaggaccagauucucauuuucuauauccuggggcaucggucagcauggaaucuggauucuagcacaugugaauuucggcuugaaaugaccuaaugccuuuucccuaguuccuucgugugucaaauacgcaugguuaccgcuaccagagcuguaguggggcuucaaugaggccaugagcaucuccauaaagaugaacuacagugugugcaaaacuaaaggcaaaaccugguccccacacgcccucccagguggucgcuuuccgugccgaggccccuccagaggugccccgagaaccucaccaucgcaccccaaacuuccagggaagggccucucccgagaaagcccccacgcccccaccccgcgccaucauucccgaaucugcccucggccccuccccgcagcacgcucgcaggcggcacaugucaaccaaaacgccauuuccaccuucucuucccacacgcaguccucuuuucccagggcucccccgaggagggacccaccccaaaccccgccauuccguccucccugccgcccucgcgugacguaaagccgaacccgggaaacuggccgcccccgccugcgggguucccugggcccggccgcccgagcccgcacugcggaucccgcgccucagggcccggccgccaccugccgcgugggccugaaccggccagggccggcaggccgagcugcucaccacgacgccagggcugcgggucgccauaacggagccggccggcgcgcgggcugacugcucaggaggaggaagccgguggcggagcagaggaggaggcggaggcgcagcaagaggcggcgccgcgcgggaaagccgagagguucgccugagggcucgucgcagccgccugaagcugaggagaagcaggccccgcc

SEQ ID NO: 192825 - RNA, 39179 nt, Homo sapiens
acuuccgguggagggccgccucugagcgggcggcgggccgacggcgagcgcgggcggcggcggugacggaggcgccgcugccagggggcgugcggcagcgcggcggcggcggcggcggcggcggcggcggaggcggcggcggcggcggcggcggcggcggcugggccucgagcgcccgcagcccaccucucgggggcgggcucccggcgcuagcagggcugaagagaagauggaggagcuggugguggaagugcggggcuccaauggcgcuuucuacaagguacuuggcucuagggcaggccccaucuucgcccuuccuucccucccuuuucuucuuggugucggcgggaggcaggcccggggcccucuucccgagcaccgcgccugggugccagggcacgcucggcgggauguuguugggagggaaggacuggacuuggggccuguuggaagccccucuccgacuccgagaggcccuagcgccuaucgaaaugagagaccagcgaggagaggguucucuuucggcgccgagccccgccggggugagcuggggaugggcgagggccggcggcagguacuagagccgggcgggaagggccgaaaucggcgcuaagugacggcgauggcuuauucccccuuuccuaaacaucaucucccagcgggauccgggccugucguguggguaguuguggaggagcggggggcgcuucagccgggccgccuccugcagcgccaagagggcuucaggucuccuuuggcuucucuuuuccggucuagcauugggacuucggagagcuccacuguucugggcgagggcugugaagaaagaguaguaagaagcgguagucggcaccaaaucacaauggcaacugauuuuuaguggcuucucuuuguggauuucggaggagauuuuagauccaaaaguuucaggaagacccuaacauggcccagcagugcauugaagaaguugaucaucgugaauauucgcgucccccuuuuuguuaaacgggguaaauucaggaaugcacaugcuucagcgucuaaaaccauuagcagcgcugcuacuuaaaaauuguguguguguguuuaaguuuccaaagaccuaaauauaugccaugaaacuucagguaauuaacugagaguauauuauuacuagggcauuuuuuuuuuaacugagcgaaaauauuuuugugccccuaagaacuugaccacauuuccuuugaauuugugguguugcaguggacugaauuguugaggcuuuauauaggcauucauggguuuacugugcuuuuuaaaguuacaccauugcagaucaacuaacaccuuucaguuuuaaaaggaagauuuacaaauuugauguagcaguagugcguuuguugguauguaggugcuguauaaauucaucuauaaauucucauuuccuuuugaaugucuauaaccucuuucaauaauaucccaccuuacuacaguauuuuggcaauagaaggugcguguggaaggaaggcuggaaaauagcuauuagcaguguccaacacaauucuuaaauguauuguagaauggcuugaauguuucagacaggacacguuuggcuauaggaaaauaaacaauugacuuuauucuguguuuaccaauuuuaugaagacauuuggagaucaguauauuucauaaaugaguaaaguauguaaacuguuccauacuuugagcacaaagauaaagccuuuugcuguaaaaggaggcaaaagguaaccccgcguuuauguucuuaacagucucaugaauaugaaauuguuucaguugacucugcagucaaaauuuuaauuucauugauuuuauugauccauaauuucuucuggugaguuugcguagaaucguucacgguccuagauuagugguuuuggucacuagauuucuggcacuaauaacuauaauacauauacauauauaugugugaguaacggcuaaugguuaggcaagauuuugauugaccugugauauaaacuuagauuggaugccacuaaaguuugcuuaucacagagggcaaguagcacauuauggccuugaaguacuuauuguucucuuccagcaacuuaugauuugcuccagugauuuugcuugcacacugacuggaauauaagaaaugccuucuauuuuugcuauuaauucccuccuuuuuuguuuuguuuuguaacgaaguuguuuaacuugaaggugaaugaagaauagguugguugccccuuaguucccugaggagaaauguuaauacuugaacaagugugugucagacaaauugcuguuauguuuauuuaauuaaguuugauuucuaagaaaaucucaaauggucugcacugauggaagaacaguuucuguaacaaaaaagcuugaaauuuuuauaugacuuauaauacugcugugaguuuuaaaaguaaagcaaaaguaaacugaguugcuuguccagugggauggacaggaaagaugugaaauaaaaaccaaugaaaaaugaacugcuguggagaaguguuacauuuauggaaaaagaaauaggaaccuuguucaucaaauugauagaaaagcuuuuaaaacuaaacaaaucaaacaacuugaguauaauggaauucagacuuugauuugccuaacauaaccaccauauuugcaaggacagcucucuaucuucugguguuuauucuuaaaaacuuaaaaguuagauuuagcgaucaccagagccacuacuuuuaugcuuagguauuuguuugacuuagaaaaaauuggucacguguaccacuuuauagugcccugcagguguuaagauaugaaggcacuuugacuuacaccucauaaaaucuuuacaaaguauuuucuaaaugaauaaugaugaaauaaagucuuuauucuaggugcaucugccccacauaauuuguuuucuuuggacuagaaguuuugauguguugagaaugguaaugaauuaacuccauuuuaaauguagaaugcguaucacuccaauaugaaugcccuaaugaauccuaagauuuguagguuuuguguacuaguaugaaaauuacuaaagauggaaaaaucacauguuggagacauaagauacaaaccuuuuuguuuucugaaaauacaaccucugauuucugauuccuuguuguaauaugguguaauuauacuagauuguaauuuuguuguuagauuauacuuuuuuaaguucaguguuugaggacagacuuucauuugguuaguaguauuauggcagcuagcagcuaaauaugauaaaguguacaaucaaaaggauauuuuuaaugaagauauuaguggucuaacaugucauuucagauacauagcugaaauguaguaaaaucaguuuuacuacaaauaaacuugcauaagguuuauaaauuuauaaguuuauaaaucaacuuggguaaaguguaaauaaacuugcacucgugguuucucugaagucuccugagcuaacuuugcauaaagguguuauucuguacuucgaggaagugaauuauuggggucaaccacauuuuuuuuccuuccuacagucugauugcccuuuuuaguuuuuaggaucuuuguggcugcaucauuuuuccccuuuugaacugugcauuuucuaaccccauacuuaaauauucucauaaccuccaaauuauuaauuagaugcaacauucagugguauauuacuggaguuucugauuucugcccacuauaggaaugugcuuccugagaagauugggaucgugauuauaauaauaguuaacaggggaugaguacuuucuaggugccaggcacuguucucucugauacuuuauuugauguauuguuguuauucccauucuuuaaaugaugcacagagagguuagguaagugacuuacuaccaagugucagggccauuaagggucaggauucugaauuccugaaaugaugaaauuuagcuugaagaaauugguuugauuuccugcuuaguuuucaauuucaugguggucuuugauuguauuuugugcuauaacacugccuuagcauccuauaacuauaguuacaguguuauauuaccauuuuuuauuguuaauacaaagccaucaugaaauaauucaguuuaugugccagcuuuuuuuguuacuaauucuugaaccuuggcgcuguacuucuucauguggaugccuguuaaggaaagauaaaguuagaaaucuuugacccugcuaggaaauuugucuuuguuauauugggagcucauaaaacugaaguauucaaaaguuagaauacauacacacaagaaaaauuaguaacuaauuuaauaauguuuucuuugcacaugucucuguugucuuuuggucagagugaagcuaaauguguuuuucacauaauuuguagccuauaugaaguccuggacaugugguaugguuggaaggacuguugaugagguuuauugucucucuuuauucuuuuauguuguuaguguccccauacaacggggcggggggaguggggacaaaaugauaacuugcuuuauauaugaagccuuggguuugaaucauacuguuaucacauuuccuaugucccuauccugucuccugcagguuuucuuucuugguuuucuuuuuugguuuucuuucuuccuuucuuccuuucuuuuccuuucuuuccuuucuuccuuuuuucuuuccuuuucuuuuuuccuuucuuuccuucauuucucuccuuugcuccuuuaguuuguuucuuuguuucuuugguuuguuucuuuguuucuuugguuuguuucuuuguuucuuuaguuuguuucuuuguuucuuuguuucuuucaacaggucucacugucgcccagguuggagugcaguggugggaucucagcucacugcaaccuccaccucucggguucaagccagucucaugcuucagccuuccggguagcugagauuacaggcaugugccaccauuccuggcuauuuuuugcauuuuuaguagagaugagguuucgccauguuggccaggcugaucucaaguuaucugccugccucagcccuccaaagugcuggaauuacaggcaugagacaccggguccagcuuccagcagguuuucuuuaggagggauauuuuacaaugcuguaaguuuuuccuaacgagaauuaucauagcacuacauguucugucuucaguaagugauacaagcuuacugaugauguuguaguuauguucauugguggucggguguacauugaaacuuuaacacauaauagccucuccugugagcagugguuccuguugguaagauacuuuacuaagggaaggaaugugaggugucgcuggggagaguuuacccaaauaaggauggacuuucugucuuuguuucaucaguccugguaauagaauguuugaauagauagcucuaggcauuacauacuuucauaaauaugauuauuguaauuaccucuuuggcccaguugcuaguaaauuagggaccccuuaaugauuuauuuccuguuuauucacccugaugaagaacuuguaucucuuuuaaacuguacuuuaucgccuuucucaaauuccaagauucucaucacauuuuuuuucuucccaaacucuaaauaaccuuuuaauauuaaguaucuuuguggaaacauuguuuucuuuuucuaucccaauuuuuaaagcuuuuuuaaaaaaaagagugcuuuuguugggauguacauuuuccaaaugcaaaaacauuuaugauucugugucucuuauaaaauaugacacucucuacuuuucucucauuuauuuagugccaccuauguguguaauuucauuacccacagcagucuuaggaggcuggucgaguuccuuauuugcagaugaggaaucugagguccagagaucacuucuuggugagagucucacagcuauuaaguauuagagccaagauuuugaacguaggucugauucacagcaaaaccguuaaccacuaaguacacugacuccaguaagagcccuaguccucacccaauacacuuuaauuccccugugcauucauucaaauucauugaauuugcugccuuuggaaaccucucaggaaccuccucaaccucucuucucuacagacaucagcuuugccugauagguagggaucauagcaaaacacaguuuuccaagguggugauagguggagugauagugcucuggagauggccaaagaaggaagguaugaguguaucugugggugggugagugguggauaaggggaaggacagagccaaaagcgacggcuauuggaaaaacuaugaugagaaacaggaagauggaaccuuguuggaauuagugaaagaccuuagaauucacaggagguauuuguccuucacgcgaguguagaccaaacguaaccuaugaguuucuuuuauuccacuuauuaaagcagcaaccaaagguauuauauaccuucuguauucacuuaaaaugacugauuuugaaaaagucaugcaaacauccauuuacagauaagccucauuaacucaaaggcaguggcccuguugggcucugaugauuacucaaaccauuucugacacucugacacuacauccggaaaucauccggaaaugcauucagagccugcaaaagcuuuuuuuuuuuuuuuuuuuuuuuuugaauagcuacagcacuugcagaucuuccuccuuugagagaauauuugauuuuaggaaauaagcaaauguagauaaguaugauucaacugggcaauaacuuuuaggcaaagagaaaaaaacaaaauauagcaauguaguaauaaggcugauauuauagugcuuuuaugaugagucugaaaacagucuccaacauuuguaaauguuuuaaaucgggucugucuacuacaguagcccuuaagccauauguagcuauugagcacuugacauguugcaagagugaauuggagacugauuuuaauuuuauuuaauuuuaauguaaguagucgcacaugacccguggcuacuaugguagauggcauaguuuuagacaagggcaguagucuuggguagauacuugauuuacuuagaacauuucuuuaccuagcuguaacaagguucuaauagcugauuaaaggacaacauuuuuagcauguaauauacaguaaggaacuaauguuaauuacugccaagauguauaaacauuaugaaaccuuaaacaaggaugaacacagaagcaguggcccuucuuuguaaauaaggggucaguuacuuccuaauaggugucuuaguuuuaguuaauaaucuaauagcacccccaaaaagcaaacuguuaauuuguuauuagccauccuguaaagacaagggagaaaucggggccaggagaguccucuuucccauucuccauaauuuuuacgaccuauagaaauaagagccuaagagugaccaguuccugcaaccuaacucaaaauuaggccucucuguugaaguaauagugaggcaaacaaucccuugaagcacuggggcaugcacccuuaugaaaucuaauaauucuaaaauaucauuggcaguauuaagcuagaguucucaaaauaugcuguagaaaauauuggucauuuaaauauagcugaguaaaaauaagcaagaucaaaaugauaagaaaauguugauuucuccccuuuugaaccaguaacuaacuauaaggguauauacccaugcuuaacuuaaaaauaauuauuuagccaccuuggguauagcacaacauauggaugccauuauaguccaccuugaucuuacaaggaagcuuucuuuuagcguagcuuuacuuuuauuuaagcauuauugaagaagcuugguaucucuguuuaaguugcuucuguaucaguguuuuccagggcccugucucagcuuccauaguuuuccuuaagagcagcuaauuaaugcuucacuccauaugcuuuaauuugauauuuugggaaguuucauuuuuuaaaauaaucuuuuuauaucauaggccuuugaagacauauuuguuuacaaagacaucugcauugaaccauuuguuuuuaaaaacauguaucgggcauguccuauauaccagaaacuaugccauuuacugaggacaccgaaguuagagaauggucuuaauccgaacuaguuauugucucacuauccaauauggauaucaaacauucagcgucaugaggauuuacuacuguguuuucucccaagaguuuuauaauuuuagcucuuauauuuaggucuuugaugcauauucauugauuuuuuuuuguaugcaguaugagguaaagguugaaacguauucuuuuugcauguggguguccacuugucccagcuucauuuuuugaaaacacuauacuuuccccauugaauugucuuggcuucuuuguugacaaaggauuuauuauuucugccacaacccagcuguuucucacugucuaaaccuuuaugccugcugccccguaggcuuaguggaaugccucuccauccuccacucucuuuuguuuagcuaguacuuccuuauccuuuaaggggucaguaggaaccucaccuucuucaguauguuuuccuuugucuuaucaaccuaccaccaucacccacacacauaccuuuucccuaaggcugggauaggaaccucuuaggcaaugaucuauuugauaaguacucacugaguucauacuagacacucugcaguauauccguaaaugaaguaaaaccugacaccacccucagaaaacuuacuguuagugagaaaaugggcuauaauaauagagugggguaaguuuauuguagggauaagcauaggaugcuaugagaaugcagaggacaggaauuuaaccuagacuucucaguucucccguugaaguugacaucugaacugaaaucuggaagaccaguaagagauagcuauguaaaaagaggggaaggacaauaggaaagaaggaauggagagaggcccagaaacuacagaguauggcacaaguaguuuagcauuguugggucacaaauucuaaggauaugaaagauaaaguugaagaagugguggggcuggggaggacagcuccuguagagccuuuuacagcgggagaaggaguuuggcuaugguccugcaggcagggagaaaccacugaaggggagaaacauacagaauaaauuugaguaagaagcuuaaaucuccccaagcccuuuuaaaauaaauuaagauauaaagccuuuggguuucuuuaugcuuuguccuauucuucuaauuguccaaaacaaaacaaaaaccuuccuuuucuguaccuauuaaaagguuaauuuuauaaaguuacagacagcaugcugauuaaagaauucuugauaauuagcuauuuugucugucuuuguguagauuacuaacaauugugucaucagauuuaaaagaucuaaaccucuggacuuuauauauuuuuucuacaaguacugugagauugagaacuuaauucaacucuaguaacuggacuuuuuaguguuguuugcagcauaugauuguuaaagaaaguuuaguauauuugugugugcguauauauauauauauagauagauagauagauuugagguuauauuuaaucauugacuauugguauucuaagauuuuaaggagagaaagguagguuacaauauauggcugauauaugguucuggaacaauuuucuuaguuuucaguaauucuaccuaaaauguacguccagcuuugcacucacuaccacauuguaauuuccaguauacuugucuauuuuucgagauguugaaaucuguggagaauuuuuucucauguuuaguguuuuagcuauguuuaucucuaggguauagcacauacaagguggcaauauagaugugcuuaaugaauaaaaugaucuucaaaaacugaccuucauuugaaguucuauuuuauucauaaacacauaaaacguuugguaucacuguaaaauuuaacuaaaaacaaaaacuaucuuuaagcucacaaguuaauuuaacguuuuuucuuacacaggcauuuguaaaggauguucaugaagauucaauaacaguugcauuugaaaacaaguaagugucucguuauauaauuuuaaugaugagguucuuuaauauuuuaugcuaauucuauucuucauuuuuuaaaaauucaaguccaguuugagugcuuuucaggaauggaucuucauguuacugacugagaaguuucugaacaacucaguauuaaacuaauggaaugacuguuucugcuaauguccuggaggucccuuauuguaugguauugauccuuacgucuuaauucccuugaaugugaagaaagaaaccagagagucuuguguauuaguaacuggaaguucgcauaggaguauuuguaaauuuuaaaaagauaguaaugaaaagauucauggguauugcuaaaaaguuguaugugaguucuuuaacauuaaaucuaaaacugaugguuuuaguugucuaguauauuuuauggaaacagucauguuuaccuauuaucugauuuuuuuuaauguuucauauguucagcaauagcaguagcugaucuuuucuguucucuuuugcuagaugaagaaauaaaaacagucauaggccuaggaauauuaacuguaugaaagcaucaauaguauagauguuaacauuuuauuggagaacacaagucucuugacuaaauguuuugaaugcuaauaaaggcuauuuucaggguagcuguugguaagauuguaaaguacauauaaacuccuuagucaaaguguagauguggcuaugaucuuaggauuuuacuaaacucugauggaugguuaacaguuaucauuuuuuuggcucuuauauaccaagaaaauuaauaauauaucaaaagcaggcugcaaaucuauagagacagaaaguagauuagugauugcuugugcuggggcugguggggagaacauagcuaaagaguacaggauuuuuguguguguggcaaugaaaauguuguaaaauugacugguaauuauugcacauaacuguaaaccuucuauaaaccauugaauuguacauuuaaauugaugaauuauaaugauauguggauuaugucugcuaaaauguaguaugugacccaggcauacugagcaauaaauacacacaucuugcuucuaaaguuuaaaaccaggccuguguuucagugucuagaaaauauauuucauaauugaacuuagcagauucuuuuggcuagcaacaggacaaaguaguauccuuagaugccugaaacacguguagggggacagagauaaaaggauuaaaagcaucuaacccuauuucuggcucuggacuaauaaucgcagaccaaaauacaaguuugaauaguagaauaccuuucccugaauacauaaagccaaaaguuuuaguauuugucucuucgcuguuucauauauccauggcuaugcaauagacaacagcaucacaccaacagaggaaucuuugauaacuuggaggguauuuuuuucuuacaauuauacacuuuaucuacuuacuuacaucacuagguaaaugcuguuucccauaaagggagaguugucuuuauuugcuacucuuuuaguuuuuccuguagucuauaaucuaaaguguuaagcaaacacucauuuccucuaugcauuuaagaauuugucuaguuuauacauugauuuauuagaucacuucuuuuuaauuuucaaucagauuucuaccauaaacuuaaaauuauuucaucuuuggaccuuccaauuauuuaucuccuguaccauaucugcaugaaaguuucucuucaagcucuuugucauccugggaguuugaaauagaucauugauuuucccuuguguucauggaguauguuugcaauacaacacuggguuugagcacaucaauaggauuuaauaggucuccaccaaaguaaucucuuugcccuuccuuguguguuuccuuuuugguuuucuguuagaaacaaaacgaaaacaguguuuuguaaaacaccagauuguauuuacccuuucuuuccuuucaaucaggaagaagcuccuguuacugauagcagauuguuuuaggugcuuuguuuuuaggugcuuccuaaaccuuccauaaagcauaaagguguuuucauauuucacauuuuuuaauaaggaauuugaauuuuuaucuguauacacuuaaaaucauuauuuuuuccuuggaaccauugaguuauauauuauuauaugcuuuaaaaucaaauuuagcaaugaauguauaacaucuauuagguguguauaauaacucagaggaggguucaguuaauuuaggcccuaaucagauuuccacaaauucugacuuaauauuugcccgcuuauauaacagcucuucuuuaacaaaaacaaguacuuuucucaauagaauuuuacuaagaaagcucuuuaguaaaacaucgacauuauacauacaacauaucucaguaucugcugaugaagaacaccaaaaagaacccagaugugacugcuccggaaguugaauccucaguauuuuugcaaaguuugucuuucaguauuuuauuugugugugugugugugugugugugugugugugucuauauauauauauauuuuuuuuuuuuuaaagacaggaucucacucugucaccuaggcuggagugcaguggcaugaucauggcucacuguaaccuugaacuccugagcuugagcuauccucccaccucagccucccgaguagcugggacuauaggcacauaccacugcaccuaauuuuuuuuuuuuuuuaauaauuuguuguaaagaucaggucuuaccuuguugcccaggcugcucuugaaguccuggccugaagcagugcucccaccucagccucccaaagcucugggauuauaggcuugagccaccgcauccuaauauuuuauauuuuuauggauauaaaaaauaauuugguaucuuucagaguuguuuaauaucauuuuaaauuuaaaaacauaggcaacuuaaacuccuauaggcugucuccaucggguuucugugguuuaggagaccccaccaucccagugcaugcugauaacgucauacugaucagcauccagcuacccacagcaagaauugaccaccucgugggaucuaaaauuuaaagggggaaaagugaguugugaauugcuaaugugcugauagccccauuuugcuugggaauuagagggcaguuuuugugguccuuggaaugugguuaaaauucuucugcaaguggaagcauauuuauauuacuaacaauuacugguacuaauauucaaauauugaaggaaauuucuguuguggacuuauguuuaaagcucuuagaaguugaaauuauuggaaagaagacuuguuuugaaaaucauaauguugcuguauuguguuuagagaaauauuccaaacgggaguaggcugcugugcugcaugcagacuuugcugaaauguuacuauauugccguuaugucccacucagcaaaaacugaugauuuuaaagcuuuugcuucuugaaacuagaaaaagaggggucagccuuaaccaaaaguugauggcagaguggucauuauuucaguuaaacaugaaaagcauguuaaauaauuguauguuugcuuauuuacagcuggcagccugauaggcagauuccauuucaugaugucagauucccaccuccuguagguuauaauaaagauauaaaugaaagugaugaaguugaggugaguuuucccugccauaaagucauuuagcacugaaagagugggguuaauuuaucuguguuuuuuuuuaauacuuugucuuuaacacuguuuaaauuacuuugagaauuacagcuggaauggacacgugcuuuugacuaacucaucuuauuaauaauucaaaaugauacaugaugcuuacauuuggcuauuugagcaguacucagagcauguauuugaaagucacugccgcaaguuccuuugcccacuaguaauucuuuucuccuucucucaauuucugaaucuuugaauaguauguuguuuguuuacaacuguguccccauuguaagcaaaauggauuaugaaaauuaauuuuacacaggaaagaaaucaugcuuuauuacaaaauaguauacuagaauuucuuuaaguagcagugaaucuucuugguauauuuuuaaaaaccuacaagcuuuaguuuauacauauugguaaaaucucuuuuucacagguuauaccgugaacuaccugcuuaucucccguugagcucuuugaccaaaaugugcuauggagaucuaacaugugaacagaaauguuguguuugugauuucuuucuccauuagaaauugguuuuguauuuaaggcgcuuacagugccucauauaguuugugugguaucuucucuccuuuguauccuuucacauacuccauuuugagcugcuucucuucuuuuucuacaauaauaagcauaaugccuuacuauuaguuaauaauaguugccguuccaugaauauuuguaguaugaaggaugucgcuaaguagacauuugugcaggugaggcagagugguucuagguccuguccuucaguucuuuauuuauuuauuuauuuauuuuuugagauggagucucacucuugucauccaggagugcaauggcgcgaucuuggcucccugcaaccuccgccucccggguucuagcgauucuucugccucagccuccugaguagcugggauuacagucgcccaccaccacgcccagauaauuuuuauauuuuuaguagagacgggguuucaccauguuggucaggcuagucucgaacuccugaccucaggugauccacucgccucggccucccaaagugcugggauuacagaugugagccaccaugcccagcugguccuugaauucuuauuugcugcacuagguaguaaagguguagcaaaaacaggacagaaucuucugccuuugaugaaaucacauuccaguaaggauagcuaauaugacagaugugagucuuaaagaaaaaaaaagggagaggaugaaaggugauuuagggacaggauugcuguuucagagaguagucagggaagaucucucaauguccaggccuguguuuuucucucuacaguuuuaaaguggacauaggauauaguguuauuuauuuuccaaaaauguaaccaaucucuacuagguguaagcagcugggcuugguuuugcaagggaucuuaauagggaacagaaacacuguguaugcuuagcuguccacuuccccagaagacuguaagcucucugaaggcaagacccaggucuuuggucuguauuaggaguacccagaauaguguuugauggagggaugaaagggacuuuuucuccccagcuuggucacuugacagaucgggaccaaugagauaccauugcuaggaugaccucacugucuuacacaccgauucguugagguaauuucucuggcuagaguaguugagaaagauggaagcaagagggaaagguauguuaaguuguauucagucacuguauugugugaucauuaacuuugguuguaaaagggagacaaguucgagcuuuuacucuacuugucagcccuagacuuuguaccucucuuggccucaugucuuuaucccccuugucuuucuuauuucucuuuucugcuucugaguaucccugucucucuguccauauauacucuguugucucuuuuccuauuaaccuugauuugcuagggucuucaugaaagguuccaugcuguacaucuuaagugaacuuugaaguggucaucaaagagaucaguuagaagaacugaucugcagugugugacagaccaggaaagugauauccagaggauugccaccaugaaguugucauuuuuaguggagaggaagcaggagaccagaaagugaccaaggaucuguccauuuaguuccaggagauaugacugccagagugguauccuuagugggcugaauguucaguggucuuacuuuagugaccaagcaacaagacaguagggcauggucaguaacuuucagucaauuuuugcuuacuaggauaaagcaaaaauaagcuuauacauuuuuagauacauuuuuuguaacuugcugaguacccaaggaaagugugcuuguauuuaugggcgucuauuuucagagcacuaauuauugcugaauuagaacagaaauauaggaaaacugauuuuuacaaggagcuucaaagcaaucucagguaguuucugauuauguaucucugccuaccucgggguacauagacaggguuacaauuugguugaggauauaugacaugugguuuuuaaagacaccuaggggcauuuuaagaaaauuuccucgauaucugaaaaucuguagauuucaaaauuauguuaaucaugaaauauucuguguuguaauuuuuguguagguguauuccagagcaaaugaaaaagagccuugcuguuggugguuagcuaaagugaggaugauaaagggugagguaggaaaaugccuauuuaaauuuuuuucuuauauuguuuccuuuuuuuaaacccagguuguacauucccguguggauuucuauuuugaaguaauaucuaauuuugaguaauuuaauuaaaauguuuucacuauguguucaguauguuucuguuggucauaaauuuuuucacauagauuauuuauuuuaaaauaacugaauagggagaacuucuuauucuuacuuuaaaaauugugauuagaagugacuuuuauuuauuucucaguuuuaugugauagaauaugcagcaugugaugcaacuuacaaugaaauugucacaauugaacgucuaagaucuguuaaucccaacaaaccugccacaaaagauacuuuccauaagaucaagcuggaugugccagaagacuuacggcaaauguaaguugauacacaagaaaugcugagaacuuggaagugauaugcaauuaguuuagaagaauuucuaguaguuuaaaauuuuuuaaacuacuagaaauugauuuuaaauuugguggacuuuggcaaaaaugguuugguuugcaagagcaauggagaaaaaacuuauuuaacuuuuccuacuuauagaaucaaggcagccuugcgcuuguuuaaacuuacuuggcuauacacgugucugauguacauaauguacauuuguuuucuaaacuaacuuuguucauucuaagauuuaaaaacugaucaaacaaaugugauaauucugucauaagucacaaacuauaaacgauuucuccguuuuuuucucuuuuaccuaaaauguuuucagauaaauguguaauaaguagagccaaagaagcuuuaaaaagucaucucaucuuacaauccuugaucuggaauaaugcuuaaagacuauagaagagacgcauuuuuauuuuuuacagauuuuauuaagugaauacaguacguuugauuuggacauguuguugaacauuaaauugcaguucagaauacauagaaauccucccuuuucuagagauuguguauguguguaaauuuuugugccuucugguucauguacguuuccuucucucccucaaaucguuuagcaguuucuuaccccauucuccgugaugugcuuauuucauauugcaugccuguaucaaaacaucucauaugccccauaaauauauauaccuacuauguacccacaaaacuaaaaauuaaaaaaaaaggaaaaaaaaaggccugcaacaagagaagaagaaagaaaucagauacccuguagguagcuaucucccaaaaguuuucaauaguugacuuaagaaaacuacugacuuguauguaacugaaaucaggaaaccuguaguguagagugguuccccugaauaugucucuuuugguaaucuaagcuguauuucagaaauguacagaaaaggagcuaagcuucuaaauggauauagcauauuuugcauaaaucaaauuuaauaugaauccaugauucuuguauguguaaaucugccugcauuuauuuaugucaguaguugguaauuauucaucuuaauuuuuuuuuuuaaauuucuaggugugccaaagaggcggcacauaaggauuuuaaaaaggcaguuggugccuuuucuguaacuuaugauccagaaaauuaucagcuugucauuuuggugagcauuuuugaguuguuuauuuuuaguuuaauucaucuggggcaauugccuugauaauaauguuguuaauuuaaaucauuuaguccaucaaugaagucaccucaaagcgagcacauaugcugauugacaugcacuuucggagucugcgcacuaaguugucucugauaaugagaaaugaagaagcuaguaagcagcuggagguaugucacuuucccuagcacugcuuguaaggguaccuaggaacgauuaacuguaucauuccacaacuugaauauggggagcuugucauuuauuuacugcuucuuaacaauuccuuagguucuauaguuggaaaauuguacaaagcauaaucauacuaaaguuuccaugccugagguuucaaaauuaaacagcagcuuauguauauuaagggacuucugguacuuucacuuuuacuagaaguuuaucaaaguugcuaauaaaaugcggcaaugcuucuuccauauaacauguugucauuaaaaauacuagagaauauuuaaauaucuaaucauauuccucucauuauguauguuuaucuuuguuuaaaaggguauagaacuucuucauucuaauugguugucauucuuuaaaacuccugucuucagauucccgccagaggcuauuucccuaacuuacuauuuugucucuuaaggugcauuuuaucuacuuuuauuaauccuccaauaauuuucaucaccauauauuuguuuucauugauaacuaucaaguacguccauccauuacuauagaaacuaaguggaucuuagaugaaugugccagcucuacuauauuccugucaaauuccagaguucgucaucauuauucauuagaaggaaaacaccacacauuugaaauaguaaagaaaaaaaggaguuccaaacugcauuuuaggagaaaagguagucaagacuguguucuuauaaaaacccugugaaauuugccaccugucaacuugauguaugaugcugaacucuuagcagaaggggaaaaguuuaaucuccuuuugccacuuuguuuuuucuuaaggccauggaggucuguuuaauuggucuuugcucucauucuuucuugaugucccuguguucaugauuuugugguuccuucagugauucucucauaacuuuuagcccagagcugccuccuuacuuugauugugaguauuaugaaaauauacucauaugccucuuaaacaucgaauuauucuuaaaugaucuaucauacuuuuggcuaaccauuuaucagugaauuaucaaugaaaaagaacgaaccagauuaaugaaccaggacucaaaaaacaugacuucuugaaaaguccuagaauuauuuuauagauuuuauuacucuagucuaaaaaaaauggguauugcacuuuuaaauuauuuaugcuaguuguauucauucauucaaauuaucaggucuguugaacaaugagaaacuaguaugcaugccuaucuuucuucacuacuaauauuaaagagauuuacauguuccuauaagaaauucccauuuuucaacaugagccacuaauacguuugguuuucauuaauggcaugcuagaacugaacacuaaauuuugauaaugguauuuaaagacagugguuauccacaaguuugggaugucaguguaacuuaguuucgucaucacuggauauuuacaagugcucaucauaauuguggauccagaucacaaggucuuacggacucuggucucauguuagcuuucagaugcuuacuaaguuuuuaauuuuugacauuuuuugauuauucaguuuaacuacuguaccaacaauuuuugauuccuuagguuuugagggaggugucauuuuaaugucauuucaacagaggaauguuuagaccacaguaccuaaugauguuauaaaaaauggcacuguuuccagaaaauauauacugauaccuuuuaauaaaaaugaagcgaauaaaauuuucuauaaagaugauauuuaaacauuuuuuuaccuaaauaaguaacauugaguuugucagaccgagugagcugguuuuuacuggggaacauuugaccugcuucuuaguuauuauauugcugaugucauugguuaacuaaggcagccuugugauaaguuuucagcaguuaccuuggaaaaugucaacaaguucuuuccuauuaacaaaaacauauaaaaugucauagaccuuuaguaaccuaaaaaguacuuaggcugugagagguauuuucuaaaaccuguuaguuuuaaccuaaaacuauuaauaauuuauggaccccucauauacagggucaagauaauuuacauggcuggccuaaauacaguugucguaauaguugauaaaguguauucaucagacguccauuucucuucagaguucaaggcagcuugccucgagauuucaugaacaguuuaucguaagagaagaucugaugggucuagcuauugguacucauggugcuaauauucagcaagcuagaaaaguaccuggggucacugcuauugaucuagaugaagauaccugcacauuucauauuuauggagagguaaauauuuuacugcauaguuuuuuuuuccccaaacaaguauuucagcuggcuaaucuuuugucuuaaaauguuuccccuuuuauuaggaucaggaugcagugaaaaaagcuagaagcuuucucgaauuugcugaagauguaauacaaguuccaaggaacuuaguagguaagucagaaguaucuguugacauauaguacaacaacuaaguuuagguaaacaguuuauuuauagugauagaauuccauuuuuucuuacuggaggguaucauuuaauugaaacauagucuuugaaauaugaucuguucuuuuuuuuuauuauuuaaguuuuaggguacaugugcacaaugugcagguuaguuacauauguauacacgugacaugcuggugcgcugcacccacuaacuugucaucuagcauuagguauaucucccaacgcuaucccuccccccuccccccaccccacaacaguccccagagugugauguuccccuuccuguguccauguguucucauuguucaaucgaucuguucuuacagcauacaaaaaaauauuuguuaaguaugaugcucaaagguuacauuuucagaagguauucaaaagagauugcuuuucuaguucaaaccuacuaauaccugaaaggauaaaucuugcccagcccuccugacuguauaccuuuuauaucuuaaaauuaaauaauuuuucaaaaugaaugauauuuggggacuuuaugauuugaaauagauuuguauuugaucuuucuuaugggacuauaaaaugauagcauucauuuuaauuaucucaggguugaagaucugaacauagguuacuuaaaucuaaaaagucccaaagcuagaagaaacuucagaugucucugggacuuucugcaaagucaauaguaauucuccauuuugacuugaguaguguuuuaucaccaucaccaucgugaguaucagcaaauauuuaggagcucuucaccaauacuccuaaaugcugcagauaucuuuaguagaacauaucaaaaccaggugcaguuuuaucaagaaagcuacauauguuuuuaauuuguaaauaaaauugggacauacugccuauauguuuuuuaucuuuuaaacuugagaucauggccauuuuauauaaaguaauacauguucuuuggaaacuuuaaagaagaaagcaaggacuucucauacauucuguuuacguaguuucaaugcuaauuuagccugcuuuuuugucagcauagacucauaaacaucuuccuugucauuaacaaacacuagaaaugauaaauguaucucccaaagaaaauuagcuugaagauaaagugcaaauaguaggaaaauaaugcagaaguguuagcucaacuguguacuacagacaacuggagaaauguguuuguaauguuacuaagguaacuugcauaccaauuguauguguacagaauguaugcauagcgcaagauaaagugcuaaucucaagacaguugggugaugaauaauauuuauuuucuucuuuacagcuugucaagcaauugcauaccuuuuguaguuagaaagguuauuguaaauuuaggaauucuuauggaaaaagagcugguaguuguuuuguuuuuuuuuuuuaauagcaaaugaguagagaauuaugugucagauucauuaaaguugguuuugaagauggcaugaugguaguggggaaagugcuugggcauuggaguuggaucuggauuucaguccuacuuuauucuuugguggcaaugugagcgugggucacugucuuagccccccugagaauuauuuuucuuaccuaucaaaugugauaauaggauccaccucauagaguugaugugauaauuaaauuggaagauauaguaggggacaauucuggacacaguaggggacucuguucuucaccuuauucaaaacaacuccauuucaguagaacagaaucacaguaaauugcucuuugggauuuggaaauaaguguaauguagaauuggauuauuugcuauuaaauauuaaaaguagauucuaccugugguuaccuggaaagaagaggaucucagaaauaaccagaaagacugcuaaaaguaaaucagccuuguuuuuguuuuguuguuucuaguuaguaaaaugagauaauucuguuuuagagaugguccacugcaacacugggaacguuggaacuuuucagaaagcauuuuuguguaagauucugcaaggcagaucuuuagagaggugucauaaucaguuuugcauguguuuuguuugagucaaccaacguuauuugugaucucuauuuuucacaaacucucuuugguaugugcacuaauuuaucuuuucauuaaaauuggauucuucacucacuaagaaugaauugguaugacuauucagucagcuauaguuaacacacaguacuuaggauaauuaagauauuaucuuaauaaaaacauccccaaaucucauuuuucauuuuguuaacucacuuagaucuuuauuaaagucaacauuaauucaugaaaauguaaguguugcaguuuaaaaucaaacugugugaagacuccaaguagcuucucucaccucaccuuuccccuuuucguuauagaagaacagaaauaauugacagaaggaccuagaccaagaauccugauuuaauggugucagaucuguucuaugaccagucaaagaguuucuaggggugaaugaggcagccacacacagcaagaaugucaaagcuaugcucugauuacaagagccacaagaauuuuuugugagaaggcuuuucacugaguucuuaucuagcauuggcucaaagcaaauuuuugcuuccaucuuuucccccaacuuugccuugagcuuugccuuuaaaggcgaaaaggaaaaaauggaagaugagauggugagggcaagcacaugguggauguggccaauguaaggguacuuagguaccuugggugagcccucagaaucagauguaguucacauguacauuuccagaauuaguaauucuuaaguuuguaaugucuugcuuuaccacucgugucaugaugcaaaugaaagcagucauuuuccaguaauguauaugauuguaaaauaaauaaggaaaugaucaaguaccuauuuuuuacugguacuugaaaucccaaguuuuaauagauguuacugaaaaauacuuaaauugguuuaaagcuuuuucauugugguuuugaguuaucuuaaaguggguuuucuuaaucuuuuacucugugacuaaucccuucacuuuuuaauacauugcuaaaguuuguaaguaaugcacaggagugauacucuguuaacacauugaccuugaagaauuuguauuccuuuuggauguauguauagcugcuuaagccacuuucagacuuagauuaucuuuuauaaaugugccuuccauacagaauucugaaaauauuuaccauggacaaagaagcagauuuaaaucagguacagacaagaauugaaaguguugaauaagugaauauauuucccauucucucuacuuuuuucuuaauucuuauagaacuuugcagaaagaaugauacauaccacaguaccagcaaguuuaaagcguacccuuuugugcaaaaauaagagguuaucuuugaacugccuuaaaaauccaaaauuacccuaucaguuugcaaguauuaaucaacucugguaccugaccaaaggaguuuaaacaaugauguccuaauuaaacagaaaaccagauuaaccaucuuguugaaaagagucucuacuuugguuuugaaaucuuacaauucaauacauacacauacacauaaaaauaucuaucuauaugaauguaauaguuuacaguagggcugugcuuacugcuuugagguauguguuuuuaaaaccaaacuugauuuauuuauuucuuaggcaaaguaauaggaaaaaauggaaagcugauucaggagauuguggacaagucaggaguugugagggugaggauugaggcugaaaaugagaaaaauguuccacaagaagagguauguuacagugcgaauauuuuguggcacauauaauaaaaguaaaaguuuuuuaugugauauguugaggaccucuaauaugugcauaaagugaaugcaaauauucugauuaucaagcaugccugcuguaauuaauguuauaauuguagauaauggcccuucucuguccucuaaugcagugaguuuggauuagucacuuuauugaauucuuuuuuccugaucuuuaaaauggguaguuauaaauuuuuaaauaugagacauacaucacugggucgaguguuaauggcaauuuaauaaaauaauauauauguaaaugcuucguaaagcacuuuguaaauguuaauguugcugacaaaagcaaaauuggaacacagguuuucuggcuuucaucuuuucacuuuuuuaguguggggauuguguaguauguguguuuauucugugugcuuuaaauuuauuucugugcuuaauaucucuuccccauccuccuuaccuuuaaauucuguaacccuuuuaucuucauaaauauaugcuuuuuguagcagcuuuuaaaguauuugcaugggguagagaggugaggaugcaccuuucugugcaauaguacucuuaagauacugucucaucaaagagccguaauuuucacauauugucuagcuuucuuuuugaaagauucuuuuagcuaaaguuaaaucuuuuuuuucugcguacaauuuguauucgguaauuuuauaaaccaaaacuguuuauaauaacuuacauuuuuuaaaaauaugaugauugauaacacuaauagagcuaaauaaagucuuaaauugguccuuuuuuucucuuuuguguuuucuguuuuuuaccaaggaaauuaugccaccaaauucccuuccuuccaauaauucaaggguuggaccuaaugccccagaagaaaaaaaacauuuagauauaaaggaaaacagcacccauuuuucucaaccuaacaguacaaaaguccagaggguaagaauuacuugucacuuugaauuacaauacaaguaauuugucucagaugucacaauugguauuuuggauguuuucucugguuagacuuguaggcuacuuauguucuauuuuuuuuccaaauguaauugccagcuuaugagauacuacaaauuagugugauacauacuuuucaauuuauucacaguaacaacucuuaugccauaaacacaaaauaaugggguugcauuuaguggucacauuuuucuuuugacaguggacucucuuuuuuccaugccuucucucuuuaaauuuugcagguaucguagcucaaaauacaccuucuguuaguugcauuaguuacuacuugaaccauauuuuagaaacuaauuuucucuguuugaacuaaucuguuuagaaauggguuuaaaaguccugcagugaaaguccugcguucaggcuucuguguaucguuuguuauaguuaaugacaucccuugcauuccuuauacugcuuuagguguuaguggcuucaucaguuguagcaggggaaucccagaaaccugaacucaaggcuuggcagguaggaaaacauuccuugagaaauacacuuucaguuuauauuuuaauguuuauuccccuuguuaacaaagauuacaaaugauccucaggauuagggacuggagggaggaguguuuguggguauguggauccauugcccuggaguuaaagcuuaaacaccuucaugccgcuuguaaggcuuuuccuaauuacuugucuaguuaucaucuuuaaauuaucuucucccuugcacucuagagaaccuuaagccauacugaaguacuuugaguucucugaacauucucgugcuuauuuugcuucuagacauauguacagguuuacucugccuggaaugcuuuuucuccuccacaugucaccucauuuugaccuuauuccuuacaaagcuuuccuuguguacuugccgaagauccccacccccuugacugguucaagagccuuccccuucuguuuugcaaugugcucaccccuagcauagcacuuaaacauagauguuuauuuguugaucuccucaaccacauuguaaguucuuugagggcagggagagcuggugagaacuguuuauggaaaaaaauguuguggacucauggauuaaaagcaaaggugccauuuuacaaagaggacuauaacggcaaguggauuggauaugucucauugccgggcagcccauuauuccagaacacagaguaacuuuuuucugggguccguacuaaaggccaucauuccauucuugccuuucuucauuuuaauuuacuauucaggucuacucgugaagugcuuaaauuagaguggcccuugggguacuccagcaguuuagacauguugcaagaaaagauauucguaaauaauuugcuccgaagucaaucuaacuaaaucuguuacauaggauuuuaaagcuauuuuggugauauuugacccagagggaaggguguagcauucauuccaucacaugguauuuugggaaauaauacaguuaaaggcuuuuguaacaaauaaagcuuguuggagaaaaacccaacaugcagaaaugaauugccaguuauuaauuugcacaauuguuucuagguuucccuauaacuugugacaagaaguaguuguuuuuuuuuucccucuuaauauauauauauaugggcuaggaguacagacauuuagcauaugccuuuuaaaaaucuguucuuauguuaaguaguguccauagagagaaguucaaacuuuccuugugauucagccuuuuaaaauuuucagaguacauuauugaaauguguaugggcuugauaaaacuuaaugcuugucaauguaccuauuuuuuugucucacagauuauucagugcauuuuuauccugauguuuuuguuuguauuuuguguguacucuauuuacuugguuagcagaaaugauuuacuuuuuacuuuuguacccuugguauuucauuuugauuuuuuuuuuaagaauuugaucggccaggcgcgauggcucaugccuguagucccgacacuuugggaggccaaggcaggcagaucgccugagcccaggaauucgagaccagccugggcaauguggcgaaaccccgucucuacagaaaguacaaaaauuuagcuggguaugauggcaugcacguguugucccagcuauccaggaggcugaggugggaggaacaccuagggccuggggaggucgaggcuacagcgagccauuaucaugccacugcacuccagccuggauaacagaauaaaaagacccugucucaaaaaaaaaaaaaaaaaaagaggcggaggcgggcggaucacgaggucaggagaucgagaccaucccagcuaaaacagugaaacccugucucuacuaaaaaaacaaaacauuagccgggcguaguggcgggugccuguagucccagcuacuugggaggcugaggcaggagaauggcgugaacccgggagguggagcuugcagugagccgagaucccgccacugcacuccagccugggcgacagagcgagacuccgucucaaaaaaaaaaaaaaaaaaacaaaaaagaaaaaaaaaaaagaaaaaauuuugaucaggauaaagccuuucauaaaugaauuagagcaucuuauacuacucauuuuguuuauacaucucaugguaaagcuuguauaauuuugaauuauacauuuugugauuuugcugauacugaauacuagucuuuauaauaaucugauacguuuaaaagguugcuauugaucuauucguauucacaguagauguguaaaguaguauaucaacuacuuuuguuuucauauauugauuuauauuuacagcaaacauuuguauaccugcuguucaccagauccugugcuagggaauuagucguuauuugcauuuuucagauuaaucuaucauuacuuuuauaggaucauuguugcaauuucuuuuucaggguaugguaccauuuguuuuugugggaacaaaggacagcaucgcuaaugccacuguucuuuuggauuaucaccugaacuauuuaaaggugagaacagaaagaacuuuaacuucuaauccuuuuguacuaaaauauacaaacuuuauaguagaucuuucagcaguuaggacucauucuagccugugcaaaacacuguaugacuugucaaagguaauagagaaaauacguuguuuggcuuauaauuuuuuuaaaaauggaagucuuuauaaauuuaaguaccaauauaccaguuuucaauaaaauuuuauacuucccuuuauucuucucuuaaacccuuacacucaguuuaggcaauccuguacauagccuguuaauccauuugauccuuucuagcauuuugguuuuuuccagacaaaaaucugugucuauaacucuugccuuuauuguuccuuuuaugucauuuaucaaggaaaucuaagcauuucaugaaguucuuuguuuaaauguuuacccuauuuuucucuuuacuguuauucaaaauacaaacuauuugugucuucucauaaauguucaguuuaguuagugugaugcgguuaugccuccuuaaaauuucaaacuggaagauaggaacgaggaggcuacaagguguaguggagcaagcacuggaugggcaaugcagcaauuuacuuauaagacuucagcaaaugaacuagcugugugacuuuaggcaagucacuucccuacacuagaugcuucuugaaauuccuuuuggccaaaauguucuauacuuuaaugaaauggaaacugaucuacuucauuuucauaauguuuuauuuguauccauacauaucaaaauuauaauguagcugguauuaaauguuuuuaaaaagcauuucaacucuauuuauggcauuaagaauuuuuuugcugauuucuugaaagaaauaaaaaguacaugauuucugcuuguguguaaauaagaaugaaaggaagaaaaaguguaauacugggcaugccauucauucuuaugguggccaguuaauuaaaaguggaaagguuucauccagcaagguuuacauggguaggauaccucuuugauuuuuuuuuaaguauguuuauguguaaucucucugugugugugucucucucguaauuagcuuaaaucaucaugaaggccuggagaguuaggauugcauuguaucaaaucccuuguucuuuugacuaauguucuuucuuagauccuuugauuuauucucaagaauaucuucuuugguuaucagcagcugcccuguugccauucuuuccaucaccagaacuucccucguuugggccuggcaucucucaccaaaaggugacugcuuugccccagugggauaaccuggacuacucuucuguuuugcaagauauuccuauuccaugagcuauuacuauaccuuuggaggaagucacucacucagcugcagucucuccuuugcucaaauucuauguaaaacagauucugguguaacuauguaaauugcuaaugauggcagagcacagaugaaacggaccaaauccuuaccugaccuuucuuuuccagaagcugccacaaccaagauuuuagaaacuuagcuuuacaggagcuucuccaaugacuguucauguagacagucucuaugauaaccucugcuucacugagacgccuacuacuacuauaguuaugaaucugauuccccguagccaguaaaugagauguuuaugaguggauuggaaggacagugguuagaaaugagguuucaucugguuuuaacagaacccaacauacuggaagugcuuuuuguaagggucugucauuggaccccagguguauauuucuaucaacuaaauguauacuguuucucguacuuguuguagcagaguuguagucuuuaggaaguuuucaaggcaugauguaagaccuagcugucuggucagcuauuaaauaguuuuguuuuccccucaugaggaauagucagcauuuucaguugaugaaaaaaucauuguuccuuaaccauaguauauguucuuuuaaaacaaaagauggcccaaacucaaugcuuuguaaauuaagauauuaacuggcaaaucuauuuuaaucaagauuauuuacaaugugugauuuuuuaagguuagcugguuauaccuugaaugucauuuaucuauauucauacauuuuagcauguuuuauuuaauauccuaucaugaagaaguccccaaaauagcauaucugugccuuagcaguagaauaauuggauaauagugccaaauuagacaacuuuaaauuuuauucaguauaauuuuacugcugaguguuuuuguuauaucucuaauucuugacaucaauaaucuguuaucuguaguaauuuucuuuuuaaggagaucauucaauuuccugauaauucuguguaacaguguuuacuguaaauuuagaacugaaauugaaauauuccaguauauuuuuaucugaugaaaaggagaaagguuuuauuaaguaaaaugucaaauuauuuuuacuguuaucuuguauauuuuaaauaggaaguagaccaguugcguuuggagagauuacaaauugaugagcaguugcgacagauuggagcuaguucuagaccaccaccaaaucguacagauaaggaaaaaagcuaugugacugaugauggucaaggaaugggucgagguaguagaccuuacagaaauagggggcacggcagacgcgguccuggauauacuucagguacaaacuaagcauuuuacucaguaacuuuaucuguuccuagacuuauagcugcuaaucucuaauauucauuagaaccccauuauaacaauuugccgcuacaugguuuccaauucacaguggguuaaauuguguuacaggagacauagaguaaaaaccugaugauaaacacguagaguucacagggccggugcaaguucuguucaugcucugauuggggguaaaucugcaaagcccuuguguguugaugauuuucuuaaggccucuccugauuuuauaacuguauagucaaaacuuuuuucauuuguguacuguggcucauuuuuauuuugucagguaugugcuggucauacuugcuggauggacuguguaaaucaggggucugccucuuguggcucauaaggugauuuugagugacauggccaaagucagcccuaggcacagucaagaaguaggcgaaguuucucuuugccuucccagcuuuucuguccgugcuucuuucuucucucccaguaccuuucagugaaccugauccccaccugccagugccuacugucuuucuugcucaacaguguaucuccuuuguaacuugcuaaugaugguauaagguauaauccauuucacgcauauuugcauuucaaaaaggaacucuuuaagauggaaaagccuucaagauccacaggaaugaagcuauaauggugaagcuauaauuggucauuagcuccaacagaggaagagagagguaguagagcugauauucuggaguuggggagaguuaccuacuccuaaggccaaccuugaaccuaaccccuaaccccucucccaacagucuguucuuuuuacucaugaauuucugccucaccguggagcucuuuuucuccgcuccuguccucuaagucguuaaccccuucaggcauaaugaauuuauuauaguaauucuuuauuaaugaucaauuauuguaaugggagugggagggcagguuguggaccaaacaucaggcaagcauguaucugccuucagcuagauccaauccaugacccacaagagacccuucccugaagcaguugccaugguggccuccuuugccacccucucagaaaugaccaaaauauauacauuccccucuguccugggccaaaucuugcuaaaaggagcucucuuuuuagagguuuuguuuaucaggguaucacacuuaacugucguggauaaucuuuuccuccagagaguauagauguuuaaaggaacacagcuauuuaaugauauggcacaucaagguuugaacuuagguggcuaauaacauaccuuuuuaaaaaugagaaugaaacauguuuauaaccaaaauuaaccucaaauauugcaaagcccuucauuuugaguuuaaaauuuuguuuuaugaaauggaaagugauaauacucuuggugggcuuauaaauugggaagaguuuuggauuaccccugaaacgucucuggaagcuucuguuaacccucuuuuuuuuuuuuuuaaagucagacaaugguauauaacuuuuaacucucgauaggaacuaauucugaagcaucaaaugcuucugaaacagaaucugaccacagagacgaacucagugauuggucauuagcuccaacagaggaagagagggagagcuuccugcgcagaggagacggacggcggcguggagggggaggaagaggacaaggaggaagaggacguggaggaggcuucaaagguauggagaucuucauuaagaaaucaaagugaauuguaacagcugucuugaaguuccaugagaaauccuauugaugcaaugaacuguuaccaagaucccaucucucccguuuugugcugauaccauaggaaaggaucagccuuccacuuguguagaaagaaagaauauuaggcagccuuccuuaugguucauacagauauaugaauaaaugcugauaacuaauucagcaucuuggugggucuaaacagcaucccuucauuaacucacauugaccuguagaugcagaauuauaauaacugugaaauauuuucuguuacuuagcagcaggcuagauuauuagccauuguguaacuggaaucacugggguauugauuacauuucagauucugugguugguuuaaauagagggugugggaauaaagaacuuccaguaagcauuucagaaucaguaacuguugaaccuuuugaaaauauucucauaggaaacgacgaucacucccgaacagauaaucguccacguaauccaagagaggcuaaaggaagaacaacagauggaucccuucagguaaaaccugucugccucuuuucaucuuaauuguuugaauaugguaguuugagauuuaugaguuuauuuuacuuuauuaaaaacauguucaaagauuacaaauccaguuuaugugaaauauuuuaccuucaacauuacaauuguagucaaucuuaguucuuugugacaaguauacaaauaagaggauuucucuagagaauaugcagucugaguauuugugaagaccuugacagccacacuaugauuuuauuauuuauuauuuauuuuuauuuuuuugagacgggaguuucgcuuuuguugcccaggcuggagugcaauggcgcaaucucggcucagagcaaccucugccucccggguucaagugauucuccugccucagccuccugaguagcuggaauuacaggcauccacuaccaugcccagcuaauuuuuguauuuuuaguagagacgggguuucaccauguuggucaggcuggucuugaacucccaaccucaggugaucugcccaccuuggccucccagugugcugggauuacaggcgugagcacugugcccagccacacuaugauuuuaauaccacauugguagaccugcaaucccccagagaaggaacauccugggauguacuuagagaccucaguaaaccuuaugugucuuugcucccccaaauuaacagggauaggguauucucuuugaauagaaaauaaggaaaagaaggugucugucuuacaacuaauaaucaugauagacagagcugaugauauucagcuagucuccaugcuuggucagucaucugcuuauuuacagccaggaccuaguccgaggaucucuucucaauuggcugucaccagugcuaaaccaauuguuaaauaauuuuaaaauuaucuccugagcacauccaggcaccuuugcuaagugcuuuguguauguuuuaucucauuuaaucuuacagcaacccacugagguaguuuuauuauuccacuuuauaggugagugcacuguagcuucaguccuuugcccacagucacauagcuagcauauguccaaaugauagucaaaccuuagugucugauucucugaaucuauguugucgucuacuuuuucuguaacuuuuaauuauuaaguaguuaggguuccuuccugacuauggauucauuugggaccaucacccaagauuagugagagauacuuuuuaagacaaaguuuaugauggaauauuucuuggaauucauagcagcucaaaguaaguguuaacuauugguggguucuuaaggaccagcauguccaagggauagauagauugguaaauuacuguauguaccugucuuuuacaaagcuauaagauauuuaaguacccguuuuguaauuuuccacuuaaacugauauguuugaugaacuuggcagucuaacugcauugguuaaaaggaugcacauuuauauuucuaaaugaaauggaauacugaauuuaaaaggugauguuuucucuauuaaguaugaaaauagauacaaaucuggccaggcgcggugcucacgccuguagucccagcgcuuugggaggccaagguggucagaucaccugaggucaggaguucgagaccagccuggcuaacauggugaaaccccauuucuacuaaaaauacaaaaaauuagccagacguguuggcgggcaccuguaaucucagcuacucgggaggcugaggcaggagaaucgcuugaacccagguggcagagguugcagugagccaagaucuugccauugcacuccagccugagcaacaagagcaaaacaccaucucaaaaaaaaaaaaaaagggccaggcacgguggcgcacgccuguaaucccagcacuuugggaggccaaggcggguggaucacaaggucaggagaucgagaccauccuggcuaacauggugaaaccccaucucuacuaaaaauacaaaaaauuagccgggcaugguggcgggcaccuauagucccagcuacucaggaggcugaggcaggaggauggcgugaaccugggaggcggagcuugcagugagccaagaucgcgccacugcacuccagccugggcgacagagcgagacugucugggaaaaaaaaaaaaaaagauacaaaucaaaguacugaauccuugguaacgagacauuuaaaacacaugcacauacccacuacuuaaacauacuuugaaauuacaaccauuuggggauguuuuuagcauuugugcuugaaguagaucaauauuuguaguuguuuuaguuccauuugucacuguuaacuuucauuuguaccucuggaauuagcagugcuguauucagcauuggcacuuaaaauauuuuauagcucuuagaacacuauuuuuuaaauuacauugaucuuuauacucuccuaggauuccaguccuuccacaaauuauuauaugcaguuuucuuuauacuguuccauucuucagacagaguucagguuguaggaucaucugaauuuucuuagugaaauacaagccaguagaaaccaaagcucguguuuuucuacuguaugacuaugggagcucucaguauagagaaacuugaucauaccugugauagauauaaagauguaaauuaaagucuaguuagugaguuauuugaggguaaagccagaauaggaaaacauuuuguuucucuuuuccugggcuucacaaucuuuggagaauaacuaauuuuauuuuaacucuaguguuagaggcauguaugucuucugguaaucaguaauaguaauucauuuuaccuguuuguuucucacuguuuuauucuacuuagaagaagacaugauaggauugugaguuuuucucuaacuuuggaugcagugagaugaccaguguguuccaguuaaagaagaagaguguuuuaaaaucauaaaccaaauaaagaauccuaccuuacauuaauuucuugcacuucuucuguucucaucuccauuucucuuuuuaacauguggaauuuacacuucagguuuaaauuucuugucaggccaauuacagauuacaguaggauauggucuguguauauaacaacuauaacuuguuuuagaucagaguugacugcaauaaugaaaggaguguccacacuaaaacauuacagaauaccuccagugaagguagucggcugcgcacggguaaagaucguaaccagaagaaagagaagccagacagcguggauggucagcaaccacucgugaauggaguacccuaaacugcauaauucugaaguuauauuuccuauaccauuuccguaauucuuauuccauauuagaaaacuuuguuaggccaaagacaaauaguaggcaagauggcacagggcaugaaaugaacacaaauuaugcuaagaauuuuuuauuuuuugguauuggccauaagcaacaauuuucagauuugcacaaaaagauaccuuaaaauuugaaacauugcuuuuaaaacuacuuagcacuucagggcagauuuuaguuuuauuuucuaaaguacugagcagugauauucuuuguuaauuuggaccauuuuccugcauugggugaucauucaccaguacauucucaguuuuucuuaauauauagcauuuaugguaaucauauuagacuucuguuuucaaucucguauagaagucuucaugaaaugcuaugucauuucauguccugugucaguuuauguuuugguccacuuuuccaguauuuuaguggacccugaaaugugugugaugugacauuugucauuuucauuagcaaaaaaaguuguaugaucugugccuuuuuuauaucuuggcagguaggaauauuauauuuggaugcagaguucagggaagauaaguuggaaacacuaaauguuaaagauguagcaaacccugucaaacauuaguacuuuauagaagaaugcaugcuuuccauauuuuuuuccuuacauaaacaucagguuaggcaguauaaagaauaggacuuguuuuuguuuuuguuuuguugcacugaaguuugauaaauaguguuauugagagagauguguaauuuuucuguauagacaggagaagaaagaacuaucuucaucugagagaggcuaaaauguuuucagcuaggaacaaaucuuccuggucgaaaguuaguaggauaugccugcucuuuggccugaugaccaauuuuaacuuagagcuuuuuuuuuuuaauuuugucugccccaaguuuugugaaauuuuucauauuuuaauuucaagcuuauuuuggagagauaggaaggucauuuccauguaugcauaauaauccugcaaaguacagguacuuugucuaagaaacauuggaagcagguuaaauguuuuguaaacuuugaaauauauggucuaauguuuaagcagaauuggaaaagacuaagaucgguuaacaaauaacaacuuuuuuuucuuuuuuucuuuuguuuuuugaaguguugggguuugguuuuguuuuuugagucuuuuuuuuuuaagugaaauuuauugaggaaaaauaugugaaggaccuucacucuaagauguuauauuuuucuuaaaaaguaacuccuaguagggguaccacugaaucuguacagagccguaaaaacugaaguucugccucugauguauuuugugaguuuguuucuuugaauuuucauuuuacaguuacuuuuccuugcauacaaacaagcauauaaaauggcaacaaacugcacaugauuucacaaauauuaaaaagucuuuuaaaaaguauugccaaacauuaauguugauuucuaguuauuuauucugggaauguauaguauuugaaaacagaaauugguaccuugcacacaucaucuguaagcuguuugguuuuaaaauacuguagauaauuaaccaagguagaaugaccuuguaauguaacugcucuugggcaauauucucuguacauauuagcgacaacagauuggauuuuauguugacauuuguuugguuauagugcaauauauuuuguaugcaagcaguuucaauaaaguuugaucuuccucugcuaaauugauguugaugcaauccuuacaaaugauugcuuuuaaaauuuuaagcuaggaaaagaaaucuauagaaaguguucuguuacaaaauguaacuguuaccauuggaaauuucacgucauaggaaguuagccuuuaucuaccaacuuucaagaacuuguuuaauaaagcgaaaaacucaaccaaaugguacaaaaccacaguguaccauuaaaauaugcacuaagucucuuuuuuacaaaggcuguauucagcaaggcgcuaacuugcuuaaaugugaauuacuaacuucuaaaacuguacuuugauucacauguuuucaaauggaguuggaguucauucauauuacaauauuugugugcuaaacguguauguuuuucaguucaaagucaugauguuuuuaaaaucuuauuaaaguuucaaaaaucugaagauuguuuaucuagauguaaauuuuuauuaaaaaguugcacuuaugaaaaagcaaaaaauu

SEQ ID NO: 192826 - RNA, 4062 nt, Homo sapiens
ccgccgccgcgcccccgccccguguccgcacugcagagagccgcggcgagcaggcgccggcgcacuggcccacgugcugcgcgagcgagggagagccacagucugagcgaacguccgcgcugggagccaggggugcccgacccccguccgccgccgccgccgccgccgcgcauagcccccggagagcccucuggggaccccgaccagaagggaccuugcccugggagaagguaacagacccaccuggggagggagacgcugggccccgggagacuccgccgccccucgccuguccgcccuaucagaacugaagcagccugcagggcagggguccaggguccuggggcagcgcggggagggggcugaggcccgcagagaccccacgggggguggggguggggggcugggcaugggccgggccuggcugcagaggcgccgcacggggaggagggcggcugggggugggggugggggugggcguggaugugggcgugcggagaggugggcauuaaccucgcucucgcccugcucgcauucacaggcuguggagaccugggccuucugcgaucacccuaggaguugauccagauaugugccucacgcccugaucacuccccccaaauuaguauccgcagagauucgaggacaugccguugaccuuguuacaggacuggugucggggggaacaccugaacacccggaggugcaugcucauccuggggauccccgaggacuguggcgaggaugaguuugaggagacacuccaggaggcuugcaggcaccugggcagauacagggugauuggcaggauguuuaggagggaggagaacgcccaggcgauucuacuggagcuggcacaagauaucgacuaugcuuugcucccaagggaaauaccaggaaagggggggcccugggaagugauuguaaaaccccguaacucagauggggaauuucucaacagacugaaccgcuucuuagaggaggagaggcggaccgugucagauaugaaccgaguccucgggucggacaccaauuguucggcuccaagagugacuauaucaccagaguucuggaccugggcccagacucugggggcagcagugcagccucugcuagaacaaauguuguaccgagaacuaagaguguuuucugggaacaccauauccaucccaggugcacuggccuuugaugccuggcuugagcacaccacugagaugcuacagauguggcaggugcccgagggggaaaagaggcggaggcugauggaaugcuuacggggcccugcucuccagguggucagugggcuccgggccagcaaugcuuccauaacuguggaggagugccuggcugccuugcagcagguguucggaccuguggagagccauaaaauugcccaggugaaguuguguaaagccuaucaggaggcaggagagaaaguaucuagcuuuguguuacguuuggaaccccugcuccaaagagcuguagaaaacaaugugguaucacguagaaacgugaaucagacucgccugaaacgagucuuaaguggggccacccuuccugacaaacuccgagauaagcuuaagcugaugaaacagcgaaggaagccuccugguuuccuggcccuggugaagcuccugcgugaggaggaggaaugggaggccacuuuagguccagauagggagagucuggaggggcuggaaguagccccaaggccaccugccaggaucacugggguuggggcaguaccucucccugccucuggcaacaguuuugaugugaggccuucccagggcuaccggcgccggaggggcagaggccaacaccgaaggggugguguggcaagggcuggcucucgaggcucaagaaaacggaaacgccacacauucugcuauagcuguggggaagacggccacaucaggguacagugcaucaaccccuccaaccugcucuugguaaagcagaagaaacaggcugcaguugagucgggaaacgggaacugggcuugggacaagagccaucccaaguccaaggccaaguaggcucgggagaacagggcaacauuuccuaccacaggccaaggagacaaaagagauauuggaaggaggggaaagagaagcccagacaaacagcagaugaguugaguggggcagagggacagggcagccagaccaaggccaagccuucucacccuuggccagcuggaagggacuucagcaaccaagaccaccuggcaacaggcucagugggggucagguccagguccccgaagaggugcuggagaggaaagcagggagccacugcauccagcacauggggugccugggccucagauggggaccccaaagaagcagaagcugaagaagguacggcuggggguucuguccugcucauccaaccaccccuaaauacccacccuguggacuuugagcugaacaugcccacuggcccccaggccacaugggaccuggaggagccuaccuggggccugccccugccagcaggugccagggcuggugaggaagagcuggggggcagagguaaagcccugcaggggaggccacaggguccaucccgucuucaggaucaucuacacugcacuaggggagccccaggaaggcagcacccuggaggcccugugccagugaggacaggagacccuaaggccccgggagcccagugccagccagagguugugcaggcaaggagaccaaagauugaugagaagacccccagcagggguacuggguacccggcaggccagugcccucacaguugacuuggaccaggguggcugugaagggaagucuuuguugcaaaggaggaggaggaaaagggaggacuugguaggguuuuguuucuucugcuuguuucuguacagggccaccagacuccuggagagaucaagcaaggagaaccuggggcugccauggccaaagcaacucaacagaugccaaugccaauuccaaggccagccacaacccugccaccuuggggaauccagccuggaggcauccccuaagcagccagccauggccuggguggaggcaccugaagacgucugucccaaacucccccagcccugagcugggagaugacagggggaaagaggcccucucaagggugccagaugccugggucucccaagaggggucccccaacucaccguucccgggacaggcugcccccuguuccaggaagcucauccucaccuguguaggccccuguagugacccacgcguccagcagacgcccacccaccgcuagccguuguuccugugcaaaguagugugcuaugcacccacccagguggccgccucugggcccaaggcacaugcugugagcuuccugugagcccaggcucugcucacugcugucccgcgucaugagcaccaccucugcuuucccuguguagaucuaggccaguggcugcuuguucuuguggagcuguguguguucuucucugagcagcuccuccccggagucccccagcacagucccaggagaugacaggaaggaagcaccagggcaaggcggacgcucacccugugaccacgauggugaccgugacugugggaggaagaacuggacccaggacggagcggggcugcccugccugaggcucccgaggagcuuugugcuuugguguuccaccccuguuguuacucaugacucaguuuccuugaccugguaggguguucccugcuguguuuuccaguguccugugacuguccugugcgggccauagggcagggcccugucccagcagaugggcuugggagggggcucccuaaagccaguggacacugccagagucuaccuuccuggcaagaggcagaccccggggcccucaggaaggagggaguuggcagcgggggcugcagcaggaguaggagcagaugaggcgucuugccaggaaccucaggaggagggggcccgggaccugugugggaccuguguccugugguggccguuugcaguuucucucuguguugugauucccuucucuucaacguuuucaguacguguuucucuucaauaaacuucauucaguguuccagccgg

SEQ ID NO: 192827 - RNA, 4064 nt, Homo sapiens
cagcagccccagguccugugcagucccagguccugugauguuuauugaaggaagcaagggcagggcuggggugccgcccucaggccuggauguggcucuucgcacugaaggccaaguaguagaucacaaggccgaucgccgcagccagcaccucaguggacacccagggcccguuccaagugcccugaaaaaaaggagaucacaagccagcucaggggaguacaggugagcagaccagccagcccuggucaccuuccgccaggggaaccaagacaugcuggccaaucacggcccagcagcagagcuggggcuguggagaggauaaccuucacucagcccaacaaccccaaaaaggaggagggaccaggccacucacccgaugguccacgcugacuguaaacagaggcgggaugauggaaauguccucguuauuccucugagccugcaagggaggugcaagggaggugcuggggucaggggugccuggcguguggggguggggaggggaggggaaagacagguaggaacaccggcccaagccccagaaaaggaaaggagagaaaugggcaagagacacugaggaagggacaggaucacagaaaggccacccagcucaggacuugcugccagcaccucccaacccagcccauccugcuccccagggacaggggagcacagugggcuacaggaguccucaccuuccugaggaggcuguaggacuccucgucgaagaaucuaaccucauaggugccugcgugggcgcucuugugguccaggcuccaggacaccuggguuggguguugagcagagugugggcagaguggacacggaggggccacccugaccaccagugccgacacugcagcacuccggcagccagagcccacggccccuggcccugguugaccggccaccccuggggcuucaggucacacccgggagcagggagcccccuagcaagggaaccauuggccccucaccugauaacgccccacauccuggccucgagugacagggaauuguuuuccaccgacgucagcauagagagccauguucugggugagggaacaaaggcagggucaccuucugcccccucugggugugggcagaggagcccugugcgcugcucacacggccugcaggugggcaggcuaggcccaguugggggcugcagugucccuggcaggagguaccaaguaacacucaccaaucccgugacuggcccucugcauuggucuucccuacgggggcacaaggccagauccccauggccgggccuaacuggacgcauaggaacccuguugacugugagcaggggcgggaugaucaaaagggcugagugauuuccugagucuacaagggaggugcuggggucaggggugcccagugggcugcccaaggggugcuuuacccuaagagggccauacccaaaaaaggccccauuuccuucuuuggacuuaugggaacuuagcugggcaugguggcgagcaccugucaucccagcuacuuaggagacugagaggagaaucgcuugaacccgggagguggaggcugcagugagccaagaucgugccaaugcacuccagcugaggcaacagagugagacccuaucucaaaaaaacaaacaaaaaacaaaaacaaaaacaaaacacccacacagacaaacuggccaauggcaaccggggugggcugacuccuggcccuuucucccgguccagauacucauucaggaaacagcggguggugagcccaggguuaccucguguaggcacagcacacaaagcaggugaggaaggugaccugucaacacuggcuaggaucuggcaucaccgugcccugaucucuccggcaccccaagaguuggaaucuugauucucccucuaucgacacaggucccccaucaacuagcagugaggagcaccccccacccgcccuccugucugaaaccccacugucucaccuggacccuguucuugcaugucagggagaucuccacaaugaagacggucucaguggaaaugacagcgucagaagugguguaguaggaaggggugaucuggggcuccaggcaggccucggcugcggggaagagggagagaugccuggguaaggccagcucgaguaucccggucugagggcaggauggcccggcccugccucauagcacggaucagcuggggacccaugcgcucuuccugccccuuccaggugggauaugcgagacagauccaagugcucggucacaaaugcaauggcaacguaggcgggauggcugugaaggaaggcuggggaggggcaaggccggcuuucuggaggugugcaggaagagcgaacuggggacaggugggggcuggauucacuggacaauacaugccaacacuuggaccuaugacacggaggcccgggggccacgccagccucaauucagagccacaaacggccuggacgaguuacugaaggcauccucagcagagacaucgggggugggggcugcaggcaggcaaugcacuggggcuuucaagaugagagaaagggucucugcccccggccaguugacagaaggugaagacuggccccagcguuuccugaagaaguaaacgggagagacucugguuccagaagcacaacuuguuagcugugagagaaaggaccuugccuuagccuucuccauaaccagaggcccaaaggaaaggaaggcugccgccuacaucagagggugugaaacaaaggcuccccaaagugggaauguucucagccacccgcuguccaaauguggugcccuggcagaacgauggcuucagcagaggacgucagagaaggcucugggucuggaccacaggaggcagaucccuaggaacagcguggaggcaguucucaggggcuagaucccgccagcccuucuguguccugccuaaguugggccugcuuccuguggcgcaggggagcccccgaaggguuuuauggccaggcuuguccucuggauacgucccugacuauaguucagggaauuccugaggggcagaugaggagugugcggaaagggaggccaguuaggcugccaaaacguugcaggcagcaaggcuacuggccugaaggacggcagaaaagggaauguggagaaagccgccccuguccaguccuggcccccgggcccggggcuggcugcugcagccaccuccuaaacacacucuggaguucagaccucagccccucacgaaugcaaaucgacgggaccccuggucggcucugccgaaaacucugguaaggguaaggcagggcccuccggaaaagccagucuucggccuggcacucaaggcccugcgcaccuuuggcuccccaucuaacucgccccgcucuugcucccucuccucacugaggucccuuccuagcuuauguggcuccuccagccccguuuuuggccgcgaucgcucagcgcuacagagcuucgcuccgguccgaccccgcagggagcgggagccgggacaugugucacguuccgugcugcagcuugggggccgggcgcaccauggaggcucggggacuccucuucguaugggcagacaaggaaaagccuggcugccgguaaacgugcgcgaggugcuuugguccccccgucccaaggccgccugccucucgggggaaggcccggcccgcagcgacggacccugaaaggccggacccccgcaucccuccugcccccaacaccaccugccgugggucagaggcucgcaagaaagaagccccggcugggccgcuaccugagcagcgggagaggcuggacagcaggagcagcgccagggcgccgagagaugccaucgccgccaucgccucuucucugccuagaggaaaagaaaacgagcucccaugaacacgaggggcaaacgaggaagagcgacgcguaaguggcagcggcagccaaucgcgcaccgaacggcugggccggcauugugacgucucuggcagcacugacguggccccucccugagccaggggcccagcuggucgcggucccccccucaacauggcggcagcggugcucuaggcgccggaagggggcgugaauc

SEQ ID NO: 192828 - RNA, 28381 nt, Homo sapiens
caaccaaguacaaaggcagcuugcuuuauucuugagaugcagggggggaagggguggugcagucugucugccuccaaucuggggcucuccaagccuaaggggcaccccacaggcagccuaguucacacgugcaaauccugaggagguugggggccucuccuucccagucagcccaccgccucucacugggguccagguugcggaucgccaccaaguccuccccaggccgcauggcccgaggucuuccacugcugcucauggggcuugguuucuagagcccucaccaucuaagcaccuuccucaguucacucagaagagaagccccugcuccagaugguguggggcgcagaacgggcucugugacuucuugguggacacccugcaggaccccuccguuccugcagucuugcucucucugagucacuggggaaacaggugccccccagaggcuccccguucccacaccucagaguggaagccaccagaacagcugcuucccauuccucccaccuuucccuccccuucccucccauccauccccagcccucccucccacucuuccuccccaacucccuucccagccaucaguggagaggggaguuccacuucugccaggcugccugaaggagcugccagcccccagggcagguccacaaaacaaaacaacuauuggcaagcacagaaagggagaaaaaccacaaaaaucaggggugccuuugucuacaaauaacugcagugcgcagcggcggggagaggccgcgcucagcagcgaagccggacacucucuugugcuccuuucagcucagcuucccugucugcaaguacacgggucggguggagagagcacugggugugugugugcgugcacgugcaagcacacgcaagagcaugggggauggggaaugcacacgcacagcugaaggggugcccaucacaggugugcccccagugcuggccacuggcauggucacuuuacuugggcagaaggaagaaaagcgucccuucuccucaggggcuucucucugcuaacaaagcccugugcgcacacccagacgaggagaugugugcgugcgcacagcgagcacgcgcgcgcgcacacacacacacacacaaucucuauaggagagugagggccggggccccaggggguucccugggccugggccguguacccgcccgggcagcucacacgguggugacugagagaagaggguuguagacccgcuugccaucggcggagcgcgcgccgugggccagcaucuccuggauggugauccaguuguccaggaucuucuuguuccgcuucuucaugguuuugcgguggcucagggcaaugauguugagcucgggcuugcugucgccauucugcugcucccgcaggcacuccagccggcucugcaucaugaacucgcgccgcuuccgcugcucacgggcccggaucaggugcugcuuccgcuccuccuugcuccaguagcggcccaucuucaucucgcucaccgcgucgucgucggucgucauaccgcugcgcuccucccggaucuucagggcacgggcuuucagcagccgaucucgcacgggccgcuuggccacguagcggguuccgucgcugcgcaccuucacuuuccacuccaugcgcggugcuucaguggccgcggccgccaccccgcccacccgagggccaccggccaagcucagggggccguggcccagcuccuccaggccucgcgucggggccagcugcacgcagcugugguagugcucgcccuccuggcccuggccgcgguggcgccgcgagagguaagggcugcuuucagggcccacacgcuccagggucaaccccgucuugggguugcggcggccgcgcuccuccgcgugcugccuccggccggccucaggaucccgggagagggaccggaacuuggcggggcuccccgguggaggagcugccuuggcggggguggcaacagcggggccgggagggguccgguucaaguuggaguugccggccauggcccgccgcagggggcucucgggcaggggcuccacaagcagcggggugcugcggcagcucuccccaguguuguaggcgcuggugcuguccuuguccgacuucucgggcagcucggagaugucggacagcucgugcuucuugggcucgcuggccgccaggucguagaggcucuccuccuccagcagccaggccuucaugcagcgcucacgcagcugcugcaucuucugcgcccgcaguauguugcggcacuugaauuccaggugccuuagcuccuccuccagcauggccaucucguggcccaggcucucguugcgguugacguccagggcgcuguugccuccggaggcccggggaaagaggaggcccagcugguugccguucuccagguggcacuugaucuccaggagcucacgguagcgcucauacuccucauccgugaggcccgggacgucgcccccucccagccccgcccccucggccagcagagaguccaugcugaaauggaagucccggcucugcagggcguccccuugcaggccaaacuugcgcaggcuucccgggguguugguggagcucggggguucgucccccagcaggucgugcucagagcucucuucguuccgggugcucucgucaguccggcccaccccgcuguccagcuccuggcuguugcucaggccugggccggcaucgggagcccccuucuccucuucguuuccgggcuagagcagaaagguaaguaccgcucaguuaggucccacggacagggaugucacgggaugucacaggaggaucggaaggggcuucaggccugguucauuucccugccaagcauugggagacccugcacagccucagcgccuuccacccaguucucuccuccucgcccuccccaccagcgcccuuuuccuuccucaccugcugggcagggggugauuucaguuuacgagcacgcagcucccccucauucucagagccaaagucauccaggaagucaucccggucgcuguccuuccaccuuuucgccagcuguggagacaggcccugguguccccacagcuucaaggaccuccccauauacccuucuugucugcucuggaccccgcacuuggcuuguuucggugaagcucagcaaccugggggcagcgucccagcccccucagccuucagaggccaggaggggaaacgggcccugagagaccccugcccacccgcccuccaucaacuccaggucguuggcacaucugugcccuagucacggccagcagcuuccaagacagaaagccugaugucguggccccgggucgcccugccaggcauacacaccugacucucaggucgggccaccagcagggagauguugguguucucuuccuggcucaggauggccaccgccucuucccgguucuggacgucuacaccguuaaucugaggcaggcaggauacaaucaacaagcaugcuagggcuggcccuggggcggacccugggcgggugcagggagcccaagcacucugggcucggcugggcuaggcuggggcuugagcucugggaggauguaacuaaguggaagguaccagggagagggcggccugacucuugcaagagcaaaugugugcucaggagagcauggaguggggcagagggagaggggccaggagguuucagagcagcaggggcccuggaugccagcagaucccauaggcacacgggagccacuggggugagugggcaggagagagaugagacucagcccggguuuaggacacggcaggcugcugggccucaggguuagcucuuagugggagagagcuagggacuggcuaaagagagguggcugggccgacgggcacagcggggccuugggccaggccugcagccugcaagugcucaccuggaugaugcggucucccucacggauccggccgucuuuggcugcaaugcuguugggauuuaccugcaggacacacgcaucuuggggacuuggugccuaacaugcccuuucgguagaagggggcaggcucaccucaggggcccccaaagcaagcugaaggcucucuggcuccccuuccagcucugagccccaggaagcagaggcagaggcuguggaguagucaccucuccccgccccugcccugcacuccuaggcucuucugcacggaagccugugcuuuuggucagccccgggcauuggugggaaguaggacauuguccaucuggaaggguggcuuuagugggaugcuacuaguagggaggggagcgaggggccaucccccuccuggggauacacaagacaucugcccaagauggguucgggagaaggcuagacagcaacccuguugcuaguucucaggcccaucugcugucccacccaggcacaggccucuuucugcagaugacuaccucacuggacaguggcugaagccgucgaccaucaucgccucaccacgcagcacccuagcugugaugcccuguuucugguagcugggaccuuaagggcagccucugagccacaggcaggccauguggaugggccucggggcuggggcauacccgucugcauaccucuccgacauaaaugcccagguccuccucgucguccgugcgguagcaaaccaucaggcccagcuugucccgguggcugcuuuuauacagcuccaccuccugccacgagggguccgggaggaagcagagguagaaagccccagaaaugcgugagugagggagcaggcagcacagcccagccccucagcccgcaaccccucagcccgcagccccucagcuuccucuggagcccccugagcucaguuuccaggccccgcuuugagggucucucuuaccaucccacguggcgcacguacucaguggucucccucccaggaaaugcacgaggcacacacaggcacaggacacagaagacagacgugcaugggacguggacucaccgacauggacggaacacguaaccucacccgcacccucccugacucagccagaugcgugccaggagggccacgggguugggccugggcaggaaggcacacaggcgucggggcggcucccgcagcuggcugcgggcccuggccuggccacccggcucaccucauacuccagcucauccaagcggucugccuccugcgggccgcccuccauaaacuccgccgggucauaauacucauggcugauuggggggcugcccaggagaaggugggggucagaccagcuggccauccucucacaccucagccccagcucccaggcaggccgaucccagcgugccuggcacggaggccugcucugcuugugcucucaaggguggguggcccaguugccuccugcagagccccuuccugggcaacaugcagccaugcaaagaccgggggcacuucucgcaccugagugugcagcguccacgcagaggaccugcgcaugccucuagcguucccgucccccagaccagaacuccuccaaccacgccagcuggcagggaccaacuucuccaaucuccgggugcccacccgcccgcccagcacuggccccacucaugcaacgcccccaggaguuauccaggcccuggaggacuucugcagagcagaggggggcccacccuaccuccaggggcugcccuccuggccccaaaacuaagguuggcugcucauggcccuguggccuaccuccccgcagcccgggcuaagauuagcagaaugaggcagcgcucacgcggucaugagccaccaggccuggaugaaaggcccuucuuccggucgggccaaagaaagaagcugaagagauggaggaaauucagagcagguagaggaaugagacagacaagggaugcaagaagauucaaggagugaugcuugugaggcggcagaggagagaggauggaggaggaggagcugaggcccucaacccuggcacuuccggcagcgacgucccggacaggaggguccucccucggcccuggggguagauacaacggggcgccugcuggagcccggcccaaggcuagaggccuggagguuuuggagcccuuggguaccacggucaguucuggaggccgaggggccugcuuccugcccgagaggguggcgugcggauggccgcuccagguggccuguccucucuggaggcagggcccggggcccuccugagggcgacucacagcucagagaggacguacggcuccaggaugaccaugggcggggugggcggacgcagcuugcccagcgccaugauaugcucgaaggugaugucggucugagugccacuguccaccagcugcaggucgugacaggagcuguccccccggaggcgggggcugcgucucagcaccuggaucaccaggggcuccuuggaggagcgcagggccugcagaguuugcuccugagacagcuuggagagcuccuucccguucaccugcggcagagacacgccuccguaagaacccucaaaggcuugcuccuccccucugaggucaaggcagaggcccuagcuggcaggaccugggcugacaaccagcaccccaagccacucaagcaaggaaucugcugucugcagcccuggcuaccuuuggugccccuguucccaggcaagccccacugcucagccuucaucccacugaaggccagcuggggaucaccaagucacaccaaggacugggggacccagccucugugcacugggucuggaggcugugauaccgcccuacaacguccuccagacacugcuugagcucuccuggccucuccccauccggacccacuucuuucuagggcggcacugaggccagagcuagcaugaagaucccauugaguuccuuggcaaugacuggaccauaacagccaacacucagugagcaucuguguugugcucauucagcaucaagcaagaggaugaccuugacucuucagaugagccgagucucucaacaaaugucuacucacuagggagggccagggucagguugggggacaaguaggaagaugccuaaagauacaguguuguguccucacagugacaacugacuugcccaagagaaaaggccuugauguacaagaagcccccuggaacugcaaaguagccuaaaagaggugccaagaaagugguccuuauaaagccaccacuaggccgggugcgguggcucacgccuguaaucccagcacuuugggaggccuaggcgggcagaucacgaggucaggagaucgagaccauccuggcuaaacacagugaaaccccaucucuacuaaaaauacaaaaaauuagccgggcgugguggugggcgccuguagucccagcuccucgggaggcugaggcaggaaaauggcaugaacccaggaggcggagcuugcagugagccgagaucgcaccacuguacuccagcuugggcgacagagcgagacuccgucucaaagaaaaaaaaaugccacuacuguuuuuugggcacgugccaugugcuacauucugggaaagaccccugaugugggucuccacaaaauccuaacccccaacaaccuugagggagaugccauuauugcagaugaggaaaccaugucagcaagcucagcaagguuguggcacugagucaaggucaugagccaggacaggcugcccgguggccagaaggaggggucagggaggaggaggccaucgcgggccagggcccaaggcggaaguaggaccuaagcagcucugcgggaugcuguaggggugaaggaaggacaaugaaggguagcagaaggaagcccauuacgcacagcgcaggugguggggcaagcagugcccacaaggucgaaggcugcuuccgcagcacccugggacaguaugcugcgaccuucaaguccuccuuggggaagggaggcaaguagagaagggacgaaugacuaaggaccaagaaggacugaacagacuccaccagaauucagggcacgugccauggggccagcaagggucagcaggaagcacuucuaggaggaggcagcucgaggcaggcgugcagggucuccucaugggcucagcggcuuauggaagggcuguucugggccuggggaggcuacacacuagcauuaugcccaaauggcuaugccccgcaggugagcguggggacagaccuuacccacagcuaagggagcacacggcuggccaugcacgccucggugggaggcggggaaggcuucuggagcaggggacaccuggccuccaucaggcaaagggaacagggccaagaaaagacccagggaggcugguuugcaguuggaagcaaagcccccagucagcacagagagggcagggcgaggagacccagaguccgccuagggauggagcaggcugggagcuugugccagaugagagggcagaagggcccugggcaugggcgcagguggcugcgccugcacggagcccucugcuuuuccgaguugugcgaauauuagcaaguuuagaagaacucucuguccugcauucucacggcggcaccucccaccccggguuucucacagagaugucaauucugacggcaaaaucuugucuuagugcccgcgauacaguagaaccaccgcuguacgagucuuuucgggaagacagcuaucugaggagagcccagcuuguccucggaaccccuguggccucagcagcggcuccugcauuacuuuuuuucuauuugacuauguccuuguagauaaucauugaaguuuucuaugucucccuucuccccaaaauuuucauauucugaaaagagcuuuuugucaaaaucaguuuuguccgauuauaaaagaaacacaguucauuuuuuuguuuuuugggggcuuuuuuuuguugagauggagucuugcucuguugcccaggcuggggugcaguggcacgaucuuggcucacugcaaccuccaccuccugggcucaagcaauucuccugccucagccucccaaguagcugggacuacaggugugugccaccacacccagcuguuguuuuuuuuuuuuuagacagagucuugcucugucauccaggcugaagugcaguggcauaaucuuggcucacugcaaccucugccuccuggguucaagugauucuccugccucagccuccccaauagcuaggauuacaggcacccaccaccacgccuggauaauuuuuguauuuuuaguagagaugggguuucacuauguuggccaggauggucucaaacuccugaccucaaguaauccuccugccucagccucccaaagugcugggauuauaggcaugagccaccgcaccuggccaugcggccuguuuccuuccagucuguuuucuaugugugccauuuugcagcugcaggccccuuaagguccauccacaccaacacaccaguggaccaucauguucaucaucacaucaguaaggguggcuuugauuuuuuauuauaaagaauguggcaaagacacauucugggguccauuuuauacauuuuucauacuuaaaucuuuguguaaccagugguugucaagguggagaaaauuucuugagguggaauuucuggaucaaauacuauaaaggaaacagcuuucagccaagaagguauuuguuggaagaccguaagaaugucagucaggacagggcaugcugugcuugguggagaggcuacaguuagaaaggcaggauggaagagggugggcggcagcagaguguggguucaggaaggcuguagacaaagggacaugauggaauggccucgacacucucagcagcaguggcuagagccaacugaagcugggaaauuuggaagccaguugucaaacacagcgauuauugguauuuuaaccguagaaauguacagguaacugaaugauauuaacaacaaaggcaauaaauccucggaacacaucacugucuaauuaucuuacuacacuuuucugucaucugugcuuuugggguuauucacaucugguaugggagauggaaauacuaugugugcauucccccaacuccaaguucagugacaucgcagugguggcuugaaaucggcuauaguggcagcauuuacaccagggaaaucggcaaaugcuccaaaucagggcuuuuugucugggaacauuuaccaccuuaccacugcccuugaggagaagccaacacacaagcagaagggcucggagcuguccucaggguuucuuccugaacucccggggcaggacagcaagcaggcagugggaugcucaggugacagagaugacagagaacgcacgaaugccuuucuacccggaaucauuaccgagcagcaguguugcuauggaaacugaggagcgcuugcugggcgggcuggcggaggcugggaugucaagagggggaugggcgugggcacagccucagcaccucggaucagcagcaaccagagugaucgccugugacagccaggcagguauuuggguggaagccacgggcuccugaagccuucucgcucucucucucucuccuccucaucggucaugcuggacccccaaggaagaaaugagcuccccucuggggaagggcuaagggcuaccaacaaggugggaaaauauggggccaugagcaaagagguauagggccaggcacaugguaaggagccacacuguggcccuucugaugacagcagcucuuccaguccugcucagagccuugccuccccgccccacccccaaccauccugagguagcacacugguaaagccaccccuguaaugccccaacccucggauugccuacucgaccacuccagucucuaaaaggcacaaacacucaacauggccaaccccaggcuugcuucccaccagacucucccuccugccccaccugcaaacguuuccacacccugggagcucgccccaccaagacagaagaccuaguccaagcccuggccaagcaauuccaauuggaucaaagaccuacagggacaaagcaaaacaagagaacaauaucuuuauggugugggauagagacgaaauucucaauauuucaaauggggaagcaauaauggaagagauguaaaacuucuagacgacaaaagacacccuaaacacaguaaaaaggcgggcucagaggagagccuuacaaugcauggaccucauaauggguuuuccagaauaugcaaagaauuccuacaaaacaacaagaaaacacagacacaaacaacucaagaagaacaugggcaaaggauaucaacaggugcucagggcaaaggggacccacuagcaagcacuuggagccaugagaugagaggagaugcccuucagaaccaccaccaggaggaccaggaggaugugggcaugaaggccacaguggccaaacaccagggacagcccaaaggucugccagcagucgaacaaacaauuccugguauuccgcaugugcaguuaauggaggcgcacauaauggaggcucauucguaguauguacuugguggaaaacacggcagagaggcgagcagaugaagugcguaggggaugggugggcacaggcggcuucaaucugcuuuuaauaccuucuucaaggaaaaacgcucaggccaacaggacccacaucaaggcuggguggcagugcuggugcuaagugaugcgagaugaugccccauacuucuccagaugcuacagcaaguccaggaggccucaagauacccaggcuggagcucagccuuuuaugugugauugucuaauuaccucccuuucauuagacaacaaaccccaagagggcuucacccugaguucuacuuccaucccaacuccuaacaguuugcugaagauaaaacuuuaauauguuucuuggcugaauuaaaauuuuauauauuucuguaauuuguugaauauauauuaaggaccuguaauuuaucugaucuaccuuuuaaaaaauaauaauaauaagagaugggguuucaccauguugcccaggcuagucucgaacuccugggcucaagccaucugcuuaguccccccaaaaguguugagauuacaggcaugacccagccccugagucugauguacccggacucuacuaaaaauacaaaaauugcccagcacggaggcucacgccuguaaucccagcacuuugggaggccaaggcaggcagaucaccugaggucaggaguucgagaccagccuggccaacacagugaaaccccgucucaacuaaaaauacaaaacuuagccgggcaugguggugcacgccuguaaucucagcuacuugagaggcugaggcaggagaaucacuugaaccugggagguggaggcugcagugagcugagauugcaccacugcacuccagccugggcaacagagucagacuccauccaccccccaccccccccccaaaaaaaagucuccuucaucaagugcaaacuucucuccuuuggaacaauccagaagaaauccacuuugcuucucuaguauggggagaguggggauuguugacugagcucauuaucggaaaacucucacuauugaauguuuccuucauugagagcaaccucccuccuuuggaacaauccagaagaaacccacuuuaucuugcaacacuucacguaccugaagcccacucaaaugccccuuguccccccucgcccagguucccagcgacucucaucuucuccagugcucccgugccauccugaccacgugcugggcaucaugcuucaccuuagcgaggucaccccguggcagucaacccuguugacuggguagugagcugugagccaagcaaacccucaaagccuguucacaaagaccccuccuccaucacgugcuagcacaauagauuuuguacaaauuuucgcauuuccuuucaaauaaucgaagugcucagagcgccacacugaggaggcggaggagcacaaagaugaaaauacaagucccuggcacuccgcugccccggggagugcagcagccugugagcacaccacggcucagccaggggcuugacgugccccauggcgacucuucagcacacagaucuacuuccuuccugauuugcugccaagaugggcccaagagggcugacucuaggacugcagcuccaaucucaaccacaguugacaugaacguccuuaauuuccaccauggucccugcucugaacaggggacucaagccuuagcagggccccucugccugaauguggcccaaguggcccucacauccugcuugggacagcccaguuccccuuugcacacugagagcacucacugccccagguccccugcaagcccaguuccuccucccagccgaccccaucacccuuucuagacacacuuagucugaaucuuaccccagaguguaaaguggucaaauuucuggagaagaauuugucaauaacuauaaaaacccuugaaaacguucaugguagccuuugauccagucaaugugcucuaaguaauuuagucuaaaacaguaauaauaauaauggauauuacaugaauuuaauuacaaggacguuuacaauuuaauuacaaggcugugggcuccaggucggggaggggaccuggcggccuggaaggggaccuggggaaggaggaaugaagcacaggccccaccccuccagaggagguggccccaggccuuccccagggaacccugggaagcugguucuuucuggaaggcugcagaagggccuggccauggguccuggaggccacuuaggcuaggcgggccucaggccaggaggacugagccaugcgcccuccccacagcgcagccccucugcacacaccccgcagcuggucccucuaagacuugcggaaagggcucugaguggccgagcuguggccccugaucucccaacccagcaucugagcagaagaggacaggagcuggggcacugaucgccccaggcccggucggcagggugggggccagggccggcaggaucccggguugcgcugccuuccgagggagccggugcccacccagcggccugcagcccaaggcagggugcccugagaaagccaccgccacccccagccccucggugugagcaagacccccagcugguggguccccacccaccaguggggcucccaggccugucgggggcucgguggugggccuggaugcuaggggggcaacgugcggcagggaccaagcucucccgcccacagaugagugggagggggucguggugggcaugggaagaccuuuccaacaaucagguguguuggggggugagcaaggcaggggaggggcccuggcagguggggugccagggaccccagggcuggggcuaggccuguggguggggcgugugcuggggauucugugggccgaggacaugugacucccgggcaggcuggagaugcuggggggugggcccgggaagcacgggagaugagggaagaggggggaauccugccccaccugcccuggacagggugccccauaggaaaggagugccaaggagcugaagggagagacgguggauccagaacacaccccccaucccguuccgcuccccaaggggcuugguuggaaggugggaggggacagagacaaagcugccuggguggguagaguggucaggacagccucucugggucggugacacuugagcugagaccuaaaugaugacaagaaaccagccaugcuuccuuccuuguagcgaagggagcucccaggagaacagacuguaagggccagaccagcaggcaacggcagugguccagaccacagaugaugguggcaugaccccagggguggcaguagagguggugggauguggucagagucagcuuggguuuuagagguaggcugccaggaccugcuguugggcugggggcaagggacagugagggcuugaagaagacaucgaauaagcgcaggaaaagacgcgucagcaccggccaguacgcacagaggaaacacacacccaaaccacagugagauaccgccgcacaccacgaggaggcuggaaucagugaaaggaagcacgaguauuggagaggacgcggggacccuggagccucacgccuugcugcugggcauguaaaauagugcagccagggaagcagucugguggcuccucacaagguuagguguagcuuauguacaugacccagcaauccccaaagaacugagaacaggcgugcaaagaaaacuuacacucaaaugcucacagcagaguauccauaguugagaacaggcaugcaaagaaaacuuauacucaaaugcucacagcagaguauccauaguaaccaagacucggaggcaacccguguccaccaguggaugaauggaugagcgagcacaacaugguacacccaucccgacauaaaaagaaugaacgaccggcacacacgacugcaugagcacagucuagccaaggcaaagaggcagacagaaagcagacgaaugguugccaggaccuggaggaaggggggccuggggagucacugcugagggauaugaggucccuuuuggggcgaugaaccuguucuggaacuagacaguggccacggcugcacaacauugagaauagacuaaaagucacuagugguaaauguuauguuaugcguaucuuaccacaagaaaacauaaaauugccacacaggaccacaaggaccagggguauccucacagcagugaggaagaccgaggaaggaaggacucagggauuaggcccagggcaggaaauggaagguuuuuaucucuagcuugaacuucccgaggcauguggacaucuccagugccccacuccaaaugucuggcccaagcccaagucagcuaacuggguggcaugugaccauugcuguucaauuaaacuaggaauuuuucuuuauuuaaaaucauaagaugacggccaggcacgguggcucaagccuguagucccagcacuuugggaggccgagacagacggaucacuugaggucaggaguucgagaccagcuuggccaacauggcgaaacccuaucucuacgaaaaauacaaaaauuagcagggcgugguggcaggcaccuguaaucccaacuacuugggaggcugaggcaggagaaccacuggaacccaggagguggagguugcagugagcccagaucacaccacuguacuccagccugggcaacagagcaagacuccgucucaaacaaaaaaagaaucaugagaugaagcugggcguggugucucgcuccuguagccccaagugguggaggagguagggggcaggcgguagggcugaggcaagaggaucaccugagcauugggaggucaaggcugcagugagccgugauugugccacuccacuccagccugagcaacggacugagacccugucucaaaaauaauaaaaauuuaaaaauaaauaaauaaaaauuuaaaaagcaaaagcaugagauggaggagcucaccuagggagugaauguagucaagaacaggagaggcccaaggagaguccuggggcacccugacacugagccgguuggggagagagacuagaaagucccgggagggaagccgaggagcugcucaaugcacugggucggagcccgggaggggagggcgaagguggggccucuggauuugcuaaaaggugggagggggccggguggggaagcucgaccugcaucgacacagccuuccggagcuuuuugcagagaaggagcagguuggguuuucaggaacaucagaggggcggcugaauaccgauggaagagcaauucgcaaggccagggaaagugcuggcaccgcuuuccccgcaugagggggacaugcgggcaagggaggggggacacagggacaggggagggggcaacaccgggcaggcgaggcaggcaugacgcgaagucggccccacgggcagucgcuguggggcggcgaucucccgcugggcaagggacuggcgggccuuaggggacgcgggaagcggggcgcccuaggcggagagggcggagccccaggcgcgcucgccccgcccccugagcccggagccgcagacaaagagcgcgccgcgacggcggcgggguggcugcggcugcgggagcagggcggaccacacucgucccggcgccgccacgcugguggcuguauuggcaggacuccugcccgcccgccccgccaaccccgucggaggcugagcucuguuuccaggcucugccccaggcacccuccugcacccagcgguggcaggcgcacagccggguggggcgcgacgcccucuugcugaucaggaaucucugggaagccgagaagagaggccggagaggcuaagaaaacaguuguggccugggagacucgcaaucccaagugcuugucacacggcgccugcgaccccuuucacucucacuggcaacgcgcgggaugggaggugaagccacaucacuuccaggggcccccguggcugccacggaggugggggggcugccaccuucggacuccccuuaccccacugcuguagaguaggaaacaagcuggggaaggacagagacaggaaguuauccucugcccggggccgagcucugaccugccugcuggcucucagcucugccgucuggaguauccaggacaccuuggaagcaguugugacuguagcuuccaggccaagucaggcaucgggggaucucccaacgaguagagcaucagaggagaaaggagaagccgcaggcucacuacauucacccacucagugacccagcaaaguccccauucauguuuccccagcucgggauuuugaaaauuguccgcccacaagcaugugggaacaucugcagauuccccacaccugcucucgggguuucuacacacacaugugcagaagcauuugaaagcaagaugccaucagucccauucuccguggaaccacaacacccuuagcacggaauuccgcacucauacaaugggccagccucacaucuccccagcugucccgcuaacacccuuauagcuuuuuuuaaaaaucuaggauuugaggcugggcacaauggcucaugccuguaaucccagcacuuugggaggcugaggcgggcagaucacaaggucaggaguucgagaccagcauggccaauauggugaaaccccgucucuacuaaaaauacaaaaauuagccgggcgugguggcuugcaccuguaguuccagcuacuagggaggcugaggcaggagaaucacuugaacccggguggcggaggagguugcagugagccgagaucgugccacugcacuccagccugggcgacagagcaagacuccaucucaaaaaaaaaaaaaaaaaaaaaaaaagcgaggcgugguggugcagccuauggucccagcuacuugggaggcugaggcaggagaauugauugaacccaggaagcagagguugaagugagcugagaucacaccaucacacuccagccugggugacacagagagacuccaucucaaaaacaaaacaaacaaacaaaaaaucuaggauucaaucaagaagcacacauauuacauucgguuguuaggucucuaguuauuaugucuccucucuaaucuagaaaaaaauauauauauuuuuuacuuuaaugggaaugacuucuuggaagagaccaguccuuauagaaugcgccagagucugaauuugccugauucauucccgcggugagauucaggcugagcguuuugacaagagcaccuugcaggagaugcuguaugucuccuccccagcccugcaucuggcggcuggcagggucaggcugccccacuguuggggaggcuguuugaucacaugguccagguggcagcugccagaucucuccucuguaaagacgcaguuucccuuccugauucacagguaauuugggguaauauuuggagacuuugugaauauucuguccccaacgaccuuacaucuaaugguuuuggcauccagugaugauuuuugccugaauuaauuacugcauugguggcugcaaaaugucuccaccaacauguuagaauucuagcagggacaaagaggugacaggcccggcaaguagcauggcugcccacgcccccaacuguggccuccugggcaagccacaccacccgcuuccauaacucugugcccacccuuucugccugggggcaggagagacagaaacaugggagggcuucaucucaaaggccuuugagcacuuagucgggggaggggugucugggcguccaugagagacauguauaccgguaggggugccggugacagggaagggggucaguuagcugcacauggcagggaagaacaaguuauguccuguaaagcccucacguaggcaacgacuccuggauguucugauuuacccucuauguguguuuuuuuacccucuauuuguaaacaauuuuuacccucuauuuguaaaaaaaaaaaacaaaacaaacaaacaaaaaaaacaacaccucacuucaccacccauguuaaugugguuuggggcuaccauagaucuacucccggucccuacccaaggcccuggcuacucacagccagugggauccacaucaccugggagcuugugagaagugcagaaucccaggccccaugcuaguggcucagucagaaagugcaccuuaacaaggacuucggguggaggguggcgcuguacugacucagagcgcgcccuggaggaaccagggcagaccucaacgaaggccuucugcaugagggcaucuuucuuuccccucacuucuccuucccuccccgaagcccagggucugcugaagucucaucaauccaccuggcccccaccuuuccgggagagcggcggccucucagacaccuccauaguccuggcucagaagcagaaaggaggccgggcgcgguggcucacgccuguaaucccagcauuuugggaggccgaggcaggcggaucacuagaggucaggaguuugagaccagacuggccaacaugaugaaacccugucuuuacuaaaaauacaaaaauuagccaggcgugguggcaggugccuguaaucccagcuacucgggaggcugaggcagaauugcuugaacccaggaggcggaggcugcaaugagccgagaucacaacacugcacucuagccugggugacagagcaagacucugucucaaaaaaaaaaaaaaaaaaaacacacaggaaaagaggggugucccacaccuugcacaggaaaagccaaccacuuccugaagccauucucaagaucaaccuucggguacauauucacagcuuuccaggcacguggcccagcaacuaaacccauccucccacccaccucaggcuaaccugacuggcuaagggcacaguucacaucuagcaacaaucaaagcaauauucccucugcagcguuuuacaaucaaagcaauauucccucugcagcguuuuucauucucaaugcuccaagcagccaugaggacaggcagaaugcacugaaagggaggacaucuuguccagccccaggcugcucagccucgccuccuccggcccaacuccugugcaaaaugaccacauaugccuccgcuuuguucccuguccaucuguuuuuucuuucucucucucucucucucucccucccucccucucucucucucucuuucucucugucuuucuuucuuuuuuuuccagacacagucuggcuccauugcccaggcuagagugcagugguacaaucacggcucacagaagccuccaacuccuggguucaagcaauccucccacucagccuccccagaagcugggacuagaggcgcaugccacuacgccugagcaauuuuuuauuuuuguagagacaaggucucaauauguugcccaggcuguccuaacuaauauuguacuacaucacacuucuucaaaacuuggaggucccuuuccugagagaaauucucagaauaauauuggacauucuucugucacugggcauuaacugugacauacccagauguaaggccuucuccauauaauuuccuuuuucauuauuuuuuauuuaauuaauuuauuuauuugagacagggucucguucugucaccuaggcuggagugcaguggcuugaucuuggcucaugcaaccuccaccugcugaguucaagcaguucuccugccucagccucccgaguagcugggacuacaggugcaugaugcccagcuaauauauauauauauauuuuuuuuugagauggaguuucgagcccaagcuggagugcaauggcgugaucucagcucaccacaaccuccaccucccggguucaagcaauucuccugccucagccucccgcguaccugggauuacaggcaugugucaccaugcccggcuaauuuuguauuuuuaguagagaugggguuucucuauguuggucaggcuggucucgaacuccugaccugaggugauccgcccaccucagccucccaaagugcugggauuacaggcgugagccaccacgccuggucaauuuuuuguauuuuuaguauagaugggguuucaccaugcuggccaggcuggucucgaacuccugaccucaugauccacccgccucggccucccaaagugcugggauuacaggcgugagccaccgcacccagccaauuuccacuucuuaaugaccaacugaauggcccgagggcagcaacucccuccuccacccagugagaucccgggggacacaccaucuguuuuccuugucacaauggcccucggacgcaagcacucuucacugccauuucacaguugaggaaacugagucacugagccagugggccaugcagcgacuugccccuggccacacagcugucaguugguggcugccuccauuccuaucuccacacugcacugccuucucuggcagggccccugaaguagaaggaaggaaaggacaccuuucuccccaggaugcgugcauguggccauggaguuccuguucuaaagcuuuggugaggucuguugcugggugguaaccugcacaucuucagugugcaaagggcagguguucauaugucauacaugaaccuggggaaccaucaccaccgucaggacaguggccauuucuaucuuccccaaaaguguccucaugccccucugcccaucccugcaaccacgaaucugcucucuggcacuaucgaauuucauuucagcagacuggacaguccucaggaaccccgagaugagaggggaaagggcauucuacaaucuugggacaaugacacaaaacaggaugaccugguccagaagauggcagucagaauucaguguccagcccucuguucuuccacuccacaaggacuuucucagagccugcuucuuccccagucagcuucugcggcagaaccacugaguugacugagaguccagcuuuccccuggaaggguggaggccagcguggaugugcuggcagcaucuggugcuggugaggcggggaggcagagugcccaugccagacccaaaucccugcucacaggaagcccccaugcaagcaggagggagccagagaagccaccuggcuuggugggugggagagcaguuuggaggaagacgucgcugaagaggggacacuggcugccagccacgcucccgcacucaagcaguacuuucucucccccgcaguugccuacauguuggcgauggucucccccuuacaaaaaggggagccuggggccaggcgugguggcucacuccuguaaucccagcacuuugggaggccgguguggguggaucaccugaggucgggaguucaagaccagccugaccaacauggagaaaccccaucucuacuaaaaauacaaaauuagccaggcaugguggcgcaugccuguaaucccagcuacucgggaggcugaggcaggagaaucgcuugaacccuggaggcggagguuuuggugagcccagaucguaccauugcacuccagccugggcaacaagagcgaaacucugucucaaacaacaacaacaacaacaacaaaaggggagucugggggaggggcaaggcccugucugcagugucucccugcugaaugccacgcacccaggauggcugccagcaccaugggggcucacaugcaggugcuuuaggcaagaaugccugggagaucaccagaagggcuggccagcuguccuuuggccucccucgauguggacagaggggagaugacaggcgguccugacccacucccccuguaaagccugaguaggaugggcgggagaccaguccuaaguaccagggguuuauccccugaccaucuccggcgugcucggaugcuagcaagcacaucauggugucagagagggggugccaaggccaagacaaguucagcagaguguggaccacgaugagauauaugacaagggggccugguggcaguggagggacaugggcugcagaaaaggcuccggagcuggggacaugcuguuuccugccuuccauucugggcaaccagccugcuuccuuuuccuaacucaacacgcaguaauccuccauuuucaggggaggucccagauuuuccaaacuaggaggacaugauuggaauauaggaauggggcugagguuccgacaugacacacgaaagugccugugacaacccacauccguggaauaaaggaaccauguggucaucucacuagccacagaagcagcacugcacaauccaaugccucucaugauaaaaacacacuaggaauagaaugggaacuuccuuacccugauaaaggacagcuaugaaaaagccacagcuaacuuuauacccccuagugaaagacuggaagcuucuuuaccuuuaagaugaggaacaagggaaagacauucacaggcacuucuauucaacauuguacuagagacuccagccagagcaaauuaacaagaaaaagaaaucgaagggccaggaacggugguuuacaccgguaaucccagcacuuugggaggccgaggcgggcaggauugcuugaggccaggaguucaagacuagccuggccaacauggcaaaagcucgucucugcuaaaaauacaaaaauuagcugggugugguagugugugccuguaauccuagcuacaugggaagcugaggcaggagaaucacuugaacccgggaggcggaggcugcagugagccgagauugcaccacugcacuccagucugggugacaaagugagacugugucucaaaaaaaaaaaaaaaaagaaagaaagaaaagaaaagaaaucaaagccauccagauuggaaaggaagaagaaaaacgauuucuauuugccaaugacaugauccuaauauguagauaauccugaggaaucuacuaaacaaauuauacuuaauaaacaauuuuaguaaggucgcaagauauaggaucaauguauaaaaaucaauuuuuuuuuugagacagaguccugcccugucacccaggcuggagugcagcggugcaaucucagcucacugcaaccucugccucugggguucaugcgauucucuugccucagucuccugaguagcugggauuacaggcacacaucaccaugccccguuaauuuuuuuuguauuuuuaguagagacgggguuccacuauguuggccaggcuggucuugaacuccuaagcacaggugagccacccgccuuggccucccaaagugcugggauuacaggugugagccaacacgcucagccaaucaauuguauuucuauacaguagcaaugagaaggcugaaaguaaaauuaagaaaacgauuccauuuaugauagcaucauaaagaaaauacucaugaauaaacuuaaacaaaagugcaaaacaucauguaaagaaauuaaagaccuaaauaaauggaaaacgcaccccaugcucaugaacaauacuacccaaauugauccacaaauuugaugcaaucucuaucaaaaugccaacuggcuucuuuccagaaauuaacaaccugauccugaaauuaauauggaaacuugagggacuuagaauagacaaaacagucuugaaaaagacguacaaaguuggaggacucucauuuccuuacuucaaaacuuacuacaaagcugcaguaaugaaagcaguguggcgcuggcuuaagaacagacauuuuucuaaagaagauccacaaauggccaacaagcacaagaaaaggugcucaucauuuagcuaacaggaagugcaaaucaaaaucacaaugagauaccacuucacacccagcaggacggccauaacaaaaacccagaaaauaacaacuguuggcaaagauauagagaaauuggaacccuuauauguugcuggugggaauguaaacugguuccagccacuguggaaaacaguucaauggcuacaggcacacacuccaaagaauuaaaagcaaggacucaaacagauacaaguagaccaguguucacagcagcgcuauucacaacagcccaaggguggaagcaccccaaaugcucaucaacugacgaauggauaaauauguuguauaucacaaaaugaaauauuauuuggcaauaaaaagaaauugacuauugauacauggaugaaccuugaaaacauuaugauuaaugaaagccagacacaaaaggucaguuucuaugaaauguuuagaauaaacaaauccauagagacaggaaguagauuggugggugccaggggcuaggaaguuugagggagaaauggggaugugauugcuaaggagugcaggguuucuuuuggggugaugaaaacguucuggaauuacuggugugggcugcacaaccuugugaguauacuaaaaaccacugacuuguacacuuugaaaggguaaguugugcaguaggagaaugauagcucaauacagcuguaauuuuggaaguguugugagucauuggcagaaaauggcuuggaacacaaggcuaggcuagagacuuggggguuccuggccuggggaucccaggccucuguggauuguagauggaaggcgcugcagaugcacaugugcuucuuucugaaaaucaggcccaugaagugccucacccugacaaggugcggacgagguuacucaggggggacagggagaagugcccccuaaagaugggggagcacccguguuuaaggaggccgggaggcaggcacggggucccagaagcugaccugucuuuuggaacaaaagcuccuucuccucugaagaggcugggaccuggugaugcguccacccccagaagcgcaguccccugggacagcucauggcuugcacugcuuuccguaucuacuuuuuucaguccucuuguuuucccuuaguugugaaggaugguucuccucguaaaaucccggcuuugauugggccaaggaggaauguagaaagugaaaguuugcagccaaacucccacgguuucaaagggagcccagcaggaaagcgcacagagggcgcaugcggcaguggcccuccuccuggcgggucuccuuggggugggcaagucccuuccaugaaggagagcuuagggcgcagagcagggagggcccacccaaguucaccucccugaaggcaggcccagcccgaccugccgaggccuucccggagggcuguggggagccccaagggcuaccggugucgucccauggcucauuucaggccuggggugcagcucgggucgcucuccccuauccacacguccccacgagguuggccuuaaaugaagugcgacaccaauccuucuccaggaaagucaaaacggccccggaggaaucgcuuggagaaaucgcuugccguuugauggaaugacucccgaaaaggaagcaggaggaugggauccagaguccccgucaaccaaccaucccagcccuggaauccaacacggauuccacaggacgcccucucggucgcauuccuaucccgcuagggggcuggcaauggccacacaagguuuccaaacagcgggaacaagagacgaggaguggcagccgggaacugagagggaagaaggcggaggacagcgaacgggagaagccgagggccccgcgcacccccggagaagggccggggagagaggaccaggagcuccgccaggguggggcaagauuugcguccccgcccugccccucggcucccgcaccagguggccagaggagcucggcucacagcgugaagucaguccccggauuccugggaauucucccccgugcccagccccuccuucccccgcccccgcccccgccccggaguucucgccgaucccugcacggguucccccacguucucccaagccaacaccccuccugcaaagcacuugauuccuucccaguccagaccaauaaacccgggaguugaauccaggccacuaaacgcauaccugucugagcccugucugcuccugggugccuugaccuugaccucccuccacuuagcccuaggaggucucagcccacagcauccgggacauuucucuagacagucugcagggugcacacagaaaguacacaaaugcggggccgggggagccuccgcgcacacagagacggggcacaggaacgcacucacguagucacgccacgcacaggcaagaagccccguuccgggccgcggggcugggcuccagguccgagcuccgggccccgcgucuccuucccuccccgcggggcccugcugguccacgccccgcaaagcccggccaggcacugccacccgcagagagcccaacccgcugaucccggcggcgcccacucacccgagacgccuaaggcccgggagcccaucguucgggcagggccaggcgggagugggugucggggugggcacccagcccccggacggacuuggaccgcgcccggggacgcccacgcacucccacgcuccaggcccgccgggaucuagauucggcgccccccgcacggcgggagccuggcucccucccccgcccuggguccugcggggagagcgugugcggggaacugcgcucguugcuaugcaaccuccaucccgcgcccgccgcaccgcgccucccgggacggaagcgcgccccacccgggccaaccccaacuucccaccccacccguggcugguucccacggagcgccaacacccaacagccccaggaugggagggugcggacggcucccuaccuuguccuccucgagcccucccgcucucccacgcccgccgcuccgggccuccccacuggcccgcuccuccccgcggagggccgcgcccccgccgcagcgccggcggcccuaccugcagcaucacuuuguacugcuccuccgguuucuggaccacgcacauauuacaucccauguugcuggccggcgagaggaggcggagggcgggaacgggaagacgccuuucacugacccgggcgcgggaccucgggucccgggccggggccaggggccauacccuggcgcggggggcgggccgccuagcgggggaggggggcacgcccccgaggugggggcagcggcucgccccucagguuaacucuucgcuggccgaggccaggcgcgggcaugcucccucgcacccggccaggagaaaaagggcagcg

SEQ ID NO: 192829 - RNA, 4110 nt, Homo sapiens
gggcuacgcccgggcgcaagcgccaagagcggcugcgucuauggucaugacgucugacagagcguccacccgucuucgacaggacucuaugguucuuacgcgcgcagacagaccgccuauauaagccaugcgcaggcggaggagcgccucuuucccuucgguguggugaguaagcgcaguugucgucucuugcggugccguugcugguucucacaccuuuuaggucuguucucgucuuccguuccgacucucucuuuuucguugcagccacugaagauccuggugucgccaugggccgccgccccgcccguuggugagucuugaauccguguacuuucacugcugggaaacgggcggggaaagaagugccuauggccgcugaaaacaauugugggguggagccucccccgugcggcggcccugucuugggaacugacccuauguuuuacaccucccggcuauuuuuuagucugcaauauuacugucuguuccuucguucccgugucgguguggaagcgacgguucccucguaucucugccuguguccugcaagcucaccgcauuuucgggcgcuagauacgcucuuggggccuuugugugcguucucugucuuauuuccgggcgacgugccgcgugcguugucggacgugaagggcaguccgggaaaaacgggugcggccgccuccuguguccuacagggggcgccagacgcauuuccacucggcuuggagguggauuuagugccacgugcccgaaagucuuaaauugggugaccugagcugugcaaugauaaugcggcgauuuuguaguacgcagugucuugaagagagaauuuuuaacuaggaaaguuuguugcaaaguguuuauaggaagcguaagacaaaguaacggaagauggugucuguuguuucuagucuuggguguugucuguguugcagcagccaacuguugcuuuguaguuuauuuccccgaauggaaacgguuuagaaguggacgugcauuccccacccuuuucccgucccucguuuggguuguuccuugaggggcaaagugccuguugggcuuucugugaaccucaccuaaccuguguuuuuucacuccccugcaguuaccgguauuguaagaacaagccguacccaaagucucgcuucugccgaggugucccugguaaguaguggaagagccccugcacugguuggcucugcggacuccgcguccgucugugacacccccugcacacuuacccaauccuuuuagaugccaagauucgcauuuuugaccuggggcggaaaaaggcaaaaguggaugaguuuccgcuuuguggccacauggugucagaugaauaugagcagcuguccucugaagguaaggcaggauucuuuguucgucaccccccaguccuuccuccgugcucccucaaccccacccacauacacugcacuggaauugggaguugaugaaacaugagccuuacaaaacucagccaacacaguuccccugagcuggagauagucguggugaauguuucucuauuaucuucucucacuuugcugcuuuucuucucccuaccuagcccuggaggcugcccgaauuugugccaauaaguacaugguaaaaaguuguggcaaagauggcuuccauauccgggugcggcuccaccccuuccacgucauccgcaucaacaagauguuguccugugcuggggcugacaggugagcuuggucugggccuuuuaaggcaguuggagucucuacauuauuaggcuugcauuauuuuaucagagcauagagguggccccagugacucagccacuauggcuacuagaaaagccaggcuggcaagugacuuucaguggucacucaggaccccuuccugcagauacaaacaaagcaugaguaagucuuagcaagcucuuccccacagguuaggggaaacacuggugaugggaguagcucuucuugcuuuuagcugaaugacaaccaucuugccagcagguagcugaagcuggcagaggagcccaguggcgccuuuucagugguucuugggaugcuccgcagccaauuaagccgacugaguuccuuuccucauggggacccagugugcgauggcugcacacagcagcuuccuugguaguguacgcagccuguugguuguauggguugcucuaagggaccuuggagacaggccuuucagguggauguucauguuucugaccuugcacuaccccaauguaggcuccaaacaggcaugcgaggugccuuuggaaagccccagggcacuguggccaggguucacauuggccaaguuaucauguccauccgcaccaagcugcagaacaaggagcaugugauugaggcccugcgcagggccaaguucaaguuuccuggccgccagaagguauguagugcugcagcccccuucucccaccuuugccccaggccuccugacucaguucuuuccauugcuccuuagauccacaucucaaagaaguggggcuucaccaaguucaaugcugaugaauuugaagacaugguggcugaaaagcggcucaucccagauggcuguggggucaaguacauccccaaucguggcccucuggacaaguggcgggcccugcacucaugagggcuuccaaugugcugccccccucuuaauacucaccaauaaauucuacuuccuguccaccuaugucuuuguaucuacauucuugacggggaaggaacuuccucugggaaccuuugggucauugcccuuucacuucagaaacagguugacaacucagcccugcucaugaggcagcaaacccugcaaagggcugggacugguggccuuaugucaguugucuacucuggagcuugacuuggaccuccccagguccuaggcaguagguugaaaaacacugaagugcuuuucaugaagcacagcugcagcaaagccuugcaaucccaggcuggggucagccuacaguuguguugcuuauuacaacacaugcggaccaagaggggcuugugggcuagaggcugaccagcagcguuuauuuagcaaggguaggugugcaucacauugggcuuguucucacccaucugguuuggccauuccuccuuggugggaaucauccagguacugcugaggucaccugcgauuugccccauuuccuaucucuagcaaccuccugggccccaugcccccaccccuucuagaaccugcauucccagggccuucaccaccugaccaaaggucuaggcuaaccuuuggucauuuguaacaagaccucggaacagacacguguguggcaugguuuggccuggggaucuuagaugucugaccugaacuauuguagaacagcgcuggcuuuugggggagcagcaaaaaugagaggagugcuagguggguggccugagcaucuguauccagggacaggacuccaaaggcuuuuggucccagagcugggguauguuggccccagcccccagccuguggcucccaaaaggccucugguuuuuuguaaucucaguuuacagccauuucuuagguuuuuaauuaccuuuauuuuauuuugccaaacauaccugggaauaccuuuuauuuuuuuuuuaccuuggggugaugguuccaaaccauaaaugugauuauaguuaacacaugacccuucuagcgucccagccaguguuuuuccugaccucuguucuuuggagaggaggauggaagggagggguccggcacgcugcuggcauuuugcuguguccugcagccccuuuccgggacaccuggguucacacagcuuuuuagcuuacauaacuggugcagauuuucuguguggagauguugccuugaccagccuuggcuggacuuuaccaggcaugcagaagccuguaccaacacagacuacagcacccaggaggugcgaguguggcugcucagcgguuauaacaggccugacugcauuguucaccggauuauaaugagccaaaauguuucccgguguuugcugguuucagggaaggaguuugauauagcagauuaaccacccuccuuguagcuauuggggcuuaaugguuuccuggugauucuuaccaauccacaauaaacauggcccauuggcauaucugc

SEQ ID NO: 192830 - RNA, 11240 nt, Homo sapiens
cuuagccgccauugccgggccugccuggccacccugcgcagcggccuugcguccucuccgggggcggagcgggucggcgggccugacagggaaccucccugaccgagcccacgucuccccacggccagagaaaucuccggcccggcccgcaucgccagcccccaggcccggaggaacggcccgagcccaggagaaccacaucuucgucccagccccggaggcuccugugggcaagaucgugagccaacggguuccugaggccccuccuggccaggcaggguuuccccgcgcguuuccgaggagcccugccuggccgggcggcuggacaaacaggucguagcaccgaucgcgcccgcccccagcaggggucccgcacaggcuugccccugacccccacccaaaccuguccuuccgcuuugcccccaaacagugcacuugccggcggucccaacccagcaggagaaguggacaugagguuggcagguggguggcuuccacagcgaacgggagggaguugaaaagggcaccuggcuggaggcccagcgucgcgacaucugugucuggagaggcccgggugaaccacuggguuugguuuuggaaauggaggacucugcacaaacacucguuccuugaccuuaaccaaauccuuucaccucugaggacgucagcuccccgagcuaugacaugaggauuaguauagucaguaucucccaacgcagguagcagaccagcugcuuuuuggaaaaugaguggugagagagaggaggugggcaguccagguggagaggcguggucuuagaggggaagugacaaaaguggcugugggcuucgacaugaacccgaugacagcccuacugucaccuggacaaguaagaugaagauccuuggggagggauagguuggggcuggguggagaguagaaacaacucgggaauuggacuucagacuugcuaaggugguaacuuuguggacauauccagguggagcuggccacugaggaaccagcuggcagggagugguuucaagagaggccacggcuggaacuagaaaauagaaagucauugacacauggugcuuaauuaaagagcuaggaguagaugacaucaucuaaaaacacacuacaggccgggcgcgguggcucacgccuguaauccuagcacuuugggaggccgaggugggaggaucacuugaagucaggaguucgagaccagccuggccaacauggugaauccucaucucuacuaaaaaaauacaaaaaaaugagccuggcgugguggcgggugccuguaaucccagcuacccgggaggcugagguugcagugagccgagauugcgccaccgcauaacuccagccugggcgacagagcgagacuccgucucaaaaaaguaaagacagcugggcgcaguggcucacgccuguaaucucaacacuuugggaggccaaggcggguggaucaccugaggucaagaguucgagaccagucuggccaagauggugaaaccccgucucuacuaaaaauacaaaaauuagccaggcauggccgggugcgguggcucacaccuguaaucccagcacuuugggaggccgaggcgggcggaucacgaggucuggagaucaagaccauccuggcuaacauggugaaaccccgucuuuacuaaaaauacaaaaaaauuagccgggcgugguggcgggcgccuguagucccagcuaccagggaggcugaggcaggagaauggcguguaaccgggaggcggagcuugcagugagccaagaucacgccacugcacuucagucugggcaacagagcaagacucugucucaaaaaaaaaaauuagccaggcacgguggugcgcgccuguaaucccagcuacuugggaggcugaggcaggagaaucgcuugaacccaggaggcggagguugcagugagccgacaucgcgccauugcacuccagccuggggggcaagagcaagacuccgucucaaaaauaaaaaaaauaaaaagacacuacagguagggaccagaaggcagccugagaugggagccugggaaaguccagcuuuuaaggggaggguagaggagacgaucuaacuaaggagaaugaggaguguccagagagauugggucaggagagugugcuguccggaaagccagcagagaaguuagugcuucugucagguggacaugggcagcccacugagaggucaaggaagaucaaggcugacaggucaccagggguggugacaccacaaaggucaucaguggccuuggcaacaagcugauuuggugaggugguggaagccaggccagacuggaguagggugggagggaguaggaggugagaugauggaaugaguauagaugacuuuugaggggguugacagggaaaagaaagguuaggggaaagaggauggggaugugguuuugaagaagaguguuuucuuugcuuccuuaacauuggagauguugaaaauacaggagaaagagcgaacuagagagagugaucacuauuacaagaaaucagagaaggcuggggagcuugcaauccaggucccagcagaugacgggacuguuguuguuuugguuuuguuuuguuuuguuuuuguuuuuguuuugaggcagagucucacucugucgccaggcuggagugcaguggcauggucucagcuaacugcaaccuccgccacccagguucaacugauucuccugcuucagccuccugaguagcugggauuacaggugcgcgccaccaugcccggcuaauuuuuguauuuucuguagaggcaggguuucaccaucuuugucaggcuggucucgaacaccugaccucaugaucuacccgccucggccuccuaaaguucugggauuacaggcgugagccacugcgcccggccgggacuggucuuaaaagggaguagggacccuucucccucagaacaggaggaaagcaggggcagguggaugcccaaauauauuggugguuucagaggcaggaaguugaggggguucuuggaaagagggcuggagcccuucucgagcagagaguucuggaaggcccccucccagacccgccagggaaaaccaaacccagcagccuugggauuugaacucaauuuccuccuuccaccugccagggagcucaagucucccuuucagcccugguagaaggcaacaggucuccaccuccuuguccuccagccacuucuucccaaguggcaggggagauccagucaugcaaggcuauggggucauucugggguucgcugguaucugaggugaccccacccugugucuauccugccuccaggcccucuccgcauugugguccuagucgucagugugggugucacauggaucguggucagcauccuccugggugggccuggcaguggcuuuccucgcauccagcaacucuucaccagugagugugggaccccgccuuauccuucucuggaggccaccaagguggccaccugggccugugguugaggcucuggguugggaguugacuuggguuuucuaucuccucccuggcaggcuaccuuuggcuguccccagucugucuccuggcaucaggcgcagccucccccaacacccaguugcuucaucuaggaaagccaauaccugaucacuagaauuauaugcccaacuggagucaguagggccagaguaagggguagggagcuuccacugaacauggggagugaugccccgguugcucccugcaggcucugagauggagaggggacucuccaccuuguugacugguaauaggucaccugaguacuuuuuuguuuguuuguuugagacagugucucacuuugucucccaggcuggagugcaguggugcaaucucgguucacugcaaccucuaccuccuggguucaagcgauucuagugccccagccucccgaguagcugagacuacaggugcgcaccaccaaacccggcuucuucuucuucuucuucuucuucuucuucuucuucuucuuauuauuauuauuauuguauuuuuaguagagaugggguuucaccauguugcccaggcuggucucaaacuccugggcucaagcaaucuacccgccucagccucccaaagugcuacaggcaugagccacuaugcccggccaggucaucuaaguaguuuuucuaauuccauuucccccuguuccuagaguagggaguuuuucaucugaacaugacuuacacuugagcaggaagcaugccaaggucggccuggcuuagcccccggccccugagccugacugccugugucuacacuucgcgguguaaggagggccaggcugcccugccgcaggccccgggaggcuccacacuaacagaaaccacucuguauccacagguccagagagcucggugacugcagguaaggccccugucaccucccugcuccuccccuuugugacaucccugccugcccccggucccguagggcuucgguuuuccauuuauuccuccccaaaccagcuguggugguccacgggggcugcuugccacugucaaccuacaaaacaaguuacuuccugccaaguuacuuccugccagaauaugacgguggggcaggccuaggauagauacucccacugcaaaagggcaacuuggaaggaaaaaagaggucacccgucccaagcaaguccaaagcccagcagggcaaaauucauuugguuucaaggccugaggggaauccucuguggccugagauucuuucuucugggccugcuggaaugacccaugcucugaaacgagacagccccaccuucggggccacccuuccuucccuuuaucucaucucugcccccuucacuccaggccggcaguguuucugcuggugucagauucucaagagccuuguuggucucuuuugcaaguuauagaggcccaagcuauaaaaucagagaguuuucccacagacgcuuccuagauaaccccaucuucauuguagauuucugcugaaaggguugaguggacccacgagucacauaccucagcucuggggcaaacgcuugaacagccuugcuguucuguccaggggacacuuuugcaguuuuuguaauaugauuaggccaagaauuuuccacaucuucgcuuucuggcuccuuugugcucaacaguuucuuccuuaugucucucacauuuuacuauaagcagcaaggagaagucaggcuacgcucucaacacugcuuggaaaucuccucagcugaauauccaaguucagcacccagcacuuacacauucuccuuucgacaaaacacuagaacacaauucaaccaaguuuuuuuuuuuuuuugagacggagucuugcucugucacccaggcuggagugcaguggagccaucuuggcucacugcaaccuccgccucccggguucaagcgauucucccaccucagccuccugauuagcugggauuacaggcaccugccaccauacccaacuaauuuucauauuuaguagagaugggguuucaccguguuggucaggcuggucucgaauuccugaccucaagugauccucccgccuuggccccgcaaagugcugggauuauaggcgugagccaccacaccugggccaaguuccuuuauaacaaggaucagcuuuccuccagcgcccaauaacucaauaacaugucccucauuuuccucugaggcuuaaccaaaagcaccuuuuuuuuuuuuuuuuuuuuuuuugguagagacagaggucuuacucuguugcucaggcuggaguucagugguaucauccccgugcacuguaagcucaaacuccugggcucaagcgauccucucaccucagucucccaaguagcugcgacuacaggcaugugccaccacacccagcuaauguuuuauuuuuuauuauuuauuuuuugaauguauugagacagggucuugcucucucacccaggcuggagggcaguggcgcaaucauagcucaagugauucuccugccucagccuccugaguagcugggauuacaggcauguaccaccacacccagcuuauuuuguauuuuuuguagagacggggucucacuauguugcccaggcuggucuugaucaccuggccucaagugaugcuccugccuuggccucccaaggugcugggaucacaugcgugaaucaccacacccaacccaaaagcaccuuuaacauucauguuucuagcaacguucuguucuugaugauauuuguauucucuaagaccacagaggcugucucuauugcucuccccuccucucaccagaauuaccuuuaacauccauacuccuaccaacagucucuuaaaggcaauccagaccuuuucuaacauguaccucaaacuucuauagccuugauaugguuuaaaugucaucucuaaaacucauguugaaauuugucaauguauugguauugagaggagggccuuuuugagguaguuacgucaugagggcucugcccucaugaauggaugaaugccauuauuaugggugaguuaguuaccuugaaguucagcccccuuuuuuccugcgucucauaugcuugcuuccaccuuccaccuuucugccacgggaugacccucaccagaugccggcgccaugcuuuuggacuucccagccuccagaaccaugagccaaaugaaucuguugucuuuauaaauuacccagucugugguauucuguuauggcagcagcaaauggacuaagacaagccucuacugacuacccaguuccaaagccauuuccacauuuuuagguauuuguuaccuaagcaccacacuuccuggugccaaaaccuguauccauuuccuggaacugccauuucaacuggguggcuuaaacaacagaaauggauucucuccccauucugaaagccagaagucugaaaucaaagugucagcagggcguuacucacccugaaaguucuacaggaggguccuuccugaccuccccagguuccaguggccccaggcauaccuuggccucuggcugugucacuccugucucuuccuccacuguaccauggcugucuucccucugugugucuuugucacuucuguucuuauaaggacaucagucauguugcauuaaggacccaaccuacuccaguaugaccccaucugaacugcaaaggcccuauuugcaaacaucacauucugaaguaccacagauuagaacuucagcauaccuugaggggacagaauucaacccauaauagaagccauccugcuccaguccucccaaccaacccccaucaaaaucgggagacaggcugcacccccugccacacuacccccugccacacugccuuugcucagguuggccucauccaugcagcuagacccccagccugacuuacuucaccccugcuuuguuccuggcugugcaguggcccaggccagcccucagcauccuuucuuuucucccaccaguaacagaaaauccuucugucuugggucccuguggccucaccaguaggacacagaguauggaaguguccccagccucggccugagccacaucccccuacuuguguccugcucugcggucacuuguucuaccaugugugcugguccugaccuccccuucagaucucaggugaccucagggccaggcccauggauaacaccugcuaucccugcccagcgccacgggccaggaaguacaaguguggccugccccagccguguccugaggagcaccuggccuuccgcguggucagcggggccgccaacgucauugggcccaagaucugccucgaggacaagaugugagcucccuggggugacuggggaucagggagggagugggggauccagggccgggucugcaagggagaguggagcagacgugcccaugugggaucuccccgucccccccacccccccccaacuaggcugaugagcagcgucaaggacaacgugggccgcgggcugaacaucgcccuggugaacggugaggccccuggcugagcguggccugccgcccuccuucccugcucccuccccaggaggccucuggguguuugcccucccuuccccucccauucaagaucucccagggaggccugggaaggagucugugcaagcgcaaggcuccacagaggagugacccaaugaacaaaaaagcaugauggcaauaaagaacuagggaagguucugggagguugagggugcuucauggagagcccccggagggccucaaaugccagacagaggcaccacggcuuggggugggaugcagcugccugaacaaauggaugaauauugggggacuguuugaaagcuuccagaagggcugccccccacccccggugcuacccgccugccgugcccugaggcuggccuggcuuacccagcagggccccucccuccugacacaggggucagcggcgagcucaucgaggcccgggccuuugacaugugggccggaggugaguugcagcgcagcgucuugcauuuugacugcagcaaaaugaccugggcagcuuccccugagacacugcucucucugucuguacuuggagcuucucagucaccuccguggguucagaaaggacaggggcaucgccagcuuggucuggaggcugugggaggucacggggaugccucagcuuccuacaccagccugucccuuggcggggcaugucccaggcccaaucccuacuucuguuuccuuguuuggagaacgggcuugugggagggugcucaguggugccugaugaccccuguuccguggcaccugcccccccagaugucaacgaccuguugaaguuuauucggccacugcacgaaggcacccugguguucguggcauccuacgacgacccagccaccaaguaggugcuuggggaggccagccucagccuugcccuucugcagcaacagcugacaccccuuccucccaugcugcaggaugaaugaagagaccagaaagcucuucagugagcugggcagcaggaacgccaaggagcuggccuuccgggacagcuggguguuugucggggccaagggugugcagaacaagagccccuuugagcagguauggggggugccuggcaucacccccaccggggcagccugucgccccuucugccugcaugcgacgagccuccccagcugcucacgccccagcaggggaccguccccaguccagcuaugaggggugggccagugcagcugaugccauguuucccugggauggguggaggggccaagugcccugagaguacaccguuggccaacacagcacaguugacugacagccuggguccugguccacuccuguccccugucccugagggccaaagucaugacuuucugcuccccuccccacagcacgugaagaacaguaagcacagcaacaaguacgaaggcuggcccgaggcgcuggagauggaaggcuguaucccgcggagaagcacggccagcuagcacggccagugccaggaccgggccgagggaggccagaccaagggaggcacgcgcgcugccgggcggacagaggcugaggcucacaccccacacccgggcaggagcgcucccuggccccaacacaucggggcuccgaggcagugaccagaacguggucucaagguggugggggcuaugggggcugcaggggguagcccugccgcacuuugucacgggagcccaggguacccgccuccuuuucguaacacuguuccccccggucagcccaucuagcccuguccuccauuccucacgccaucuccauccccaucuugaguccuggaacggcccugggugccugccccucacugugcaacucugggagcagcccggcagguuggggcgucuuccagaaccucucccuucuggagccacucugcacugcgggcuaaacauguuuccagugugauuccuuccagugagccaaacccgguggcugcuucaugagccugacugccucucgccugcucucagcaggaagggaccccuggagcaggcuggcccgggguggugaaguagcuggagcccgaucacagucccgcgguuugucagggggcccaccuucuagaugaccccuuaauaaagugauggccccacagaagaaaugccuucagaugcuguugucagugcggagucagagguggcgguguccucuggggugcgggaggacagauuccagagucuuaaccaaccugcucccacagcccgagcagacagccuuuugucuccagggcuccugccaccaacaggccccgcugcgacugagaugugacucaagcagucaacagagcagugggacucuuuucgucuggcagagaagauugcacacucgggcugcaggaagcugacucaacaacucccucugacccagugcaggccuguacggacagggacagggauugggauuaacaccagcccaggcccccaccacaccccaucaucauccaggagcacaugucgcccacagacuucggcugccuuugaagucaggguugugaggggucgagucacuugggcuuuuugcgucucucccagguuacgguuaauaccucccuuugcuaagcgagagccagcaaauuagaagcaauuuugcuggaauaucaacuccagaggcccagaagcagucugaguucagcgaaaggagagaaggcaguuccuagaugggaggcacugugguguccuucauggggcgacguuaggggcgauggacuuaggagccaaucccaggaagaguacagagcgcagacagagccucagaagacaaaagugcuucuggagcaggcacaugugggguuggaggcacaggggugcccuggaggagcggcucaccagggaggaaacgauggugaugccaguccugccucugcaccaggaacuuucuacguguauuccauuccuuuuuuguuuuuguaaacuuuccuucuuagagccauuuuagguucacagcaaaacugagugaaaaggucagaguuccugugugcccccugccagcccccagcuucccaucuguugcugucaaugaaccaguaucggugcucacaugaggcuucaguuugcuguuggacguucaguggguuuggacaaaaauguguaaugauggauccacugcaggaucauacacacuucacucuuuagacuugcuauggaaaauugcaaacaucuccaggagacagacuagcauacaaucggcccuucauauccauggggguuccauguccacagauucaaccaaccacagauuggaaauacuuggaaaaaauaaaaauacaagaauaa

SEQ ID NO: 192831 - RNA, 22803 nt, Homo sapiens
ccugaacgcccaucaagcccauggcccuugugauccagguggggaaacuaaggcccagagaagugaggaccccgcagacuaucaaucccagucucuuccccucacucccugugaagcucuccagcaucaucgaggucccaucagguggggaaagaugcuguuccaggcgcacacuagucuacaaggccagagcuuucuggaagggggcaguaaguaccucggcucccuuucugguaggggugggaguccugagaaggcaggaaguggcccacuugguaacucugaggugccaucagggcccccaggaaggaagcugggugugugggcaagugugagguaagcuggccagggaggaggaagggacagaggaaggccacguggguccagccugccccaggguguccugcuugcccaggcugugggucugccagccacuugccugcuuucaguuucuaggucaugcugagcuuguucccaacucggggcuccgggcauuugcucuuccuucuguguuugugcucucccggcccucuuugugggaucuaugcgcuuugggggacuggggacacagggcccauguguaucuucugaaacacacgucagccugaacucuugcuggucugcuuacuugccgugguucccuggccgcaauagcacauaggucccaugaggagggcagggacuggcugcuguggcccagaaguacccaaucgcugucugcucaaugaacggagaaugggcugcuuuccuggaacagcagauucuaggaucacgugcccucaagugccacccugccuaccucccgcaccgagugaggcaucaggcguggaagaagcccgggagccggagcuguuccaggugcugccugagcacgccaccucccaucucccccccagcaggaagaggaaaaaacaaaccacgaggcucuucagagagaggaccccuuguccccuacccacagugcuggagcuggcacuuccuauuucugcuuugaaagccucagguugucacucucagaacagaggagagcaaaggggaacccuacugauuucaacaaaacaaaguugcccaacccgaagcuggccacaggcggaggcagugaaaugacaaaaucagcuuggaaaagccuaaggacccugggcccucguuucaaaagcugucauuugcuacacgaaaugcugagguucaggaaaaggaagacacuugcuccaacucacacagcaagcuuggaugcucucaaugaggugucuaauaagagcugaaggccaggagucauaagcuaucauuguggccuggguugcucuguugcagugccuugugacagcaugggguggggauggagaaagcaaccucaguuaccuucuccuccagucugcuucuuggacuaaggguuuaacggucagaguccuggcuguuaagguuuguggcugaugcagguauggcucuuuuuauuuuuauuuuuuugagauggagucucacucacuccgucacccaggauggagugcaauggugccaucucagcucacugcaaccuccaccuccuggguucaagcgauuuuccugccucagccucccaaguagcugggauuacagaugggugccacuacaccuaacuaauuuuuguuauuuuuuuuuuuuuuuugagauggagucucacucugucacccaggcuggaaugcaguguugcgauuucugcucacugcaagcuccgccucccgaguucacgccuuucuccugccucagccuccugaguagcuggacuacaggugcccacaccaggccuggcuaauuuuuuauuuaguagagacgggauuucaccauguuagccaggauggucucaaucuccugaccucaugauccacccgcuucagccucccaaagugcugggauuacagacgugagccacugcgcccggccuuuuuguuuuguuuuguuuugagacagagucucgcucugucgccaggcuggagugcaguggcgcgaucucagcucacugcaaccucugacucccugauucaagcgauucuacugccucagccuacugaguagcugggacuacaggcacgcaccaccacgcccagcuaauuuuuguauuuuuaguagagaugggguuucaccauguuggccaggauggucucgaucucuugaccuugugaucugcccaccuuggccccccaaagugcugggauuacagaugugagccacugcgcccagccaauuuuuguauuuuaaguagagacuggguuucgccauguuggccaggcuggugucaaacuccugaccucaggcgauccaccugccucggccucccaaagugcugggaauacaggcgugagccaccgugcccggccagguauggcucuucugaggggaccaggcuggggcuggggcugaggccaagcccaaucuacugugggcuccaccugguaccucuccugggucucaggcuuauggggagucagaggacaauggccccuccuuacucugccacuggcagagcccuucucccucggcugccuccucauucccuuuuggcucuccuuuucuaaguucugaucagaaguacaaaggugucaaggaguagguuugacaaagugugacagcgcguuguucuaugugaacaaagaaccacugagcucagccagcacugaggggcgcacgauguggaagaacuaacuaguuuugauagagcuccugcucaagguuacaagguaaguuaauggcaaagauggucauacaguaaugagcagagagauucuugagugcauccaggguuaaaagugaaaacugagaccacguguaauuugagaugaagcccuuguuccaccagccccugcacagucucacugccccaugggacacaggggagggugcucuagucucgggcgauggcuguccuaggaccaccccucccuccccucccauggaaauccucaugcuauacuauucuuuugucuuuccuaugagugcagaauggcgguucuacaagcuggacaauuggggccagguggggugaggcagagcuccuugguaggcuuucgaaauugaggcaaagagacaguguucaaagaaaagcuaaguguuuguaucgacggaacuugaaguguuagugaagaggcagagaucaggccucagauccugccuuuggaacucauuuguuaaggcaugaacaggucugaaaaaacuacagaaugaauagcauucccuguuuuccccaagaaguccaucuagacagucccuaaagagccugcaacuccaggauuaagggcuacauucagcggcuaggcacaggguucagaaacguccugcagccgggcgugguggcucaugccugucaucccagcacuuugggaggccgaggcgggcggaucacuugaggucaggaguuugagaccagccuggucaacauggugaaacuccgucucuacuaacaauacaaaaauuagccgggugugguggugcaugccuguaaucucagcuacuuggggggcugaggcaggagaaucgcuugaacccaggaggccgagguugcagugagccaagauggcgccacugcaccccauccugggcgaccagagcaaaacuccgucuccaaaaaaaaaaaaaaaaaaaagucuugcaagugcauaugcacaccagguagagccgggaugauccuggcgcacuagcaggagcgggaggaggagcucaacuuagcagagccuguggggcccugcaacaauuaguuggaaaagcugaggcauggagcaggcacuuccuggcuuuuaagauuggggccugggagauacucaccgaugcacccaugaugaugaauauguguguauccgacugauggaaggcaucgcccuggaaaagcucuucccgcaggaucccgcacaccuggguccggcucagggccaccugcucugccaugacgcugucugguggaagaaaggcucguuaacaaggcagaagaacaggagagcauugagaaguuagccccuuucuugagaguuccucuggggucucacaccagggugacaccugauugcccaaaucacuccuugugaacggcugggcauuggggagugguugauggguuagaaacugcuggcucugggcuccagccacucucuccuaggcagccuucauucaggguguacauuacaaaauuacucaaagcauugguguauuccgacuacagcaucaauucuggacaaccgaguaaaauccuuguggggcauggaacugcgugcccaggaccaucucauucccgacuguagcgggaacuccacaaugaccuggagcaugggagauggugcagaugcuggaguucagcuccagcccuccccuugccaagcugggugaccccggucggcaaguccccuucgcucucggggucucaggggcucaagagaggaggugcgggguauaaagggauugguuaagacccucucgauucugcucgguucucaagcacaacaaacagcguguauuuuaccgccgcgcggcgcagcgcgggacaguacgcuccuccgccugcgcggcgcccgcccggccgguuaccugcgcuucgucgucgucgcccuccgcgcucgcagccccgaaguguacgaccguuuccgggggcugagccccgccggcccauuuaaucggcgggggcgggggcgggcgccugggcugagcggacccgccucaggcgaggcgugcggggcggggccucggccaccaccccucgugcgggcggggcggggcgagggcaggugcgcgcgcaucccaggccagccccugccucucgggcaccugcgcuggaggccggcccgccggcugccugccauacccgcugccgcugcucugcauccccaauuccggcgggcacgggugcagcuccgcguagugcucccgaauccccaucgccggccaggccccgccccuacuguccgguuuccccgccugccccggcggccucgcgcgcucgcggagggcuccacuuccgccggcagcguggccacgccuccucugggcugucccucggcuccugggcggggccuucugccgcgccacucccccgggaacccucgccuguucgcgggucaagccggcccuauugggcagucucuucuugauuccucccccggagagggcggggcggccgagcgccccgaggcuagacgccgccguccgagagacgagggggcguguaggcggugacgcccugcaaaguggccggcgugcuuaucauuaccgagcuuccgcgggccugcagagccuggcggacucagacuucucuccggagcgggaugcggcccuaccgcggccucacacuucucgccggcuucccgaguucucgggggcggggcuuguguuuuuacuuccggaucccacagcuaugacaccggaagccggaagcgugguagggaagggcgaccgcgaaacugggacuuucucggagcgccggggcccuaccagcguucacaguccgccgcucccacccuucucacgucugacggacucugcugacaggugugguccuuuuccccaaagacaggguuccauccgugggcguuccgccgccuccgaaacuucccccggacguucaggcuccccccucuuuuuugggccccagcccguuccugcuccgcgcuucuggagcacuggccaaggcgggccgauucaggacccagguuacuugggcggcgagcuggacuguuucuacuccucccuccuccuccacugcggggucugacccuacuccuugugugaggacuccucuaguucagagacauauucuguucaccaaacuugacugcgcucuaucgaggucguuaaauucuucggaaaugccucacauauaguuuggcagcuagguaucugauuucauaugccuguuugcucguuuugcaagacaacaucugccuaucgucauacuguuucugugaucugagaaugaaugggcucuccuggcacauuagaggaauagcacggaggucacuauagcuggagcagagugagggaggggagcacaguuggagaggaagggauggggaacccgaugguacagggccuuguaggccguuguagggagauuggcuuuuacgcagaaggcaacggggauccaugguaggguucucaguagaggaggaaugugaucggaauuacgucuuacacugaucguucuagcagugguggggagaacagaccauagugggcaaggguaaaagaaggguggcgugguaagagguaauugcaguaauccagcucagagacagugcuuugagcauuuuauuauuggaaauuucaaaaauguacgaaaguagaaaaaugaguauaguaaaucuuuuugguuuguuuguuuuugagagauggagucucgcucugucgcccaggcuggagugcaguggcaugaucucagcucacucuaaccuccuccuccuggguucaagcgauucuccugccucagcuucccagguagcugggacugcaggcgugcgccacuacgcccagcuaauuuuuguauuuuuaguagagacgggguuucacuauauguuggccagucuggucuugaacuccugaccucaggugaucugccugccucagacucccaaagugcugggauuacaggugugagccacugcgcucggccaguauaguaaaucuuacauucacagcuaccaacuucaacaauugaagguaucaacuucugacuaauuuuguuuauaucccucgcaauccucucccauuauuauuuuauuucuuuuucuuucuuucuuucuuuuuuuuuuuuuuuugagacagaaucucgcucugucaccaggcuggagugcaguggugugaucuccacccacugcaacuuccgccuccuggauucaagcgauucuucugccucagccgcugggacuacaguugugcaccaccacgcccagcuaauuuuuguauuuuuaguagagaugggguuucaucauguuggccaggauggucuugaucucuugaccuugucauccgcccgccucggccucccaaagugcugggauuacaggcaugagccaccgcgcccggccucuuuuuuugagacccagucucacucugucgcccagaauggagugcaguggcacgaucuuggcucaccgcaaccuccaucucccagguuugagcgauucuccugccucagcuucccaaauagcugggauuacaggcaugcaccaucacucccagcuauuuuuuuuuuuuuuguauuuuugguaaauacaggguuuugucauguuggccaggcuggucuugaauuccugaccucaagugauccacuugccaugaccucccaaagugcugggauuacaggugugaaccaccaugccuggccaccacuauuauuuucaauaacagcuugagauaucauuagcaugucacacaguucauccauuuaaaguguacaauucaaugguuuguuguauguauauucacaggacauuuucgucaccccucaaagaaaccccauacccuuuagcucagcuuaucuuccccucagcccuaaguggcacuccccagcaaucuuuaauccacuuuaugucucuguggauuugccuguuguagacaucuuauauaaauagacucauacaauguuuaaucuuuugugacuuguuuauuucucagcauauuuucaagauuuguucauguuauagcauguggauguacuagauuuuguuuauucauaguugauggacauuuggguuguuuccacucucuggcugcuaugaguaaugcugcuacaagcauucauguggacacauguguuuucauuucucuccgguauauaccuaggaguuuucccauuauuuggaggugaauucagacaucaucuuuaaacauuuaagugugccucucucuaagacaggacucugaaaaacaaccacaauaucauuaugacaccuaaaauaguuaauguuaauugcucagugugaucagaucgguugggggauacauuuuaacaggauuucuugauggauuagaugugcucuuguguguguguguguguguguguguaugugugugugugugugugagagagagagagagaaucaaaaaagacuuuugacagcuggaggauggauucgccaucagcugauaacaaagaaggccuuggguagaucuggguuuuggggacugucggaggucuuagagagguucguuuugagaaggcuacuagauaaccaaguagaaaugucgaguuugauaaaugaauguggaguuuagaaaagaggucuaauuaagcaucaagauuggaguucaaggcaugagacuggacagaauuccugugggagugaaugaaguuacagagaagaagauguccuaggacagagcccuggggcagcccaacaugaaggaugggaacccagugagagugccugggcaggaguagccagcaagauagggaggaaaccaggagaaggggcuguucugaaagccaaggguggagugcaguggcacaaucucagcucacugcaacguccgccuccuggguucaagcgauucucuugcuucggccucccgaguagcugggacuacaggcgcgugucaccacacucugcuaauuuuuuguauuuuuuuuuuuugagauggagucucgcucuguugcccaggcuggagugcaguggcgcgaucccggguucacgccauucuccugccucccggguucacgccauucuccugccucagccuccuggguagcuggggcuacaggcgcccgcuaccaugccuggcuaauuuuuuguauuuuuaguagagacaggguuucacuguguuagccaggauggucucaaucuccugaccucaugauccacccgugucggccucccaaagugcugggauuacaggcgugagccaccgugaccggcaauuuuuuuuuuuuuuuuuaguagaggcaggguuucaccguguuagccaggcuggucucgaucuccugaccucaugauuggcccgccucggccucccaaagugcugggauuacaggugugagccacugcgcccggccagacauuuuaaucucacaguucuggagacuagaaguccaaaaccaaaggguuagcaagcacacacccucaaaggcucuaagagggcaauccucccuugccucucccaagcuucugccccauuuauuccugggcuuguggcugccucacuccagucuccgaggcagucccgacauggccuccuccccuugcgucucccucuggcuucucucuucugucucucauaaagacacguuguuggauuuagggcccacccacgucacccagaaugaucucaucuugagauccuacaucugcaaagacccuuuucccgaaucacauauguuucagggguuagaacaugggcauaucuuuucggggggcuaccauucagcccacuacacuggaugaggggccgguacccuccacuucuccugcuuggagguguguaggggaucaggauucccagcauacugacaucucccuccacaaacagucuugucccgacucucccaucucuggugaaauucuucuauuuccagccuggagcuaggccuuuucaagucccacaugggugguccagcaccucccuuuggaaugggaguaucugcuaccccuuagacugaaaacccacuuuagcauccugauacacuaggugaauuaucagcauucuguuuaaaauguagccccagaacucauaggcuuuuucugcuggguaaggaugugggucuccugugacuccccugcugccuuucucuuucagcccuugcccuguuggaugaauaggcaccucuggaagagccaacugugugagauggugcagcccagugguggcccggcagcagaucaggacguacugggcgaagagucuccucuggggaagccagccaugcugcaccugccuucagaacagggcgcuccugagacccuccagcgcugccuggaggagaaucaagagcuccgaggugaggaaagagucaggggauccagcccugcugaggggaaggcgucuucuccccaccugcaccucugcguuuccugggccugggguggggaugugcugcccucccucuugguuucaggaaguagacucugagaugcagauuagcggggaggaaguuuagcaugcucucaggaccaguacugggaagggaaaggagggacaggggaagaagccagggagggcagagggagaagcacgcugccggguaggcuccaggacagccuugcuggaucuuacagggagcucuggagcuggaaugaaccuuccagguuggaccaacauguccaggccucugugucccugcacugagcacucaugaagugcuguccauccugggacagggcagagucggcgcugggaagaggcguggucugcccagagaggggguggggccuguccuggaaaugggcggggcaugcccugguagaggggcguggucugucuugggaaggaaggugcguggcccccacaggcaacauuccucuggggcaaucccggcgcacaccucagcggaggugaaggcugacuucccacacccaguggcugggacuggggaguucuuuccuagacugccauccgggcgccccucacccucuugcugcucagcuccaggucgucauggguucagggcucagcugcacgcuccugcccgcgcccugggcgugauggcacccccagccccugccauucuucccccucacccccucucccugccacugcucugcauugcccuggguuagccuggcggggccagguggcacccgccauauacucuugccuuucugcugcgggggccuucuaagccucgggucccagagcugcagggaggggcggcauagacuccccacauggcucacugggugugguggggccuguagcccuuuuuguuucauccuuugguuccugcuggggacucaggccuaaguguccaccccaucguggaggacaacaccccuuccuugcaggagucaucccugagcuggcagcuucaauuggcucuccguguccuggcuggcuggcagcuccugggcgagguggcaugugccgugacuacuagagaucgcugucaugggcccacucccccgccuucuuugcuggacugugguccgagauguuauguggggcucugugcugacaagucacauagucuguaggcuucagagaguggcucuggcugacaccccgugggcagagacaagacccaugccugcgaugugucuccucuuacugucaaggcaaaucaccuuuccuuccauggaggaaggggucagugcagucagcuugcugucagggggcugcuuggucuccucgacggugaggcugaauuggagaggcccugcuggagcauggagacccaacaugaccugccuguuccaggacagggucccccaccucagugccaucggcaccuggggcuggagaauucucuuguacguuguaggguguggagcagagucccuggccuguaccugcuagaugccaguagcaccuguccuguugugacaacuaacaauauccccagauauuuauugccaaaugaccccugggggauacaguugucccuggugagacccacuguauugggaucuucagagcacuggugcacagagaggugacaguuagacugggggcuucugcucauccccaggagagugcucuauugagggggacuugagggugaguguugcaggccagcugugcagggacccuggcacagcguauggcgcccuugcuucccuuccaggcuguguguucagugcagcagcuucccucgggcuccagggacacaaggaggccucaaggcuguauugacucccccugcuccgccugaccugagcuuuguggguggcaggugaaacuugguagcuccaugugucaggcccugggccaagccccuaagggcccagaagaugucugucccccaagauguacaugcuuauguccauggaggaggcuguacuuagaauguugagggagagauucacgaagaaguugcaugucucuagugugugacuccacuagugugagacauguccagaaguggccaaucugcagaggcagaugcagaugaggagggugcugggggagcgacugcuuauggggucccggaacuguucuggaauuagauagugcggaugguugcacaaccugauggauacaccgaaaacugcugaauuaguuaaaauagugaauuugaugucaugugaauuuuaccucaguucagaacauuuuuuaaaagacaaguugccagccaggugcaguggcucaugccuguaauccgagcacuuugggaggcccaggcggggggaucaccugaggucaggaguuugagaccagcuuggccaacauggugaaaccccaucucuacuacaaaaauuagcuacagacgugguggcgggcaccuauaaucccagcuacuugggaggcugaggcagggagaauugcuugaacccaggagguggagguugcagugagcugagaucgcgccacugcacuccagccugggcgacagagcgagagucugucucaaaaaaaaagacaaguugcagaugagcugagcuuugggcagagcaagcgggauucugaugggggguggauguugcgcucgucagcaggcaauaguuaguugguugaggguuuugaucacgggguagcuacugccugccccauuuuauccagcucuguaguugcuauagaguugcuagaaccuuggcacaucacuuaucaguuuugucaccucagauggcuucuucacuacuuggggugucuccuggguguggggcucuccuuccuguggccucugcugacugccuggcacuggcacacaugcucuggugaggggaggaccagcgguuuuucccguuuguuuucugcuuccucguuuaacccuccucgucuuguaagaugaauguucuugucucuguucacuaugcagaugaggacuuugaggcucagagacgccacuaacuugccugguccaagccuuuugggccucucaggcugcagccagcaaugcugcagugaaguuugccugggaggcugacccuaggagucugcaggcguguuaggacccccgaucuagaagacagcagagauguaggccagggaggaccaauaccgagcaucugagggcaggcacaccucagacugaccagaauacaaaugaauucgagucacuuacaaacaaaguggcauaaggccaggcacaguggcccaugccuauaaucccagcacuuucggaggccgaggugggaggauugcuugaggccaacgaugugagaccagccugggcaacauagcaagaccuugucucuacaaaaauaaaaauucaaaaaaguggcauuuaacacauacuuuuuuucuuuuuuuugagacagaguuuugcucugucccccaggcuggagugcaauggugugaucucggcucacugcaaccuccaccucccagguucaagugcuucuccugccuuagccucccaaguagcugggauuacaggcgugugccaccacaccgggcuaauuuuuguauuuuuauuagagacgggguuucaccauguuggccaagcuggucuggagcuccugaccucaggugauccacccaccuuggccucccaaagugcugggauuacaggcaugagccacagugccuggccaacacguacuuuuaagugaagcugauguguuugguguuauuuucuugcagaaagugaggggcauuaguguaaaggauuuuggaaguguuuaaagaaacaaaagggaguguugagacgccauccaccccugagagaagcugcgugguauuauggcgggugggggcaccaggauggguggccccacuucuggccucugacuuccugagccucaggcccaugugggcccaggcagggcccggcaggccgggcugcccagcuccccuccacuguccccucugccaccagaugccauccggcagagcaaccagauucugcgggagcgcugcgaggagcuucugcauuuccaagccagccagagggaggagaaggaguuccucaugugcaaguuccaggaggccaggaaacugguggagagacucggccuggagaagcucgaucugaagaggcagaaggagcaggcucugcgggagguggagcaccugaagagaugccagcagguagucggggcagggccagguucugaaaacccgcggugacgccaguguuccacaagggaacccguggucggggucccccaaagcacccuggggcucagugcugugccgggagggcucggaacucagaaaagccgucacacucccaguuccgguuuauuacaaggaaaggacacagguuacggugagcgaaggcucagggcgcacagggcgggcuccaggagagaccaggcgugagcuucagcggcuccucgcccaggggaguugugcagacggcaccuguuucuuucggcaacagugugggacagcgagcacggagucacaaccgggaagcucaccccagccguggcggccgggguuuucacggggggugggccgcgugggcaccgagcgccugcguggccaacccuggucacucggcuguagccaccagagguccagcuguguggcccaaggcuccccccauaaaucgugucauuagcacagaccgccugguuucagggucuuugugugugggcuuggcugaucgcaggauccuggcgaugguagucaggaaggggccgugcucccuuugaggggcaagguggagagaagugcuggagaggagacuugcuggcggguaccuggcacuugccacagccaggcuccacuccccuggggaaaggcguggauggugggcugugcacgccgcuccacucagggcuuagagcgccuggcuuaaggcguugauuuccugugugggaaguggaugaguuuucuacagcugccgugaccaagcaccacagacugcggggccgaagccacagaaacgcguggccucccgcuucuggaggccuggaggcugagcuagcgguggugucggcagggugggcuccccgccagggccgcgagggagcugccuuccaggccucuccacggcgccgggggccgccggcugcaccucuccagccuccaucuccgucauccuguggccuuguccccgcgggccucugugccuguccuccucuuuugacaagaacaccggagauacacaaagguacacaaaagcgggccuuuguucaagcuggcaaaagagaucuucuucagaaaccccugcuugcgggggagagagcugagcuccguucccgccccagcagaggcggccuggccuugcgaagggagaaggagggagucgggagggggcgagugcaggcucaggugaaagaugacggggcagccagcguccuugccgcgaggccagccgugugugggagcugccggugcuuaccaagguugggaugcuuccgucccguggagacugggagacugggccccgcgccuccugagguuuccguuuccaaggaguggcugcggggcccucgggaaagccccuggguugugggugcuacacagaugucucaaagggacaggguaagcccuuuguaguaaaugcugucagaaagggaggucagguguuggccggaacagacaguacaugcucugggcagcccugagcguuuccagacgggaacucacucaaaagggggcuggggcgucccaggggcgcggccuuaggcucccagaggccccgcgaggugguggccgggugucuucgggcagggguuugagugcagugugccugccgagagguucugcaguucccaguguuuaacaaaauucaguguccacucuugaucugcacaaacucucccauccuggcggccccggguguggacuggggccuguguuuacuuugcccuauucgugucuggccuccuuuugucccaagucucagagagacggagagagauccccugcuggggcuguagcugcaaggccaccggguucagcccucgaggccugcuugccggggcagugacuaagccguugacaaccucaaggcagcuuugugcuccuucgucucuuuggggaucucuuuuugccccaucugugugucacccuguggcagaggguuaaggugggcagcuggggaggguuggguggcccuugggcucaugaggcccuagggcacccagguuugggggugccgagggcaggaaaaaaggccucauggcgcgcaggccucagccgcuugcggguugccccgggcuugcggauggcaggagugggccgcuggggagaaagcagugcugacaggaaguggcuuuuuauccugcagcagauggcugaggacaaggccucugugaaagcccaggugacguccuugcucggggagcugcaggagagccagagucgcuuggaggcugccacuaaggaaugccaggcucuggagggucggugagucgggggagccggcuccggagaccccuuccaggguuuccaaaagcaaugagguggguuuaggggccuccagggugcuccuugaugaggauagaccggggcaggcugcguaaacacgucggggcagacgucgggagaggucugggccaggcauccgggaccugggucccagccggcucuccgcacucugugacccuuugauggaguuuggauuauuuccuuaggaggcauucugggggccccgagcccacacccacagugucuaguucucuggaaggacuucugggaccggcgcacagucgcccucguggcugagguugaugacagggaaaaaggcacagggcaggagccgccagggcaggagccguggggggaguuggagaagcccugucccagccucccgcugcccugcgagcggcacagugagaagcgccucccacacgggccguguuccugcccagggaugcccgcuagagacucagcgcccuggguguuuacugggggcagguccugucagcgcccucugccaggcagguaccuaaauccccgacucccagcagcagagcgggugcucacgucaaccacguucuuccuacaaauggccuaggugcagggaccgaccugaccacuagagaaagugucacuguggcaagggaacuucaccagccaagggccaaccuugccagccgguggccucaggccugcugguuacucucuuuugcaaaggggucuugguucuugugagugggaccauugggucaaagggcagggagguuucugugguucucauucgguccugcuucugcccuccagacagauggaucagcugccaggggggccccagccaucccagcacaguaagcggucaaggugcacuuggggcagccagcagggcagaggggaggggagcuugacccaggcucugaugggcagagggaacccgugcagggugugggggcaguaugcaggcaggcgcggaggggagagccaagcagccaggccugccaggcagaguuggggugacuggagaagggccgugucugccuguggccagaggccacccaggaccuggacagaugcacccaccauugucccugcagugaggcuguggaagggcuugguguggugggaugaggccagacccuggaaacuggagguuaagggagcuguaggggggcaggugugggaacugagcauccgagcaggucgucugggacuccagcagagcucugggcagcagcagggauggggccgaggcccggucugcauugagcucagugcuugcacgcccaggugggcagucucucauuuuuggaacagcagucucuccugacccccuccacugagacugcuuuugcuggggcccccagcagucccccaguggaacuccacgggcaguuccgagggcuccucucaccuggccccagcacugcgggaugcaggcgaccccauccuuuucucggaccacccccuuccccugacuuccaggucuccuugccaucuguacuuggucaccugcugggccccugcauugaagcaaacacgucuuaagcaaagcuccucaccugcugcucccaccuggcccccugcaguuguccucgugucuguugacggugccuccacccugccgccuggcaucagcucgcagucacaggguguucagagccgacccccaccccccgcccacgcccugcgcauagccccugccguccccccguucguccucccugagucugcucuuuccccgugccagggcccgggcggccagcgagcaggcgcggcagcuggagagugagcgcgaggcgcugcagcagcagcacagcgugcagguggaccagcugcgcaugcagggccagagcguggaggccgcgcuccgcauggagcgccaggccgccucggaggagaagugagucagcgggggcggggccgcaccgcagggucugugguucuacacuugaucuuagccgaaaggcugagaagugucggguccaugguucuuucugccuucugaggacuccuucagauucugccuguggcugugggcccauucugucccuuagccuugcuaacgguagaggcgaccaugaugacacccgguuugucuuugauacagucaugccaucugcucuccagaccacguuucacugcguguccacacguggccuuuuuuguaguuuuuuuuuccuagccacuaggucaucaggggacuuguccuuuaaaaccccuucuaggccaggugcuguggcucacgccuguaaucccaacacuuugggaggccaaaguggguagauggcuuaagcccgggaguuccaagaccagccugggcaacagaaagacaacaaaaauacccccaaacccccccgucuaccagcauccaaucugggaccucagguuccuguccuuggcgugccuuuucagucuccuuuaaucuagaacaguuccccugccuuucugagcuguuugugaaguucacaguuuugaacagugcaggguaguuccauuguauuauuacuauuauuuucaagacagggucuugcucuaccguccaggcuggagugcaguggcauaaucucggcuuacuguaccuuccgccucuuggucucaagcgauccucccagguagcugggacuauaggcgcaggccagcacaccuggcuaauuuuugcauuuuugguagagguggcguuuuccuauguugcccgggcuggucuugaacuccugagcucaagcgauccuccugccuuggcuucucaaaguguugggauuaugggcgugagccaccgcgucuggccgcgauuuuauuauaaacauuaaaaauacuagcuuuuaggaaaacgauauuaacugccuggugaccagcccaccaaagccugcuuuagaguugacggccucaggaguccucacacagccuuggaagaccccauuccaggccugugaugcgagggagggaaggaaggggguagaguuggaagcaggcagcaccguggcuggacuggcaugaggugguuucuccagcaaaagcucccuuuccucaggaggaagcuggcccaguugcagguggccuaucaccagcucuuccaagaauacgacaaccacaucaagagcagcguggugggcagugagcggaagcgagugagugcgaccacuggggcucuagggcuggccuugccucuuccucuccccguggcccugaaccuugagaauggguagaccugccuuagacuugccuuagaccugugucaggcugcagcugcgacagcucagggaagcuguggggagauggcaaccccaggauguugcucucaggagugucagcaggccaucuuaauggggggcugggccagagccuuggggugcucccucuguggggcuggggacgucuugucuccauggacauucccucuugccagccaucgccaucuggcaccuggcucagcuucccccaagccaagguaagcccgacagcauuuccaccccaguguuggcugggagccuuuuccuaguuuguccucaucagaccuaagcuggggugcaguuugcuagugaucacauuuuagcaggacaccgucaaucguaaguguacccagaggagauuuauaaggacaaagccugaagccaggucacauggggaagaguuagcuacaaaacuggccacuuaaucucuggaggggggcguugguggggugugucugugugugucucagggggcuggagaugccugcgugggaggagugcaccucugaccagguggcagaguggaaggacugagggcucucagcugagcugugcacauggcgggcacaggaccggcuggcugugaguggguguggccuguggccugugaagggugggaggagggcuguggagcuggggauucugggaagggaaugucggcccagcugggagguuguaccagaugaccucagcggccucuucaguccugaaaaaaaccucagcaucuccucugucguuuugggccgugacaggacgcagccaucucccugugcacgcugagauccugcaaugggcccucaaaucaggggcuggcaucacccagccuggucagccagggccacucuuucauccuucucaguucuucucagccagccucgcccugggcugacgaggcuccgucagcuccccuugcccguccuuagggaaugcagcuggaagaucucaaacagcagcuccagcaggccgaggaggcccugguggccaaacaggaggugaucgauaagcugaaggaggaggccgagcagcacaagauugugauggagaccguuccggugcugaaggcccaggugagggcccuccucucugacccacccuggcacugggaccuggagagucucuuuggcgucuuuuuuuuuuuuuuugcuuuugcuuuuugagauugaguuuugcucuuguugcccaggcuggagugccacuaguggcacgaucuuggcucacugcaaccucugccucccggguucaaacaauucucuugccucagccuccugaguagcugggauuacaggcgccugccgccaugcccgucuaauuuuuguauuuuuaguagagacaggguuucaccauguuggcccagcuggucucgaacuucuggccucaggugaucugcccaccgcagucucucaaaguucugggauuacaggcgugagccaccgcacccggccucuuuggcaucauuuuguaguggccuuucguaagcuucugagccacuugugcugcuccuuagaccucucggugagcuuggcauuacucgccgacguaucuguuuccucugcgccgcugggggcucugggaggacagcaguggguucugcuuuguuccuguggugccuggcgcagugccugguggguggcuggcuuguggcgggcacaucccuuucuguuggauuugccaggcggauaucuacaaggcggacuuccaggcugagaggcaggcccgggagaagcuggccgagaagaaggagcuccugcaggagcagcuggagcagcugcagagggaguacagcaaacugaaggccagcugucaggagucggccaggugggccucugagagcgugcccgugugagcagugggugcgacacuggggggucgccaguggugaccccgcagugggugcgacacugggggguugccaguggugaccacaggagacggauggcuccugguguucuggguuagggcucacuguggucccucuccucucaccugagcuuccaagagcugcuuugacacuaguccagccaaggagcuuuacagaaaugcguggcuugacuggacgguuucuguuuucaaaggaucgaggacaugaggaagcggcaugucgaggucucccaggcccccuugccccccgccccuggugagugagcgagaacugggccugcgggaggagguggguggggagggcaggugcugcgccgcgggaggucacaguucgaccuuccuguugcucucuggagacuugacggcgggagcucguguaggccaccccaucgguagcccacccccuuccccgaggcuaagggaggcaugccgugguagcggcggcuccuggucuuacaugaguggccugugagaccaggccugccauugacaguccugccaagucuccgucccccuccauccuccccuucccucugacucuucucuuuucccagccuaccucuccucuccccuggcccugcccagccagaggaggagcccccccgaggagccaccugacuucugcugucccaagugccaguaucaggccccugauauggacacccugcagauacaugucauggagugcauugaguagggccggccagugcaaggccacugccugccgaggacgugcccgggaccgugcagucugcgcuuuccucucccgccugccuagcccaggaugaagggcuggguggccacaacugggaugccaccuggagccccacccaggagcuggccgcggcaccuuacgcuucagcuguugauccgcugguccccucuuuugggguagaugcggccccgaucaggccugacucgcugcucuuuuuguucccuucugucugcucgaaccacuugccucgggcuaaucccucccucuuccuccacccggcacuggggaagucaagaauggggccuggggcucucagggagaacugcuuccccuggcagagcuggguggcagcucuuccucccaccggacaccgacccgcccgcugcugugcccugggagugcugcccucuuaccaugcacacgggugcucuccuuuugggcugcaugcuauuccauuuugcagccagaccgauguguauuuaaccagucacuauugauggacauuuggguuguuucccaucuuuuuguuaccauaaauaauggcauaguaaaaauccuugugcauua

SEQ ID NO: 192832 - RNA, 14934 nt, Homo sapiens
agcaaaucgcauugcgcagacgaccagcgggcgccucggauuccgcccccgggauggccccgccuccucccgccccgcggcaaggcacgcacagggcagugcgcggguggguggguccuagcagcgcggccugacgggaccaaggcggcgggagucugcggucguucccucggcuguggaccgggcggcacgcacgcggugcaggguaacauggcggaugcggaagguaagggcugcaggcuuccgggccgugcuaacuccgggcgacucggggaacggggguggggggaugguaucggggcccgcgcacgccucccucugguucccgccggcgugucggccucuucaccgcccggccuuaagccggccuugucucucggcccuggcuccguggcaagggcgcgagagugggagccccucgcggugacuuggcaugauggggcucggcccucucaccucccugggguccgggucgccgucgaaagacaucugccgugcugcccaccccgcgguggcgugggacguggcagugucugugcugcugccagcccggacgccgccguuacagcuccaugcgacuaggggagcaaggguaguggaaacgggccgagaagaaaaggagcggagggaccccggagcagggauagagcuccgaguugcaagaaaguucuagaggccacaagcccgcggggacagucgaguggucgcuuauggaacuuuccggcccccugcgugagcgcuucugugggauguuuaagcucugccauagccacguggugaaccggaagggaagccgacacgugcaguagccuacagucaguuacccagccaugggacccauacauuuggccuuacacaccuuguuuucucgcuuaccuacggauauacguucuaagaaaugggucguuaggcgauuucaucauugugugaacaucagagggcucuuacacaaaccuagguggcauaggcuacuacacaccuaggcuguauaugguguagcguauggcuccuaggcuucaaaccuggacagcaugguauugugcggaaugcuguaggcaguugggacacagcgucgagaguuuguguacuuaaacaugucuaagcagaaaaaggacaguaaaaauauagcacagggccgggcgcgguggcucaggccugugaucccagcccaggcuggcggaucaccugcggucaggaguucaagaccagccuggccaacauggugaaaccccgucucuacuaaaaauacaaaaaauuuaggugggcguggugguauacgccuguaaucccagcuacucgggaggcugaggcaggagaauugcuugaaccuggagaaggagguugcagugagccgaguuucugccacugcacuccagccuggggaaagagugugaccgucucaaaaaaaaaaaauuauauauauauauaaauauguguguguauauauguauauuauauauguauguauuauauguauguauauuauauauauauaguacacaagguuauaaguggugcacccguagaggagggcacuuaccaugaauggagcuugcugagcuggaaguugcccugguugagucggugacugaaugugaaggccucagacauuacacuacuggagacuuuauaaucuguacaccuaggcuacacuaaauuuauaaaaauauauuuuucuucagaauaaaucaaccuuagcuuacuguaacuuuauaaacuuuuuacuucgacuguuguaauaauacuuagcuuaaaacaaacacauuauuuagcuguacguaaauauuuucucugcuuaucuccuuauuuauaaguuuucuauuuuaaaauuuuuuaauuuuuuucuuaaaaaauuuuuuuuuguuaacuaagacacaaacacagcacacacaguagccuugaccuacacagggucaggaucaucaagacaucacuaggagauaggaauuuuucagcucuguuauaaucuuaugggggccaccaucacauacgcagucuguacuugcaaaacauuauguggcaugugacuguaauuguagaccuaaaauccauuuccuaccugcccuaauuucggucuuuauuuuaaacccuuguuucauuuauucuuggggaaaauucccaaauccuguguuuguuuuuuuaguaauuauuuugccaaagaaacauaagaagaaaaaggagcggaagucauugccagaagaagauguagccgugaguaguaauguguuugacuucacuuugacuaaaaagaaaguuuacuuaaauaacaaacuaaaggaaagaaguguuuuuaaagguuuccaaggaaugggccagcauugguagucauuguguagauucgaaaaagcacugaaaugacacagccccagacaguccaaguguccuucaggcauagcuuacuaaauggugcuggccuuaccaacugcugucucugaauuugucuuccuuaugccacccacagacccgccaucccccuuucucuuuaaauguuuggacccaucuuagugacauuucacuuccccucuguacuccugguucauuucuucucucucuuucccuuggaggucccagugaaaaggcauaggaagccuuguuuucuguuuaaaaggcauacauuuccauggcaguaauggaauuguucaaaaucgggugggaaguuuaauagguuauauuucuguccugucgaaggaaauacaacacgcugaagaauuucuuaucaaaccugaauccaaaguugcuaaguuggacacgucucaguggccccuuuugcuaaagguaugugguuaaaaucgugcaucagaugaaugccugcuuuuacguuauuuccaaguguuaaacaauugauugagaaugcuuacugcuggcauccuugacuuugggaagugcccacugauacaguuuaaagcaggauuccuuaagguaucugaaaugagaaccaaguuuuuaaaaaauuggcagugcacucaacacuguuguagaacacauguccccacaauguuaaauugcugaguuugucaacaguucucaguuuuuguacuuaguccaucuugcagaccuaugccaguuugugggccacauagugguacugacucuuuuuuuacaugugcucacgacaugguauuuuguuuuguguugugucguugcuuuguagaauuuugauaagcugaauguaaggacaacacacuauacaccucuugcaugugguucaaauccucugaagagagagauuggggacuauaucagguaaguguugggaggaggcacugugcaaacuuacuuucuuuugaaaaugcuuucacaucagcuauucaggaaggcaguggcaugccagaauagcuuugucuugaauauauaaccuguacccgcagugaauuauuuuucuuuuuaacuuuucagauuuguuguuucacuggagcauuaagagugggugauacauuaauuuuuuuuuuuuccauuccaggacagguuucauuaaucuugacaagcccucuaaccccucuucccaugaggugguagccuggauucgacggauacuucggguggagaagacagggcacagugguacgcuggaucccaaggugacugguuguuuaaucgugugcauagaacgagccacucgcuuggugaagucacaacagagugcagguaugugggagagggagggaaggacuggcuagagugaaaagcuuucuguauuucccuucuauguuuugucugcuggaaacuauuucuucauuaagaaaaaaaaaaauccuaaagcaaggauauuguuuugguuucuguguacguucuguccccugccagaucuuggugguccgcgcuuuuuggaauuccacauacuaagcauguauucaucaagcugacuggauccauuuguccggguucagcucucagcuugucacuccaggcuucucacucugugcuaccgcuucugccuaaaguauccuucguucauuuuuaucugagaaaagccugcuuaucuugcaaggcuuuuuccacgcagcuucuacacugaguacucccaacugucccuguuaguacauugaauucccagugagaaagugucuucauucuuucccacaucaucaccaugaaaucucucuuaaugcaaauuuuauagaaacacaaggucaaacugccgcuuuuccugcugugcaaaaugggagugacugagcauauaagaaauauggaaaacagaaaacucaguggccacaccugacuacucuuuugucauuuuucaggcaaagaguauguggggauuguccggcugcacaaugcuauugaaggggggacccagcuuucuaggguaagucugcaauuguagggaggacacccuuuguugacuuggaucucugagccccuaaacaucuggagauggguuagcuguccugacugacuccuuuuguccccuuuucagucggcugcugcagccagccuggaccagugacugcacauguacauucugaugagguguuuguuuucauuuguguuuguucuuaggcccuagaaacucugacaggugccuuauuccagcgacccccacuuauugcugcaguaaagaggcagcuccgagugaggaccaucuacgagagcaaaaugauugaauacgauccugaaagaagauuaggugagucauuaggccugugaguggguaugaacacauucuucaggauucuguucucuuauuaaaaguagaugcccuugaaguugaagacuuucuaaaaccugcccuacagcugggauauugucugugggcgauaguuuuuguuaucuuuuguugaaaaagugaacagugccuaguaaagugagauggcuuuuacaccuuuuaugaugacugcuucugcuggaguugaaauguuuucauucugcauuuguguaguucggugcuuuguucaaagguaaguguuuucaccaaaguauguuuugcauguguuuuuuauuuguugcaauuuugacugcuuagaaguuucuguugucagaaguaaauuuaagacaaugccaauuuuccucccauccaugaaacauaccaugcugaauauaccugcaacuuaaguguuaaaaauucugcuaauaucagaauuacagaucuuuuuuuuuuuuuuuuuuuuuuuuugagacggagucucgcucugucgcccaggcuggagugcgguggcaugaucucggcucacugcaaacucugucucccggguucacaccauuuuccugccucagccucccaaguagcugggacuauaggcgcccgccaucaugcccggcuaauuuuuuguacauuuaguagagacgggguuucaccauguuagccaggauggucuugaucuccugacgucgugauccacccgccucugccucccaaagugcuggaauuacaggcgugagccaccgugccuggccagaauuacagaucuuuacagcaaaugcuuauauuuuaagaagugugucugucaccucuagucuugguggcucagaugaaggauaacugcauuucucaaccagugauguauuuacaguaggugcugcuuuucuuuuguguguguguaucuuaggaaucuuuugggugaguugugaggcuggcaccuacauucggacauuaugugugcaccuugguuuguuauugggaguugguggucagaugcaggagcuucggaggguucguucuggagucaugagugaaaagguauguguuacggggcuagaaguuuuagagcugguucuuaccaucugccagccuuugauggcacuccacuugcuucaugucgugggaaagaugcuuuccaaaguguugaguucaguccagggcagcuucccuguucuguuaauuaaacuuugggacauuaaaaugggcuaagggagaugauuggguagaaaguauuauucuauucauuugccucccagccuacaaaaaugccugcuuggggucuaauacuucaacgguuaaagaugccuggaagagggcgcgguggcucacgccuguaaucccagcacuuugggaggccgaggcggguggaucaugaggucaggagaucgagaccauccuggcuaacaaggugaaaccccgucucuacuaaaaauacaaaaaaaauuagccgggcgcgguggcgggcgccuguagucccagcuacucgggaggcugaggcaggagaauggcgugaacccgggaagcggagcuugcagugagccgagauugcgccacugcaguccgcagucccaccugggcgacagagcgagacuccgucucaaaaaaaaaaaaaaaaaaaaaaaaaagaugccuggaagagccaggacugaagaggcugaagacauaaugagcuuggacuaguaaacaagugacauucaguuuuaggaaguuuggggucugaugggcugagauacaaauaaacugaauuauuuucauacauggcugcuuuucaggaccacauggugacaaugcaugaugugcuugaugcucaguggcuguaugauaaccacaaggaugagaguuaccugcggcgaguuguuuacccuuuggaaaagcuguugacaucucauaaacggcugguuaugaaagacagugcaguaaguuccggguuaggaguuuauauuuggaaagaacguacuccaaagaugaggcuugcucuuuuuauuguuuuccuuggguuuuauuuuauuuuuuucaaguccaaaccaaguauauuaauuuaaaguaaaaguuuaaugguaggcauacuuaaaaauaaggcacauuaggccaggcacaguggcugaugccuauaauccuagcacuuuggcaggcugaggcaagaggaucacuugaguccaggaaggaguuugagaccagcuugagcccaggagaucaaggcugugagcuguguuuuuaugaugaucagagaguuggccuuuuauaaauuaaaacauugucuuuuucucuaacuugagggauaaaaauuucuggauauuuaaaauguuuguaguugguaauuauuuauauucaaaucuuguauagauguucacauuuuuuguauguguauaggcuguaauaaauacugaaagauggcaccauaauaguugaaaaaacucagucacaaaacaguggacaacauaaaugugauguccucuccuuaucaaaccauuggcuucugggugaauguaaagggaggggagaaugugaucaaaagaggucuaggugaguggagaugguaugaggcagaugggugcauuggguaccauugaaccucuggagagguagccuuaacuuguacccacugaccuauaaauucugcaccaagacuuuugugugauugguucaacagggcucaguaaucuuguuuucaaguucuuuaagagccuguuauugccuggaucuccaguaaaucuguucuuucuccucauaaggaggagagaggaguaauuaaggaaugccaaggcuauuuuuauguuucaaaugaaaauauggaccacgugcgguggcucacacccauaaucccagcacuuugggaggccgggccaggcaaauugcuugagcucaggaguuugagaccagccugggcaauauggugaaacccugucucuauuaaaaauacaaaaauuagcugggcgugguggcacgugccuguaaucccagcuccuugggaggcugagaaucacuugaacuugggagauggagguugcagugagccgagaaugugccacugcacuccacccuggacaacagagggagguucugccugaaaauuaaaaaaaaaaaaaaaaaaaaaagaaaauacuugugagucucuagaaccugaaaaccugaaagucuucuuuacuacuuuugagucguguguaaugugcggagagugguaccuauagcacagugagguggcucuucugaguaccacucaugccccuugcagcuagugggcuauaagugucaucccuguuuccuggugucaggccccacucccuuguuguccuccuuuacucuggugugggagugggguggagggcagcagcugggccccuuacacuuggugccaucucugcagguaaaugccaucugcuauggggccaagauuaugcuuccagguguucuucgauaugaggacggcauugaggucaaucaggagauugugguuaucaccaccaaaggagaagcaaucugcauggguaagaggggauguuuauuuuuuaaauucuaaauguuugugguuacauacuagguguauauauuuaugggguucaugagauguuuugauacaggcaugcaauacauaauaaucacaucauggagaauggggcauccaucuuaagcauuuauccuuuguguuacaaacaauccuauuuuacuguuaguuauuuaucaccuuaguuauuuuaaaauauacacuuaaguuauuauugauuauagucaccccguugugcuauuaaauagucucacucuucuuguucauucuuuugguuuuuugguggugguguuuuuuuuuuuuuuuuuuuuuugagacagucuugcucuuuucacccagacugcagugcagagacgugaccucggcucacugcaacuucugcuucccagguucaagcgauucucgugccucagccuuccgaguagcuaggauuacaggugcacaccaugacaccuggcuaauuuuuuguauuuuuaguagagacaggguuuugucauguuggucaggcuggucucgaacuucugaccucaggugaucugcccucccaaagugcugggauuacaggugugagccaccaugccgggccugauuuuuuuuuuuuuuguacccauuaaccaucccuaccucccugccagccccccacuacccucccagucucugguaaccauucuuuuacucuucucuguccaugaguucaauuguuucgauucuuagcucccacaaauaagugagaacaugcaauguuugucuuucugugacuggccgauuacacuuaauauaacgaucuucaguuccauccauguuguuggaaaugacaggaucucauucuuuuuuaaggcugaauaguaauccaucguguauauguaccacauuuucuuuauccauuuaucugucgaugggcacuucgguugcuuccaaaucuuggcuacugugaucucuuugauaacacugauuuccuuuauuugggguauauacccagcagugggauugcuggauccuaugguagcucaauuuaguuuuucgaggaaccuccaaacuguucuucauagugguuauacuaauuuacauucccaucaacaguguacaaagguucccuuuucuccacauccuugccagcacuugucauugccugucuuuuggauauaaaccauuuuaacuggagugaaaugauauuucauuguaguuuugauuugcauuucucucgugaucagcauugagcacuuuuucauaugccuguuugccauuuauuugucuucuuuugagaagugucuguucaaaucuuuugccuguuuuuugaucagauuauuagauuuuuuuuccuauagugcugaguuccuuauauauucugguuauuaaucccuugucagauggguaguuugcggauauuuucucccauucuuaugcauauggauaucuaguuuucccagcaccauuuauugaagagacugguuuuuacccaguguauguucuuggcaccuuugucaaaaaugaguuaaauguaggugugugcauuuguuucuggguuccuuauucuguuccauugguuuaugugccuguuuuuaugccaguaccauacuguuuugguuacuguagcucuauacuauaauuugaagucagguaaugugauuccuccagguuuguucuuuuugcuuaggauagcuuuggcuauuuugagucuuuugugguuccauguaaaguaccaguguuuuuuaacuugugaaagcuuagcuacuguuggauugucucuuaagacuuuaaaugcucugcgcacccucuuagugaaugaaccuuagagcuauucauuuaaugggucuaauuuguaccagaaguaagcaugucaucaggauuccuuagcucugugagcaggcaaggcagccacggcuuauggacagcagcagaaaaggaauccuuaaaacuucaaagguucuguggccccaaagggagugugcaugccguucuuauagacgucuugagcugcaagccuguuauguguaucguuaggugcuuugguuagguguuuuuuaacuucagaaguuuaacgucauuucaaaggccuccuucucauaauggaguauuuccuccauaugcacauccugagcaaagguaaccccaauuaaaguaguagcucagaguuuuaaaaguuuuaaaguggcauacaacaguagaauuggggcucaucaauuaucaauucuuucacccuucaaauaauucuuuucuuuauucaaugccuguagcuauugcauuaaugaccacagcggucaucucuaccugcgaccaugguauaguagccaagaucaagagagugaucauggagagagacacuuacccucggaagugggguuuagguccaaagguaagugguacuggguugcgugcccugccagguucuuuuuuuuuuuuuuuuuuuuuuaaauuuauuuuuuuauugauaauucuuggguguuucucacagagggggauuuggcagggucaugggacaauaguggagggaaggucagcagauaaacaagugaacaaaggucucugguuuuccuaggcagaggacccugcggccuuccgcagugucugugucccugauuacuugagauuagggaguggugaugacucuuaaggagcaugcugccuucaagcaucuguuuaacaaagcacaucuugcaccgcccuuaauccauuuaacccugaguggacacagcacauguuucagagagcacaggguuggggguaaggucacagaucaacaggaucccaaggcagaagaguuuuucuuagugcagaacaaaaugaaaagucucccaugucuacuucucuccacacagacacggcaaccauccgauuucucaaucuuuuccccaccuuucccgccuuucuauuccacaaaaccgccauugccauccuggcccguucucaaugagcuguugggcacaccucccagacgggguggcggccgggcagaggggcuccucacuucccaguaggggcggccgggcagaggcgccccucaccucccggacggggcggcuggccgggcgggggggcugacccccccccaccucccucccggauggggcggcuccugccagguucuuuuguuuggcauuguugaauacuugggcagcucuugguguguuucaccaccacagccuuguauugugcugggcucuggguugucgaugaguggaaacaggcccugucuugggccuuagagauuucagucuaaugaggggaaacaguugggcauuacucacguaaucacacaguggaauggcgaauuucaugcacguuaguggcuaccaaggagugcagagaggugucugucaccuggaguguccacaguggucaaggagucuggucaagggauugucuguuaagccacaccggugugaagaguggguuagguguuggugaagugaagaggggaggggagaguucagggcauugggagcaagcagcaugugcaaaggcaaaaaaguagaguggcugcgguggggacguuaugucugcagaggcucucacuaauaagcuuugugaucuucaacaaguccuguguguguuggaguuagugggcaaauucugaaugcucuggagaggaguuugaggcccugcugagaauacaccagggaggaaccuuguucuauucuuuguagucaccaugcccgcuuccagcauugacaccauucuaauguugacaccuugauguuccaccaggcaagucagaagaagcugaugaucaagcagggccuucuggacaagcaugggaagcccacagacagcacaccugccaccuggaagcaggaguauguugacuacaggugagggcaggauguuucagagccgggguggguagagacggcacacuugcugccuugaugcaggaguaugucaacaacaggugaggaugggaagguagagcccacuugccaucuggacgcaggaguacauggacaacaggugaggaacaggugagcauggagguuguagagcccaggggagggggagucacuugguuuggggcaaacuugcuaaaugcaggaccacaggaaccagcucuucagcucccgugagauuuuggcugcccaggccaguuaggggugugggccugcacggcagacaguuaucccuuucuagucuggcucgugggacucuagagggagucagucugcaacaguaaguggugaguucuucuguccagcgucaguauuuugaugguggcuuuagacuugccagauaacacuacauaacaucaguacugcccuggaaagccauucagugaauuugaccuauugcuaccucuuuuucagugagucugccaaaaaagaggugguugcugaagugguaaaagccccgcagguaguugccgaagcagcaaaaacugcgaaggugaguggcaugcuguccucaguuuggaaugugcuuagggagauaauccuaagaggcacuggcauucgucuuacuuugugacuguccgcaguccagccauauacgcuagcaucagaggugcagcgcauacacagguaaugcugccucauacccuggggugcuuguuugggcucugcaggcuccucugauuuguauucucuguccuaucugcugggaggaggaaugugggcucaggaaucagaugggccucgacuccuaccucagcuauggcagcaacacagugauggaaugggugguggugugugugucaauucuggcccccgcccugggucaaaugguaggacagauguguugaaaucagaggccauggcuguuggacauucgaggccauacaaaauucagcagagagcagaauugcaucuuaaccuggcaccacccaguguugaaagagucagucaagcauggguuggcaacuccaccccauggagcugcuggcauuagagcacagaaugacaggucugcacucagaaaccgggggcgguacugaguauccugcacaggcugugugggaggagcuucugacuugucagaugugaauuccugcuuugccugcuuucugugagagguccuugcagucaugagagaaacagcuccuccgggccuuuccaccccaagccccgugcugcugcugugcuccuucucuugugccugccucaaggcuucuuggauuugggggaugagacugucuucaaauccucaguaaacuaaggcccuguccggguuuguagucagaaaacguccuguuagauucaguugggaucuuucuuggugccuugcuaccuuuugacucacugaaccuuucuuguccauuauugcccaagaucuaacacuuaaccaauugcuuucaucucagcggaagcgagagagugagagugaaagugacgagacuccuccagcagcuccucaguugaucaagaaggaaaagaagaagaguaagaaggacaagaaggccaaagcuggucuggagagcggggccgagccuggagaugggguguguggaaacacguucagguuccuugggcuggcuuagucccugcguggggaaagaauuacccaggugguaccagcuuuguuacucuucuuggaggagcuguggccugggggugggaugccaccgagugccuuuagugcuuccccauguuccuggagugcuuuugcccucccuguggaauggacagauagaggcacccgaccucuaccacuuauacuuagagcucuauugaugguggguggagaggauguguaggauggugaucugaauguuuccacuuccaaaaguagaccacuagggugucacugaaagguuuacagaacuuugugucacaugcagcauuuaacccaaaauauccuuacagguccugaaaaaggcuugcuugacuguggaccuuuaccagauuuccuucugggagagucauagcuuuguuaguggaugguaucugugagcuuucauucucuuucuuucuaggacagugauaccaccaagaagaagaagaagaagaagaaagcaaaagagguagaauugguuucugaguagugaaggccacuugaagcuggaggagaaacuaaagccuuauugagaaaacauguuauagauccuuuuguugcugagagaguggaacauagguccuagacagggugaagaguucuggcacauuuuagcugcuacuuugagaccucggugauguuaccugguguggucaucccaucuuguccuguuuuaaggauauggguggugaaagaugaaagaggcagaguuuaucccaaugacuucucuguuugaguugggaagccucaccuucagacccaguaacuguccgcagcugucugcuagugguugucuuaacaucguaguccuaguuugcauuuuuuaaauccccucuguuuaaaagguuuguaaaacaaaaacaaaaaacuaagucugcucagugaaaugcuguagaacccuaaauaagugguagaagagugucacugaauuuugucucugaauucaguauaacugaguuuuguccaugcuggugucuggguuauaggccugaugggccugguaguuuuccaucuuguucuggccuagaggucaguccuuugcacuuccucaaagcuuguguacagugcucaccuaaauccaucugacuacuuguuccugugcccucuuguuuuaggccucguuuacuuuuaaaaaaugaaauuguucauugcugggagaagaauguuguaauuuuuacuuauuaaagucaacuuguuaaguuuuuuauguauuccuguuggguuuucuuguugaucucaugcuagcagagcaaaaauuguaaaauauuuugauuaaaaaucuagggaccuuuauguccuauuugaaauguga

SEQ ID NO: 192833 - RNA, 26844 nt, Homo sapiens
uuggcauuucaacacagcauuuuuauugcuuuugaagguuucccuagagcagacaucauucuauugcacagaugugucauuuuggcauuauagaaaguugcaguuaaaaacgcuuucuccaaaauaaaaagacaaaugaaauacccagcauauacaguugaaggcaaaggagggcaggcuuuagagggaugggguccauugcuuuugcugugcaucacccuugauuagcaguuacauuuugguaguacuucuuacccccaauuucuagaaauccuuuucaaauccagaucaguggggccccaucuaucaggagaaucaacccuucaggagccugagcaagaagacugaaccuuacuggcugaauuaggauagcugcagagagcuggaagcugacacaaaacuaguuggagcagcccuguuugucuuaaagcaaggcggguggaauuccaaaugcuggagaggggcauacaguggguucccccauucuacaagcuuaguaaacccaggagacaggcacccacuguggagaacugcacgcuuggucgaaggcuucuuguaauuucuuaaggguuucaucaacaccauuauugaccagugagaggucaaaguagugagcguacuggcugcggauggccucagaguccuucugcagcugcugcagggcuucugucugcaaagaagaaagccacagaugaagcaagcugcaccacccccagcccagagaggccagugacagauuuuaaacagcaauuguuagcguugcucagcugugcaucauacuugacgagucaaauucagaagacauugugaaagaauguuaauguagggcaugaagaggcaaucucaaaagaccauggcaauucucagaggaucucaagcuaacccugacuaaucagaguccucuggaggaccaauagcuaugcagagacagcauggacuucaccagcaucucccacuuaaugcccuuugaacauggaagagccauuucaacaaccaccagagcugcaauccuaaaacgaagauaaaggugauuuuguuguuuuguuuuguuuugagacagugucuugcucuguggcccaggcuggagugcaguggcacaaucucggcucacugcaaccuccgccucccggguucaagcaauucucgugucucagccucccgaguagcugggauuacaggcaugcgccaccacaucuggcuaauuuuuguauuuuuaguagagacaggguuuugccauguuggccaggcuggucuggaacuuuagaccucaggugauccgcccgccucggccucucaaagugcugggauuacaggugugagccacugcacccagucagauaaaggugacuucuaaucccagaucacaccuguaaucccagcacuuuggaaggccaaggcaggaugauugcuugagcacaggaguucaagaccagccuggcaacacagugagaccccauuucuacaaaaaacaaaauuuaaaaauguguguguauauauaucucaggacucugucuuugaccuaaaaccaagcagccaugaaagacaaaucauguaacuacauaaaaguaaaaaugucugcauagcaaaaagacaugccaaauuggaaaaaaauugcagcugauauuacaaagggcuaauuacccuaauauagacuuccuauaaaucaaaggucaauaacucagcagaaaaaugagcuaaggguaugaccagauaauucucagaaaaggcaauacaaauugcucuucauaugaaaaaguaccugaucaucucuuuuaguaaaaaagaaauaugagauacuauuuuucccuccaguagacuggcaaaaaaagaaaauuuugacaacaugcugcaggcaaagagaaacaagcagucucacaggugguuggcggucccuguccaaauucuaagugugugugcucuuggacccagugauccuacuuggaguuuuuccuacagauauauuugcacacaugugcuauaugcacagggcuauugacugcaguauuacacaugcaugcagcagaagaccaagcagcuauagagaaaaagaguuccucacacccugauagggaaagguguccauuguucaaugcaaaagcacagugcagcaaagugcauggguagggcugggcagaggagcaggguaggcuuuuugauauauuccuggccucucugucuuuccccacagccauacugcaccccagggcggguucagugccaccucuguccaucacagcuuccccugccagagccugcaucccaccaguaucaggaucugcucaacuguccaucucugccccuggaacugugugccuccaggacgaugacugggucugguuuguuuugucccuguuagguagcaugggcacuggccuagcuaguggcuuaagagcuggaacgaaugugcauacccuuuggcuucuuggcccuggaggaagaagcccagcuggagcugugaccuccagccagcacucuggccaaugaccuggacugaggucccaguaugggcaggcccggagaaagugaacuacccaucgcgcacaaccucuccucaccugagugcccuggucaguaggugcaaugaacacaaugaaaggcgaaaguucugcuguccgaacaauuuucagggucuagaaaaaaaaaagaagggcggcggggaggggggggaaggaagaaaaggaaagugaaaaaaaaaaaccuacauagcugucauaauggauuccuucuaauaagcagcuuugagcuuuaccccaauacaacuuuccaucauucccaguacuacuguucuuguuccaggcugaccccauuaaaaggcugaagcaauccugagcccccagaagauucccaaggagcacugucuucgccaucccuuguguggcugagcccaucugucccugcccuuccaugccuacccaccuggggcucaaugucaaggauggcaaucuuguucugcuuauggaucuggugcacuguuucaaauuuggugccaaacauguugccuugguagcugccaaacuccaagaacucauuggcagagauguuccucgucaucuccuccguugagauaaagugguacuccuucccaucuuccucacucuuccuuggcggccguguuguaucuguguacaagaacccaaauccccgacaaacuccagguccucacccuuucaugagggcuuggaccauggugucuguauggaaacccuagcugccuuuggugcauugacuuuaauacagggguuccucccgugggcuccugaagagcugaugcuagaaagugaugcacaccaggaaaucccuccaucugcccaggacacauuuaauuuuuaaggggcaaagccuaacauagaaaauuccuauuaucauuuucccuaaaugaaguuacaucucucaaacuaccaaaucuaggaauauugaaacuuagaaaugaagauagcggaaaauauuuuaaaaacagaucuacagacuauggucaggauuucuuggaaauauauuuaagguuuccuuuucaugacuuggaaagaagaguacuuugguuuaguuucagcucauguuguuaaaaguuggacuauuuucuauuacucauauaaauugucuaaucaguaaaauaugcuccagauauuguagcuugaaacacaauccucccaaccuccccucuuuccaucuuccauugacugucuccuuugccuuccggaucacacuugucucucaacuggccccuuccccucaaucuacaaccacaugugauucucuugaaggaggagccuguacugguuauuucugcuuccccacucacuccuggggccaucucuuucugcuccuaaugugacacuggaauaacucuuaugucccuccagcaacgagacaacucucaaugauccauguguaaaaaagcaaaaugaagaaagaauuaaaaaauaguaauaugagguuuagaaucugguuuucuauuuugcuuagcaguacaguaauuccucacuuaauauuauuaucaguagguucuuagaaaaugugacuuuaagugaaaucacaugcagcuggucguugacuaacaugguuuaguucaacuucauuucauuguauuguugaugaguaaaaaaacugguucuuguuauaugucauuucacuuaaagucacagucuucgaagagccuauugacaauauuaagugaggaaucaccguauuucuuucugggaacauacacaacuauaccaugcagcaucacuucugggaauggaagaguuaucaaauucuccaccugaucacuggcgcuacucuucuccauaucuaggacugcuguugagaucguuugggccuuuccuaggcacugcuuugauuuagaagacauuccaugaaaaugagaggcagccugaacaucaagagugggauaguucucaaagagaauuaggcaaauugcagaggaacaugagaaaauguuuaaaaaguaaaaugacaaaguuauauguauaaacuuuaauacuuaguaauuuuuaaggcaguaucaaaauguuuacuauagcuucuguuauguagacaaacagcacgaauaacaauaagaaaacaguuauucuguuagguggaggaauugugggcacaaauuuuuaucuuuccauauuuuguuuaguuuuaauaaucauuuaaaauaaaauaauuuaaaaaauaauaaaauaacacuaugguauuucagauggcgagugguaccagccugucaccuccccuccaaggugccuaagagcuacuuacaugggacaggguacacaaacuucuccggauucuggcugagcagggcauucuuaauguggcugcgacccaccccacuggcuccuguguagagagagaagaacaucuuuuggaaaggggggagaggagcgaggauaagauacggauuuuccucucucggcacucaaaacugccaacaggugaacaugaguugggguugcaucugggcuggggucaacucuaaagacaggaaggugagcaguccgccagaggcaaagccuacauaccuggguuugaagcaaggacuuacucuguuucaggucagagucacugcuugggggaagggagauuuacaaagcguaucacugccagcagacagcaugaaaccuaaccaaaaauaauucguugcuaaauaguagagaaacuuguaagguuuaguuucauuugugagguggacccagguggggugcacgugaggauucagaaaauuccuuacaccugcucuauauggagaacccaagagaccucaguucuuuucuuccucacugccuuuuuugggggugggcacgugaugcaggcaggaaaacaaagacagaaaugugcaaauggggcaaugagaagauaccgaucagcaccagggucuuccucuugaaugcagggagccgaacgacuuccucguaggaaacaacauccaacugaucaaaaacuagagacaaagaaaaccaagcaguguucauuuccagagcuagggagaacagugguccacacucugaaaugggaaacagccucgcgacaucucaacaagcagggaggaagugacuagagaugagacgagggagguugguguggaggaaggacuuuggacuguauuuuuaguguggugagggaauuuugagcaagggaguuuaucuaacuuuugcacccucucuuccuccuugcccuaucucucugagccaacuuuucuugucuccuguccucaucucuucuccauaguuucaguaucagauguucccuuggcacuuagagcugaagaaugccaaugcuaucucgguucugccugaaugucccuuaucuuagaagaugguggugcuauugacccagcugcucaagauagagaccuggugucauccugacucuccacccccuuaccugccuacaacccaagacugccacgaucauucccuggcugguggugugcacgugacgucucagaaaagagaaaugcagauggaaagcugaccgugcgaauucucugcucaaaacccuucaccagcuccacagucuauagugcaaaauuuaaaacgcuagggagggugcacgaagcucccuaugaccuggcccuggccucucccucuggccuguguucuugccucacuuccccucucccaccacaucuacuucugugugagggguggggugaugagcaggugugggcucaccacuaguccuccuuuacauccacuggccugacugcagcaagcuugugaagauggauucaauaaaaagaaaccagaagaaaugacaugcuuucuguagaaugcgccuucugcugcgcacugcaccaccuccccuuuucugcugguuacagagacugggaaacacgugaaugcugccaggaaccuggggcaagaaggcucagaaagcuuacucgagcugugcuuggccagauauuugucuuuguacuucuucuucuucccaaagggacugcagcucggggcuucgcuaggagcugacugagccauacuugccacucgccugguaggaaaagacaaucaaggggucagcuuuccucccccuccccucauaccccccccagccacucagucucuaauggcacccccuucacucucugaguguccauuacagugggagauaaugugugcaaagcaccccauacacuguuuggugcaucuugcacugugcccugcccucagucagggaccuggcuccuugagucugugucaucuaguaccugucagcacauucuggacacaacccacaaacaacucucuuucuuuggucuagaccauaaaggucucaaaccuuuaugacccuaccucacucuaagaaauacacuguacauugcaagccauuauugcacauacaucuauaaacaaaacacauacacacaccccacauauauaucuaaaacaacugcuucacaaaacaauaacuuguauuacuacauguaauauauucuaauauuucuauucagugucaaccccacaaugguuguaaucuuuacacugggguaaguuugcacaggcagagggaggcucaguguuggaugucuuaucaguuggaacuguuuugugaauuuuucugccauuccuaugauguaaccaggacuaagugagcaaucugacucggggacaggaauuauuucuuccauguaccaggaaugugccuaaaggacacauacuuaaaugcgacuguuuucugcaggacuccaaggaaaucccagaaacagcauggcugguagaagcgcacuagcuugggaaacaggagaccagggagggcucagucccagcacugucacgugcuugguaacuauggggaaaacguuuaaggaagcaagaggcccacauaagaaugaagagcuauuugggcucccuugccugugguugccucucaguccagcuuaucaacgcaugguuaacccucccccacccauuaugccaggaaaucuaggaggucuccuugguugagaaacagaaacuacaaacaaaaugacagauuuucugaagcuaaguuauuuguggcaggcacauggcccuuccaccugcacaaaaauggcucaccauuccugcagcucaggggaagggaucaauccugcugacuccuuggaggagccuuccacccgucccugccaccaauugcugucauccuuguugauaaucuggauaauguccccaguagcaaacuucagucccgccuccuugcaagggaucagauuguccuuuuugggaucauagucaaacugcgcucucaugaacaucuaaaaagaagguaaaaggaacugcaggcggcagcuucaaaagaaacaccagcaucagagcauguccugcuguagacaaauggggucaggauggaaugaacaacagggagguaagaauggugggggagcacccaagaaagagaaauugaaacgcugaagugauuguguuugcggaggggucagaaugaaucccuuuaacaagaaggcaugagaagccaggcgcaguggcucacgccuguaaucccagcacuuugggaggccgaggcggguggaacacaugaggcuaggaguuggagaccagccuggcuaacauggugaaacuccgucucuacuaaaaauacaaaaauuagcugggugugguggcgugcaccuguagucccagcuacucgggaggcugaggcgggagaaucgcuugaacccgggagguggagcuugcagugagccgagauugugccacugcacuccagccugggcgacagagugagacuccgucucaaaaaaaaaaaaaaaaaaaaaaaaaaagaaggcaugagauaucuuuccacgucaacguguccacaguuacugcuggaucugggucgucugucucaguacagggcagcuacucuuugaacaacuguuuucacaauugaaaauauggacacucauaucuaucaaagaacuugaauuuauuauugaaaauucuccucuccugcucccaaacacacacacacacacacacacacacacacacacacacacacacaccuaccucauuacuucauugacaaauuuuccaagcaucauuugaagaaagaaggcuaaucucauacgaaaacagauuauagaaaaugauggcacuucccaacucauuauaagcaugauacccaaaucugacaagaaucuuauaauuucucucugcaacagagauguaaaaaccccaaacaaaauaucagcaagucaaauuuaguuauguauaaaaaguauaauaaaucacaaccaaacaggaucuaguucagcaauauaagaagguuuacuaccugaagggcaauaaauucaccacguuaacauaaaaauggaaaaagaucauaugauccccucaauagaugcagaaaaagccugugauaacauucaaaacccauucaagauuaaaauucuuagcaaacuuggaauagaagggagguucuuuacugugagaaagaauaccuacagaaacccuacauccaacgucauacuucucagugaaagauuaaaagcuuucccugccuuuuucaaaggacaugggucuugcuauguuacccagguuggucucgaacuccugggcucaagcaauccacccgccucggccucccaaagugcuaggauuacaggcgcaugccaccacaccuggccagcuuucccuuuaagauggaaaaauaaacaaagaugucugcuaucaucacuuccacugggauacugugaagaugccucuuuuauccaaacugauauguagguuugacacagggauaaacaaacaguccaaaagaaaagaauaaaaaguuccaaaauagaccuguaaauauuaccaugacaaaagugacaguguacaguaaaugauacugguucaauugguauccauauggaaaaacuggaaucuugaccucuuaccuuacaauguauauaacaaucaaucccagauggguuguggauccaaaugugaaaaaucaaacaaguaagcauuuagaagaaaacacaggagaauaucuuguugaccuugugguaaguaaaaacuuuuaaaacaagacauaaaaagugcuaaucagaaaaaagugguagauuggauuucauuaaaauuaagaguuucuagucauuaacaggaaccaugaagaaaauaagccacagaagaagagaacauacuugggaugcauaugacaaaggacucuuauccagaauauaugaggaacugcuacaaaucaguaagaaaagccuugaauugguaucuuacaaaagaggauauccaaguggaaaaaaacauauaaaaaggaguuuacccucauuagucauuagagaauuuuuagaaucacaaugugauaccaccaucaggauggccaaagggugaaaaaaaacccaacaaaucagacaaugcuaaguauuggugagaauacagaacaaccagaacugucauacugugcaguuggggauguaacaugguucaccaacuuuggaauacuauuuggcaauaucaccuaaagaugaagacacauauauccuacaaccuggcaauucuacucucaaaagaaaggcauagauguauccacaaaacacaugcacaaaaaucauaugauuuuucuccauuuuucuguuaacguggugaauuuauugcccuucaggcaguaaaucuucucauauugcugaauuagauccuguuuggugaauggcagccauucaauguaagaccaaaaaagcugacagaauagauuaaauuguagcauguucauacaaugaaugaaugagaaugaagcaauauagaugauucccauaaacauaauacugagcgaauaaaauaagacaccaaagaauucauacuguauaauucaacguuaauacauuucaaaagggggcaaaacucaucccugcuguuagaagucaggguuauggugggccuugaggaaacacgcauggugagggggcggcggucuuaggcauggguguacucaguuugugaaaauucauccaguuuuauacuugugauuugugcccuuuguugaauauaugcccauauaugccaaaacugcaauuuaaaaguuuacuuaagaaaauuauaccgucacacuacaaguaaccugcaauagaaacuucagauuuauucuuuuaaauaucuccuucuuccacauugacuugccauggcccuguccaaucuauuccucuacuggcugaugagcuaugugugaacugggaaccauuucucuuuauaucaccuccauguucuagcacaguacuuuguacaugguagacccucaauaaauugugaauaagugcucaacagauucuaucuaucuuuuguuucuuucuuuacuuugccacuaucaaucacggggcuuuauuauugcuauuuuaaaaaguauuugccaauuugcuuggugaaaacuggugucucaugcauauuuuaauuugcauuucuuugaugaucgguaagauaaaauauuuuuucauauguucaaugcucauuuguaguuuuccuccugugaaugaucucuucauucccuuuacccauuuuccucuuggagcuguauugauuccuuaccaucuguagaauaaaauuacccucucccuuccuaccugaccacuagcagcaaaggcucauucauucucuacuccugucgucacuauguucuccauugaggaaaggggaaugagcuccuguauuuuauaccaggcagggaauaaugggacccugagccaagcagcuacacacuugcgagauacuuagaacuuaaaguuagacucacaucccuuauaaucaaauuucaaagaauauaagacaacauggcccgacuccugccaucaugacaacagagaaaauggugccacccaccuguagugcaggaagacggcuuugcugguugggaauuacuuuuaaugagaucauuccuuugguuucuuucuauuaaaaaaaauggacauaaaauuguacagaaaacuaaguugaaugaugugaucauucauucaaagucccagguuuuuuuccccaacaaccaucuuuacauuuugagauuuuguaggacaauuccuccuuuaauacaaaagugucaugugccccauaaaucagcauaacaauaugaagacaugcaaagaguaacaaagaaaagcuaacuaaagacuuuuccgagcugggcacgguggcucacgccuguuguaaucccagcucuuugggaggcugaggugggcgcaucgucugaggucaggaguucaagacuagccuggccaacauggugaaacccugucucuacuaaaaauacaaaaauuagccagcgugaugguggguaccuguaaucccagcuacuugggagguugaggcaggagaaucgcuugaacccaggaggcggagguugcagugagccgagaucacgccauuguacuccagccugggugacagagcgaaacuccaucucaaaaaaaaaaaaaaaagacuuuucuuccccauucuuuaccccaaaaaguccugaagaaguuccuaaaaaugaacuauggcgcauauauauccacgccuuuccccauaccaacaaaagcauuacaaauauuuacauacauuaugcauacauauguauuguuuguuuuuaacaaaaaugggauucuacuauauacguuauagcuugcuuuacuucauuuggcauuacuucauggaacaccagauugaugcucuggguuauuugcccugcuuuagaauuuuacuaaauaaaggcagaaaauuaucauuucuuacacagauuaaagacuagcagugaaaagagcccccucaagaagguacaaauacuuugacagagagaugaggucacugauaccaauguggaucaacacuuauggagacaauggaaggucuucaucuagcauagaaaauacccaccaucgccuucugcagcugauccacugaaugauuugucacauuugugccauugauuucuaggaucucaucccccacgugaagggagccugccaugaaaugaaaaaucaauccacaaaagaacaaaaguucaaacaggagcugucaauguaacucaagauaccauagaagagaaaccaggauuuacagcauguuaugaaacagauugugucaaauacucaggauugaaaacauuugacuugacaguuuaagauggucucauccuccuuggccucaguaguccaacagcacaauaaaacaccuuguccucaaauuccuggaacuagaguggcuacugacuccagacuaugacacagauguauacacuaaaaagaauaacaaagcaaggcaaagaacucaguacuccucuuucaccagcaagcuccauguuucuuuguuguuuagcucaaaccccaaaaugcuaccaagugguacugcuguccuuuccaagucuaaugcaauggguggcauguggcaauugcucaaauauuaacuuacuagaaaaauauugguauaaauaggugugaaagaaggcucagauagggagaugguggcacugggcaauucacauagagaucuuaucauguacugauucuacagagccaguuauuaagccacaaaaagucucuuggcacacucacaaaaaugcuaccaguuuggaggauuauaagcuucaugccccacaccacugaacagggaguaaauuauuaaucccugaaucaaaccccacccagagcucccacagaguaccuugucuauggaucaugccaccaugaagaauucuggccaccguacaggacuguuuuucauucagcuucagcgugauucccugaaauaaaggcgacggcacaauaagcuuuauuuuaagcucuuucugagguuauuuuagaaagaacuuacgguaauuucucaggaaaauauuuuccauuuauacccaggauaguccucaacuagaacaggcaugaagccugcuuugaggaggaauuugagauaagaaugaaaagacaauuuugggguuggccaauucccuaacuccaugagcagccucuugcauugacucuucuggcccagugacucauggggcagagaguaacuggugggcgacaauaugacgggggauuaccaugggcucuucugugaccuucucaaacuguaugagucgcacuuuccgcaccuccugucccuugaccugggcagggcuaccuggggcaggagacccguugguguacauguccucggucacaguauucaauggaugcgauacagccugccaagccaaaacaacaaagcaacguaugaaaucaggagcaaggcccacagccaguccacaaucugcaauucuaacauucaagaggcucugaaaacuuauuucauaaguuuggccucauucuuauuugaauugacaugaagcuguuuguaagcuuuauuucuccaacuuaauagacaugucagccaagugugguggugugcaccuguagucccagcuacagucccagggcaacagagugagacccugucucuaaaaauaaauaaaauagacauguuuaucuagguugcugcagaaauauuaaugugccuugauuuacauggugcucuccuggauccugcuugggguauuacauaauauauaacaaaauuagaaagauucugaauccugcggcaccucaggcuccaaggguuucuggcauguucucuucuccuuuguauuuccuugaacaaccugaugcucucggucacacagcaauaaagguaauucagguuagcaucaguuucucaugaaucaccccuuaggcuacaaagaacuucuaccuguagaauuaggcacuuaggacugggccccgaaccgcggugauaacaauaauacauugccacugugacuucuuccccugaucucaaagacagcaaagcuaaaugaguuacucuaccaggcagcaaggccucuuuauuauaaaucuaaaguaauuuaaggcacugugguaagaagaaagacaaacgacccauguaauggaacagagagugcaaaaacagagccacacauuuauagucaggugacacugcagugcagcggggaaaaauggucugcacgauaaaugucauaaaaggucccgaguauaaaaugaaaacuaaaaagacaaacacuuuaaaaguaagaagucuauucaucaaaaaacuccacugagauaagcauagauuuaguagacgagacacggagcaaucaucauacaagcaaacaacugacuucaucaaauucaaacaucuuacauaagaaacuagacagguaugacacagccugagaauaaacauuugcaauauuuacaucugacaaaggauuuguauccagaacauauaaagaacucuuacaauuuaauaacaggaugaaaagaaccauaaacaaauccugaacuugagccaaugauaugcaugcugaagcuuucagggguaaagugcucugauaucugaaacuuauuuugaaauaccaggaaaaagaagguggauagaugggcaguuuuuggauagaaaugugauaaagcaaacacagcaacauguuaacuguagaaucuaggagguguggcuauaugggugucacuauaaaauucuuucaucuuuuuggcgccauuccaagagcagccaguacucuuuaaaaaauauuauaaaauuuaauuuuugaaccauuugagaguaaucugaagacuucauucuccuuuacccauagaugucucuauauguuaggaacgagcauuuucaaaacugaaaauuuaacauugacacaauauugucaucugccaacccuuucaagaauguccuuuauagcuauauauuucuuccccaguccagaauccaaccuaggacuuuuuggucccagaauccaaucuaagaccagaauccaaucaugcauuucacauuuccuuacucuuccuuaauuuggaaaauuuccucagccuuucuuuuucuucuuucaugaccuugacauucuugaagaguacacaccuguuauuuuguagaugucucucaguuugggguuaucaucugauguuuuuucaagauuagacugggauuuugcauuuuuggcaggaauuccaggaaaguaguggugugcccuuuccagaacaacacuacucuuaaaagcccaaaccugaaaauagcccaaaaguccaucaacaguagaauggauaaacugaagcauauccaaguggauacccuacaucaauggcaaugaauggcuacugcuacaccacuccaugguagaucaccuguggaucagucucacaggugaucacucucuucuccuuaaaaugcuccuucucaguuugcuuugcuguucuuuccucaucuuacugaucuggguaagagcaaucacaauggggaaaaacuauggaaaccucugaaaaugcucccugcccaccccagauaaaauauuaaaucaaaaaugauauagccaccuggaggaggaggaggaggacgaggaggaggaauaggccugaagugggcuuauggaagggucugcugaaaauaggggauagcugcauuccagucacacccagaggugacccucaaagacaguagggagggaagaucuucccaauaggcagaacugugaggagugugccauucacuguguggggaaggagaagggucccuagaugggaauagaugguaugccugagcaguguccacuggccugcccaaggccuagaaaaggacuagaagaugagagagaaggaagucuggaguagaggcuuacaucauuucuaagggacucugauuucuaaguagaaacuuugauaagauggugagguuugggccaggugcaguggcuaacaccuguaaucccagcacuuugggaggccaagguggggagaucgcuuaagcccaggaguuugagaccagccugggcaacauggugaaacuccugccucuguaagaaauuuuaaaauuagcugagugugguggugcaagccuguggucccagcuacucaggaggcugaggcagggggauugcuugagcucaggaguuggaggcagcagugagccaugaucacaccacuacacuccaaccugggcaacagaggaagacccugucucagaaaaacaaacaaacaaacaaacaaacaaaaaacauggugagguuugaaguaguauucgcuaucaggugaccucaaaugagggaaguacugagaaagagaaacugccuucucuagcaacuagaacuucaaaaaacucacaugacaccaagucauauggcauugcuguuauaacaaaauugucuaagauaggcuuauauuuaaaaaauugacuuaugauacccgggauacaccauguagguaggaaaaggagguucugagggugaucuugaagauuuauuguuaagcaaaaaauaauaauaaugugaugaaggguauacuagcuucaucauaaacagugaaagaaugauuauauucauauuugcuuaaaaauccauaaacuggccagguucaguggcucacaccuguaaucccagcacuuugggaggcugaggugggaggaucaccugaggucagggguucgagaccagccuaggcaacauaguaaaaccucgucucuacaaaaaauaaaaaaauuagccgggcaugguggcgugcaccuguaauccuagcuacucgggaagcugaggcagaaggauugcuugagcccgggaggucaaggcugcagugaguugugauuacaccacugcacucuagccugggugacagagugagacccugucucaaaaaauaaaauaaaugaaaauacauaaacuaugucuggaaggagacauaagaaacagugguugcuucuagggagaggaacuggguggcuauaagauggggugagaaggaaauuguuuucacuguguaucaaguuauaccuuuuaaauuauguauuaugugcuuguguuacuuuaauaaaauaaauuaguaaaagaauuuuccaaagugauugggacucagguucaaguacuuguguggaucuuguccugccucaaccuugacccuguuuaaguaagaguaaacgggaggagggaaauagaaacccacaaaaagucaucaggguugaaggauuucuuucucuuuguuuuuuuuccuuuucuuuucuuuucuuuuuucuuuuuuugagaaagagucucacucugucacccagucuagagugcaguggcgugaucucggcucacugcaaccuccgccuccuggguucaagcgauucuccugccucagccucccgaguagcugggauuacaggcaagcgccaccacaccuggcuaauuuuuguauuuuuaguagagacgggguuuuaccauguuggccagacuggucuggaacuccugaccgcaagugauccaccugccucggccucccaaaucugcugggauuacaggcaugagccaccaugcccggccaagauuucaauagcuuuccagaagacagaaagcagauggaggaaugaccaaggagaguugagacagcuagagccuagaaugugcauacaggaggcaccagccaaagaggcugggaagauuaguuuaguugagcaucuugccaucccaaacaagaucagggauauguaagugagaagugggauguuggauuggcaaccaguuauaauaaucuaaaaaccacuuauugauuuuuacuuuuuagaacucacuuagaaacaaaucaugaaacaaauaacagacuguaaauaucagcaccaugacaauauuaagguacacauguccaugauaggaaguuggcagguaaaaaggggagaaaaaucgaaaggaagaggccuguaaucuuguucuguuacaaaguggggagucaagaaguaggaucugcauugguuggacaauaaaugaaggagugaaugcauuacauaaaguuccaagccaggugugguggcaugugccuguaguccuagcuacucgugaggcugaggcaggaggaucauuugagcccaggaggucaaggcugcagugagcuaugauagcaccacuguacucuagccugggcaacagagcgagacucuaucucuggaaaaagaaaagaaaaaaucuccaaagcagaaguugcaaacuguuuuauuucgaccacaugucucuguuuuguuuaguaaaaaucaggggacuccaacuucuuuuuaaaguaucagaagaucuggcaucgcucuccagguggccccagcucucacauuccuuacugaugccucagccagaagccaguguuggcuaccgaucacccuauaucugggguguuauuuuucucauacacgagugcuuucacucacuugguccauguagguuacacuaaaagcacguauacaugauggaaagguacagacccaugaaaagcuaaaauaauuuugaaaaacaagagaguaggaagacucagucugcacaguuucaaaacuuacuguaguauagucucaguaaagacuaugugguauagacaugcagaucaagggaacaggauagggaacccagaaacagacccacagagauaugcccaguugauuuuuaacaaagaugcaaaagcaacucaauggugcugcagcaauuggaaacucaucaccaaaaagggaaaugcugaccugaaccuuaccuucuaaaauggauauggacuuacauguaaagugcaaaacuagaaaauauauuugaaaaaaauagaagaaacuugucaggaucuagagcuaggcaaaaaguuccuauacaugacaucaaaagcagaauccauuaaaggaaaaauugguaaauuggaccucaucaaaaugaaaaacucuuguucugugaaagcccacaugaagauugugaaaauacaagcuacagaccgggagaaacauuuacaaaccacauauccaauaaaagacugguauauagaauauaaaaagagagugcucaauacucaacaguaaaaacgaacaaucuaauuagaaaaugggcaaaaaacaugaacagauauuucaccaaagaggauauauaaagauggcaaaugaggauauaaaaagauauucaacaucauuagccaucagggagaaaugcaaauuaaaacaacaaugauauaucacuacacaucuaucagaauagcugaaauaaaaaaauagugacaauacucauaacuggugaagcugagggaaaauugggcaucucauacauugcuggugggaauguaagugauauggcuuccauagaaaauaguugaacacuuuauuaaaaaaccaaacacacaacuaccauaaaacccagggaugacacuccuggauauucaccuagagaaauggaaauuuauguucacucaaaagccuguacaugaaugcucauaacagcuuuauuuauaacagccaaaaucuauaaagaaccaaaauacaggugaacaguuaaagcgugguacauccauaccauggaacacuucucagcaauuaaaacaaaaaacacuauugauacuaaaacaacuugggauccagcucaaaggcauuauccugacugaaagaaagcuaaucuauuucaaaacaucacauacuauaugauuccacuuauauaacauuccuaaaaugacaaaaucauagagacauugaacagaguagugacugcaaggaguugcggggaugggguagggaggaagacaagugugacuauaaagcgacagcaggagagaggccuuuguggggauggaacaguucucuaucuucauuguggugguggcuagaggaauuuuauuuuauuuuauuuauuuuauuuuuuugagacagacuuucacucuuauugcccaggcuggagugcaauggcacgaucucggcucaccacaacuuccgccuccuggauucaagcgauucuccugccucagccucccgaguagcugagauuacaggcaugcaccaccacgcccggcuaauuuuguauuuuuuguagagaugggguuucuccgcauuggccaggcuggucuugaacucccaaccucaggugauccgcccgccucggccucccaaagugcugggauuacaggugugagccaccaugccuagcuaugucauauucuucuuauccagcuuuauuacagugauugcuuuuuacaugucagccuuuaaauuaaagacucagcaaagcuuacuagaggcagaaccauuccagcuggaaaaguucaagaguugccaucccaaagguuggucuuucagaugugcuuauccaacaagacguuccucuuuacgaugacuaagagucacuaucacgcuuacccagaaguugcaaaugaugacuaagaaaaacggaaacuuccaacgugguaacuaaaguacacacuugcaacaguaaguuuuccaaaagcaaagcacaauuuucuccaccgugaacuugucccugagccacccugucuucaugagacucucagaaagggagggucagcucucugugaccucaucuuacagaacuccuucaacuaguccccaugucuccucauuacugacacaucauaggagaaaagauaugcagacauauacugucagugacaugaguaaugcugaacaaauaauaaaggucaaagguacuagauucuauuucucagaguucaguucacaaccuccacaucauccucucaaagcagccaccaucaucuguaguggauauaggaggccacagagcuauggcaggccugccccugaccagugacaaggcagggcggaaguggcucuguuaaggaugacugcugggauucaggaggagccagggaauaaacacucacccaggacuccaugucuggccuuuguucugcagccucuggccuuuaaucagacaaagugcuggaguggcaaugccugccgcucugaaagccccuucagaggaaacaucugcagcaggguucaaagggcagaggcaguugcucaaaggaagcuggaauuuaaaaagagaugaaaaacaaacuuggcggggggcgggcgguggcgggggugaauagagcaggggcaacugaaguuggcuuucuaauccaaacaauuagauuaagugacagugaacauaggaaagaacaaauauuugcucagccuacuguuaggcucuuugccaacugcucccacguggagacuuagaaagccaaguccaagaaggcgagaugaugccagacagcugcccagcaagcccuggccccaggugcucgcaaauucccucucuuugcaugggcaguauccuauuccacuuugggaaaaaacaagagaaacugagaaagccaaggguauucugaaguauuagaaagagauuagcacuguuuaaccacaaaugacaggaacuagggagagaggaaggccuaagagccaggauauucuggcagguacugucuuaaaaucauacauuaaccaggugcuuugcuucucagguacuaaauccaucugggaacacauacaucaaccuaaaggccaagucucuagagaucccuucccaacgagcuuuuucuaccccaugcucucaguacacaugcaaaggcuuuugcuuccacuggggaaaaaaaacaacaggaaacucaaguagcaccguuccacacagcagaaacacagggcugcagauaccuggcacugaguccccacacugccauuaaaccagugccggagcugugugcaaauaacaacacucguuaaaucaaaugcucauccccauucuguggucaauauuugaagacaugaaaugguucagaaaccugucugagcuuaaaggaugaguaagccucagacuccagaaguuaaacuauaagcauggacuuuggaguuugugcagguacauggagagaaugcaggugcugugucccucacauaaaggcugccucugcacugugcagaauauucagagaugauggcaggugcuaaggaggaaaauaaagcagaaaaggccucgcaaggaagauaacuuuugagggaaaaccuauuauguguuuuguucauguauauuucuucauaugaaagaaaaaaagaaaagcaagacuauguuacgaaaguuccucuuccccuccucuggcgucacuuccccuaccccagccaauuuuggaaauauggcuauuuagucuugccuuucuacacuccacacccagaguucuuuuuuagcaacacugaaagguuagagacaacucacugcuuaggagaaaaaucucugcaucaacuaauuuugucuccccucuugacacugucucaggacauuauugauugucacaacuuagcggcgagguauuacuuuuuacaacagaauuaucagacccaaaguguuaacagugcccagguuggcaaacuccaauuuaagggaauugaucuuaaccugaaauaucuguuccugguauucuauuauacuucagugucuuguguagggagaacaaaugaguuagaaaagaauagaacguucaugaugaaacucaaaucugcuuagccacaauaaaagcagauucuuaucugcaagguauccuaagcccuuccaguuuugaaaaaaaagucaugaaaggcccagggcgcuggaucauaccuguaaucccagcacuuugggaggccgaggcaggcggaucaccugagaucaggaguucgagaccagcccggccaacauggcgaaaaccugucucuaucaaaaauacaaaaauuagccaggcguguuggcaggcgccuguaaucccagcuagcugggagacugaggcaggagaaucgcuugaaccuaggaggcagagguugcagugagccaagaccacaccccuacacuccagccugggugacagagcaaaacucugucucaaaaaaaaaaaaaaaaaaaaaaaaaaaacaaaaaacagaaaaaagucaugaaguuccuggaagugaaggacaggaaaggcagacuggcugagaccacaccacauacuggggaaauugggcagaggacuaaauaauuugaaaauuacacuuuacuuucuaguaucaguucugugaaaagaaaagccuugaacggaaccauuuccuuugcaaaggaaacagcaagauccaagucugcagcgaaaguucuuucucaggugaaauuauaacuagucagaagcagagucagugaucaugcacaccguagacucaaccuccugccaucgcagaaggugccgcacucggcaugcaccuugguguccgugcacaggcuguucccucugcccagguaccaccugccaguuacagccuagguacugcgaaaugcaagagcccacugugcugggugccccuccuugcuccacagcgcuccacagcugcuucuaucacaucaccaccacacuacuguauuuguuuccaugucugcguccuuccuuauuugccucuuaguuccagcagcagaccuggaguaggcaacaaacaacacugcgucacacucagugaccaccagcggggaguaaugcugcaugugauggccuaagaaccaagaaacagguuuucuugguggaaauuugccuggagccugacuuaucuguuaggugauuuuuuuuugaugugggauaggcccaagagaauuuucagggauucucaaccaauugcuucagguccuggggaaaguguugcuucaaacaggcccgaagagaaaagcaguauugggaauuuuacaacuacuuuuaugugcauuaauggauacugcugugaagaacaaggccagagagagcuaauaaaauuaguuucuccauuaaccugccuagaccacauugaaaagaaaaaaaaaauuaguuuauccaaggaaggagauauacuuaaauaggggagauaggcuacauucaaaccuauugcaaaauuaccuuuagacaauauucuuucaguauuaaauguggauuauaauuggaagugaaacuuuguuuugaaucgguagccuuuuuccauaaagugacaccuuuaaaugaaacuuucagcaaaauaauuuuauaauuucuauugaagccaacaacuuccucacagguuuuccugcuucaaaucuugccauuauaggaaaacuuucugacugcuacuacugggcaggcagcuccuagggagauacugggucauuacccuggaugucccaguguggcucaagguccuugucaagcauuaucucauguaaauguugccacaaccuuccaaacuugccaguuucauaaaggagagaaaccuaaggcacagagagcuucagcagcuugcccaaaaccaugcagcaagugaaaggcagagcuugcugcugcagcaaagacugguaagagccccaaagggaaggugaaccuaaagaaauaagaauccgcagguuguggagucaagccacacuucaucgugugaagagucucccucagaugcucacuuuggcacagcuggauacuauuucauucagggauucaguaaguuuucuuauuugaucuucuucaaauccguuaguaaaaaccaaacaaauuagcuaacugguagacuaucuccaauauuacaguauaaacucacagccccacaaaacgugcuguuuacucagagguugugcccacaacauaacacugguggugacagggccucuuuucaaaaaggcacagucuuucaagcaugcccauaagggaacacauagguuuacauaagaaccccgacacaaaauacaucauacuguaggauucuauuuauauaaaauuccagaaaaggcaaaucuauagugacagaucagugguugccauguuccagguggaggaaggugacugacugccaagggucacaggggaacuuccuggaaccuugaaaauguuuauucuuugucaugauugugguugucguuacaugacuauauacaucugucaaaugucaucaaacuacacaauuaaauuucaugaauucuacuguaugcuaaguguaccucaauaagacuuccagaaauaaauagauuuuuuaaaaauaguugaggcucagccaagugaguacugauuguggggaagaaaaaaaucacaaguccaaguuuauggggaaucagguaacagaacuuguaauuuugucucaucaucuguauaacaauagcaucuuucaugccuguauuauuucugcacucauuuaaacucaggcuguugcaauccugauuugaaaugacaggcaggugugaaugccucacucgaguggaauauaaaggguaaggcaaugcggugcagcagacacaaaaucuagccucaguucugaugcccauuacuuguuuccuugaguuaaugccacuuagcccaaagagucuacagcucuacugcuugccuuauguugcagggaccuucaguuuuuucaucugugaaaucggaggguuacuguaaaucccaaauguccaucucuucagucauuuauuaauuuagcaaacauuucugaggacccacuuauugggcacuuaaagaagugaguaugacacggcccugcccuagaagaccuugcagucuaggaaggagguucaugcugugacuucugagcuucugccuggcucucugguucucucuggacauuuuccccuugggaccuggccagcaugcugugaggaagaccaagccacagggagaggcugcugguugauuuucuggcucauggcucauggcuccaaaugaguaagugagccguguccccaccugacagacccugagugacgaccaccuugcugggcccaaucaaaacgaaauaugagagacaagaaaaugcucaguguuguaaaccagcgaguuugggagagauuugccaguaacagauaagcacaaccuacccuuagggcaucuuugaggacggagguuaauagcuauuuaccagccauccaucccuggaaucuggauuccuuguuccacccgcaaauauacacuggccacccucuuugcaccauagcacaaggggaccugccuaaaugaagaggaacagugagugagcucuuuagaaccagaagcuggcuuuuacaaucauuucugcugacccaaacacaagcacuucaacaacaaccaggcagaccuacuccuugauguguuccuuaaagacuuucuguuacucugacuuccguccacgaggaaguuuuccuugcccuuaauaagcgcacuguccaggccgcugccucuccugauuuccaacuggaaggacugcugggggcaaggauccacugcaccagcagcccgguacgaacccggccgcgcgcuggccuuguccucaccccgccggcuaucgcggucuccgaccuauggccaggacccgcaaggacaggccccccggggacagggaccgggacagggaaagucccgagaugaauggccgagccccggcccagcgcccuugggacuagcggggcccgcucaccucuggccgacuacgcuucugcagcaaaugcuccagguagaggucggagagcgccgugugcaugcugcccccacucucgcccucgcucgccuugagggucaucucgcagaagcuggaacacuggaacgcaagacagggcagcgcugggaaugacagggcccggggccugcggggcugcggagaaggcgggagacgcggugcggcugggccagucaccgccccgcaggcggugcgccgggagggcgcggacggagcu

SEQ ID NO: 192834 - RNA, 186935 nt, Homo sapiens
uuguuuguaugugucaauguuuuauuuaacucauuacugaagaaaccagcaggaaaauaaaagagcuaguuccaugaacauuugagaaauagagauguauauagucaaugggaaaagaaugccaaaauaagauuaucaaguuaaacauaacaggaaauaaaaccauaucaccuuugggguuaacuccucuaccgggcuauaaaacaaaacaacuuauucauuucuguaaguuagccucuaaacuuuaagaacuucacagggcuauaaaccauuugcaccugcaucauuuguggauugugacuauacugugacagcuauguuauaguuuccaaagaggucagauaagggucaagcaggauuauuagaaaauacuccagcauagaaaaaaguagccauucuuuugccuuuucucagauugggauccauuuuucuuucauauuaggaucuccuguuuuccauuugcccuggguugcaaucuuuggaugcuuccuccaacugcucuauaacuuauccuugucuccagcccccuuuacuaucaggagauucuguguagucauagugaaggggucaggcagauggaaggagcaguaaacccuucacaaucuuauggggguggagggcaagaagggggauccuauuguguggugauauggcagacuggaguguuuuuucuguuuucaccaguccaauuuucuucugaccuccuugauauuucaacuauguaaguaggacucuaguuuucagucacgguauauaauuuccccuguuacauuuuuguuguguuauuuucagcaggaaauuaguagagggagagaguaaacugagugcauuauuagaauuacaaaguuuguaucuccuaucucagauaaccauggauuuuccucauauuuccacagaaauauuaaauguauguccuuuagaagccuaaugucaucaucauuuucuuucuuggccaucacaaauuucaagaagacauuguuauuuuauuucaaagcuuucaacaauugcauccuccugacuuauuuuuuuauuggucagaauuaagaccaaauggcuuuauaucuauggacacucgucagaaaaaugcacauuugcauuuauacagaaugccuuauauaauuucaggggacuuagggauucuugaaccccaucuauaauucucaguuuaagaaugcuaguuuuggagauaagaaugugccccucauaaugacuaaauaacauaauuauaucuauguguaaggaagcagaaacagacuuuacuguaguaguuauuguauucucuccauuuugcagauuguccaaaugauuugccuuuugacuccaagauuguauugaucugauccugaaacaugcuuuguuccaugcuugaucaggauaauaaacaacugagaguuuuauuuuaaacguaugaggcuuaaccugaaauguuaacaucauaaauaucuuuuucaaaguuucaucacauaguuuuucuacaacagaggaaguggugacucugagaggccuaacuuuucagggaagaaugcuuucaugcagguuucuccucacuucuuuuugccuaguuauauuggaaggaaggaguaaucugggagcagcugcagaaaauagguaagaguuaaguuaaauuggaugcacccuccuggccccccaccaaagaaaugcaggacugaugauaguuaauucaggaggcuucaaggcagugucugcuaggauuuagcacaaagguagaaggcaagccagggagggacacugcccuggagcugaggagggagaggugacggcaguggcaggugcugcaguggccacccucaguagagguccugugccucgcagcccagaaccuccauccucagggcaaucuggugcacccaacucugggggugaauucgaagguagcgagucaguaacggugggucuagagaguucaccacaggugugaaggagucuugauuucccugaaaaaccugaaagaggaaagauagcauuuauugguugucugacaggacaauggucacugcaaagcacagacgcuuuucucacuucuaguuguuuccaguaguccaggauuaaacccuggaagaugacuagaugacucuguccuacgcaucugggacaucuagaauuaagagcacccugcuuuggaggccuucacucuagcuaggccuuauaucuacaguguucucacccacuucccaaaccucagugacauuaagugcuuuguccugggucacacacagcaucuguguuggaccaucuggagaugagagucaggcuuuggccagcagacucccuugucaaugcauuugcuguggcaagaggaguacauggcaagagcucagaaaaugguagcuaucguuauuagauaaacugguuucgcacauguuggugacaacuuuagaaugauaacgaaugcaacacagcaaggcaugcaauuuaguguggcugggcaaccuuggcaggaggggaugcagaagagagaaagaagugggaagagucuaagacucaaggcaccuugcuacuccaggacuuuggagcaaaggucaccuauaacuggguggauguuugggaaaaugaagaucugaauguucaaaacguguaauucaaggcaacucugaaacccuguggguuuuguguggauuccgagguaauccuacaguagaaaguccagccaaauggugagaauaagcaagagucuuggagaaaaaggaacagaaugaaggcaauguccuaccauaaugcaugcucuugcaaggacagacagacaccaugauaucuuuaggaucuccugaggcaguuuguguaaaaggaggcaacuugccaccaaaaugggaaagaagugguuaaacagcaacaguagggcuccugcuuccuggagcuauugggugacauuuuccucuaacaauccuggcaucuucaaguguggugucaguuuuacuucggauuccaaaugggaagagacuuuuccuggcaaaugcacugugaaguaacacugugauccuacagagaguuuagcuaucagaacaaaagacguuugggccaucuucauucaucuagcuacauuuucccccuagguucccaacccuggcugcuuauuggaaucgccuuuggagcuuuuaaaaaaugaugcauggguaaguuccccacccccccacccccccaagagaugccaauuuaaucggucuguucccaccuuggcccccuuacucuggucuccaaguucugccuaauauagccccugcccaagucucugaucuguucucccacugcauuccuccuauuuuaccgcaucgcagaugagcugaucuuucaguuucucaacaaugucaacucuuguuuuauuuaacaugagagccuuuguauaugugauucccucugcuuggaaggcucuuaccccuucuguuucuucuuuuauccauguuuuuuacccuucgggucucaguuuaaauaccaccucuuaaacuaagcauaguggcaugccccuggagucccagcuacucagcaggcugaggcaggaggauugcuugagcccaggaguuugagacaagccuaggcaacauagcgaaauucugccucaauuuuuuuuuuuuuuuuugagacggagucucgcucugucgcccaggcuggagugcaguggcaccaucucggcucacugcaagcuccgccucccggguucacgccauucuccugccucagccucccaaguagcugggacuacaggugcccgccaccaugcccggcucauuuuuuguauuuuuaguagagaugggguuucacuguguuagccaggauggucuugaucuccugaccucgugauccacccgccucggccucccaaagugcugagcuaccucuuuagaaaggucuuccucauuauuccucuuguaaaauaggacucuuuuuuguucuaaaucucaacuuauuuguuuccuuuguagcauucaguaucuuuuccuuuaucucuuuacaugcuuauugacuguuuccucugucuccgccaccaaaugucaguuccacaagggcaaagaccuuggucauuguuguaucuucagcacauagaauauauagcauaauguauauagcauggcaaauauaccauaaacaucuauagaaauaaaguucuguauuuggaaaaauuuuugagaaacauuaaggucccuguucugagauuauuuuacaaauguuuacgcuguauuuggaggcuuuguacaucuuuuguuagacuuaauccuuacugcauuaaaucagggggcaugcgaugccagauugucccauuauugaugaugcuaaguuugaucacuugguuaagauguccaccuaaucucuauauuuauaaagguaacccuuucccuuuccuaacaaucuguggagugagacuuugagaccaugcaaauauucuguuucacaacaagcuuuuauccaaugguauuagcaacccuuaaaguucuuuacaaguauucaauaguaaguacauugaugguugcaaacugauuuuccaguuaugauccauuacccucauuauuccuuuugaugcucaaauugucucaaaucuggccaacaggaagcccuucagaccaguuucuguguucuuuucacaugaucccauuaaucuucuggcacaucaagaucaccaagaucaucuaagauugccuggcaguuuccuugauccagccuugaaaaagucauuucucuagggagcucagauucuuuugacuggaaaaugguaguuagagaccaagauuugggcaugggaugggcucguuauuacugcaguguaauuacuucuagauucccucagugaacagugcuaagaauaugauuuuuuaaauuccuaaguucucacugacacuucuaauucaacucuaacauucuuuuuguuaguauuagauuucuagggcuacuguaacaaauucaccacacacuuggugccuuuaaaacaaaagaaauuuauucacuuaucguucuagaggcuuaaagucuggagccuggagcagaggcacaaaagagugugucaaacacaaaaucacauuuaaagcuucuauuuggaagugguauauaugucauguccaaucacauucuauugaucaagaugagccguacggccaugccuaaaguugaugagguuuucaaggaaagagggaauaaaaacucaagaacauuaauaccaucugcuucauaugcuauuuucuguucauuuagaaauuccuuacauuuucuuguuucagcaauaagaggugauuuaugcaggcagacaugagggcuggguggcuuacuagguuucuuagccaggaguacccucuacuguugauaaauggaaguguaauuuauuuaauagaugugaccaaagagguuugugggucuugugauuuaguaauucacuuuuguuuuuauaggacaguuaauuuccaacauuugcuuucuucuuuuuuuuuuuuuuuuuuuuuuugagacaggguuucucucuggagcaagguuggcuagauuuauauauuuauuuucuacuuguaaauauaaacuuauaguacuuuuugucuucugguuauucuauagauggguuaugggugguuuuagucauaauuuaaaauuguguguguauguguauguaugguuuuugaagacuguggagagauuuaggcagcugccauuaucugacaggaaugugcaacuccugcuuggaauuuuuaaaugcuauuuaaaacuauuuuuccaacuguuucagguauacagaaauacaauuaauuuugguauuuauuuuguuuucagcaagcuugaaaaauuuuaaaaauucuaauaauuuauauauaaauuccuuuggauuuucuaucuaugccaucauaucuuccacauacaaugaguuuguuucaucauauucaauccuuacauauuuuccuucuuuuucucaucuuauugcacugcuuaggacagccaauauguauaauccuucagucugucacugugauaaauuauaucaguuuucuaauguauaagccaaacuugcauuccuagcauaaauccaauuuggauccauauugcuaauauuuuguuugggauuuauguuuaugaauaaaacgggccuauuaucuuccuuucuaauauuguucuuguucgguuugguugucaagguuaugcuauuaucauaagauaauugaauaacauuccaucuuuuuccauuuucugaaagaauuuuugcaagguuaauauuauuucuccuuugaaaaauugguagaauauaguuaguguagccaucuggaucuggauuuuuuaaauuaauaaccuuuuaacacuaaguuuggaaaauuagguaaaauggauuaaucccugguaaauacaacaagaaagaacauuuaauauuaauaaguauccucauuuuuuauauuuuuauauuggcagaaauuuuugugggaucuuuauugauguccaguuuuuuaaaguuucugauauuauuugugccuucuuuucaucuugauugcucuugccagaaguuugucaauuuucaaggaaccaacuuuugguuuucuuuauucucucuauuguauguuucuuuuuuacuucauuuacuucauaucuuuauuauuuccuugcuucuacuuccuuuugguuuauuuugcuguuucacuagcuucuugagacauaccuuagcucauuaauugucaggcuuucuucucuuccaauauauguuuuuaacgcuauacauuucuuucuaaauauugcuuuagcugauucccacauuuuaauaugucaugccuuguuaucauucaguuuaaaauauuuucuaauuuaugauuucuuauuugacacauggguuuaaaaguauaguucuugauucuaacauaggaagauuuuauaguuaucuuucuuauuuauaucaacuuuaauuguauugugaccagaaaacauguuuuauauuaucugaaauuugagacuacuuuauuuguagcuuauuuguagcuuaaaauggaaaauucuaacauguuuccuuugugugcuuacaaagaauguguaauuuugcaauuucuuuuuuuuuauuauacuguaaguucuaggguacaugugcacaacgugcagguuuguuacauauguauacaugugccauguuggugugcugcacccauuaacucgucauuuacauuagguauaucuccuaaugcuaucccuccccuguccacccaccccaugacaggccccggugugugauguuccccuaccuguguccaaguguucuuauuguucaauucccaccuacgagugagaacaugcgguguuugguuuuuuguccuugugauaguuuuugagaaugaugguuuccagcuucauccaugucccuacaaaggacaugaacagauccuuuuuauggcugcauaguauuccaugguguauaugugccacauuuucuuaauccagucuaucauugauggacauuuggguugguuccaagucuuugcuauugugaauagugccgcaauaaacauacgugugcaugugucuuuauagcagcaugauuuauaauccuuuggguacauacccaguaaugggauggcugggucaaaugguauuucuaguucuagauccuugaggaaucgccacacugucuuccacaauuguugaacuaguuuacagucccaccaacaguguaaaagcguuccuauuucuccacauccucuccagcaccuguuguuuccugacuuuuuaaugaucgccauucuaacuggugugagaugguaucucacugugguuuugauuugcauuucucugauggccagugaugaugagcauuuuuucauguaucuguuggcugcauaaaugucuucuuuugagaagugucuguuuauauccuucacccacuuuuugauggggucuuuuuuucuuguaaguuuguuugaguucuucguagauucuggauauuagcccuuugucagaugaauagauugcaaacauuuucucccaauuuguagcucgccuguucacugggaugguaguuucuuuugcugugcggaagcucuuuaguuucauuagaucccauuugucaauuuuggcuuuuguugccauugcuuuugguguuuuagacaugaaguucuugcccaugccuauguccugaaugguauugccuagguuuucuucuaggguuuuuaugguuuuaggucuaacauuuaagucuuuaauccaucuugaauuaauuuuuguauaagguguaaggaagggauccaguuucagcuuucuacauauggcuagccaguuuucccagcaccauuuauucaauagggaauccuuuccccauuucuuguuuuugucagguuugucaaagaucagaugguuguagaugugugguauuacuucugagggcucuguucuguuccauuggucuauaucucuguuuugguaccaguaccaugcuguuuugguuacuguagccguguaguauaguuugaagucagguagcgugaugccuccagcuuuguucuuuuggcuuaggauugacuuggcaaugcgggcucuuuuuugguuccaaaugaacuuuaaaauaguuuuuuagaauucuguaaagaaagucauugguagcaugauggggauggcauugaaucuauaaaauaccuugggcaguauggccauuuucacaauauugauucuuccuacccaugagcauggaauguucuuccauuuguuuguauccccuuuuauuucauugagcagugguuuguaguucuccuugaagagguccuucauaucccuuguaaguuggauuccuagguauuuuauucucuuugaagcaauugugaaugggaguucacucaugauuuggcucucuguuugucuguuguugguguauaagaaugcuugugauuuuugcacauugauuuuguauccugagacuuugcugaaguugcuuaucagcauaaggagauuuugggcugagacaaugguguuuucuagauauacaaucaugucgucugcgaacagggacaauuugacuuccucuuuuccuaauugaauacccuuuauuucuuucuccugccugauugcccuggccagaacuuccaacacuauguugaauaggaguggugagagagggcaucccugucuugugccaguuuucaaagggaaugcuuccaguuuuugcccauucaguaugauauuggcuguggguuugucauaaauagcucuuauuauuuugagauacgucccaucaauaccuaauuuauugagaguuuuuagcaugaaguguuguugaauuuugucaaaggccuuuucugcaucuauugagauaaucaugugguuuuugucuuugguucuguuuauaugcuggauuacguuuauugauuuucguauguugaaccagccuugcaucccagagaugaagcccacuugaucaugguggauaagcuuuuugaugugcugcuggauuugguuugccaguauuuuauugaggauuuuugcaucaauguucaucagggauauuggucuaaaauucucuuuuuuuguuguuucucugccaggcuuugguaucaggaugaugcuggccucauaaaaugaguuagggaggauuccaucuuuuucuauugauuggaauaguuucagaaggaaugguaccagcuccuccuuguaguucugguagaauuugagugugaauccgucugguccuggacuuuuuuugguugguaagcuauuaauuauugccucaauuucagagccuguuauuggucuauucagggauucaacuucuuccugguuuagucuugggaggguguauguguccaggaauuuauccauuucuucuagauuuucuaguuuauuuacauagagguguuuauaguauucucugaugguaguuuguauuucugugggauugguggugauauccccuuuaucauuuuuuauugcgucuauuugauucuucucucuuuucuucuuuauuagucuugcuaguguucuaucaauuuuguugaucuuuucaaaaaaccaguuccuggauucauugauuuuuuaaaggguuuuuugugucucuaucuccuucaguucugcucugaucuuaguuauuucuugccuucugccagcuuuugaauguguuugcucuugcuucucuaguucuuuaaauugugauguuagggugucaauuuuugaucuuuccugcuuucuccugugggcacuuagugcuauaaauuuuccucuacacacugcuuuaaaugugucccagagauucugguauauugugucuuuguucucauugguuucaaagaacaucuuuauuucugccuucauuucgcuauguacccaguagucauucaggagcagguuguucaguuuccauguaguugagcgguuuugaaugaguuucuuaauccugaguucuaguuugauugcacuguggccugagagacaguuuguuauaauuucuguucuuuuacauuugcugaggagugcuuuacuuccaacuauguggucaguuuuggauguggugcugagaagaauguauauucuguugauuugggauggagaguucuguagaugucuauuagguccgcuugcugcagagcugaguucaauuccuggauauccuuguuaacuuucugucucguugaacugucuaauguugacagugggguguuaaagucucccauuauuauugugugggagucuaagucucuuuguaggucucuaaggacuugcuuuaugaaucugggugcuccuguauugggugcauauauauuuuggauaguuagcucuucuuguugaauugaucccuuuaccauuauguaauggccuugucucuuuugaucuuuguugguuuaaagucuguuuuaucagagacuaggauugcaaccccugcuuuucuuuuuuuguuuuccauuugcuugguagaucuuccuccaucccuuuauuucgagccuaugugagucucugcaugugagaugggucuccugaauacagcacacugaugggucuugacucuuuauccaaugugccagucugugucuuuuaauuggagcaguuagcccauuuauguuuaagguuaauauuguuaugugugaauuugauccugucauuaugauguuagcugguuauuuugcucauuaguugaugcaguuucuuccuagcaucgauggucuuuacaauuugggauguuuuugcaguggcugguaccgguuguuccuuucuauguuuagugcuuccuucaggagcucuuguagggcaagccugguggugacaaaaucucucagcauuugcuugucuguaaaggauuuuauuucuccuucacuuaugaagcuuaguuuggcuggauaugaaauucuggguugaaaauucuuuucuuuaagaauguugaauauuggcccccacucucuucuggcuuguagaguuucugccaagagaucagcuguuagucugaugggcuucccuuugcggguaacccgaacuuucugucuggcugcccuuaacauuuuuuccuucauuucaacuuuggugaaucugacaguuaugugucuuggaguugcucuucucaaggaguaucuuuguggcguucucuguauuuccugaauuugaauguuggccugccuugcuagguuggggaaguucuccuggauaauauccugcagaguguuuuccaacuugguuccauucucccugucacuuucagguacacuaaucagacauagauuuggucuuuucacauagucccauauuucuuggaggcuuuguucauuucuuuuuauucuuuuuucucuaaacuucucuucucgcuucauuucauucauuugaucuucaaucacugauacccuuucuuccaguugaucgcaucggcuacuaaagcuuaugcauucgucacauaguucucgugccaugguuuucagcuccaucaggucauuuaaggacuucucuauacugguuauucuaguuagccauucaucuaaccuuuuuuuucaagguuuuuagcuucuuugugauggguucgaacuuccuccuuuagcucagagaaguuugaucaucugaagccuucuucucucaacucgucaaagucauuuucuguccagcuuuguuccguugcuggcgaggagcugcguuccuuuggaguaggagagguacucugauuuuuagaauuuucagcuuuucugcucuguuuuuuccccaucuuugugguuuuaucuaccuuuggucuuugaugauggugauguacagaugggguuuugguguggauguccuuucuguuuguuaguuuuccuucuaacagacaggacccucagcugcaggucuguuggaguuugcuggagguccgcuccagacccuguuugccuggguaucagcagcagaggcugcagaagagcgaauauugcugaacagcaaauguugcugccugaucguuccucuggaagcuuggucucagagggguacccagcugugugaggugucagucugccccuacuggggcgugccucccaguuaggcuacucgggggucagggacccacuugaggaggcagucuguccguucucagaucacaaacucugugcugggagaaccacuacucucuucaaagcugucagacagggacauuuaagucugcagagguuacugcugucuuuuuguuugucuuugcccugcccccaaagguggagcguacagaggcaggcaggccuccuugagcugcggugggcuccaccaaguucgagcuuccuggccgcuuuguuuaccuacucaagccucagcaauggcgggugccccucucccugccuugcagccaccuugcaguuugaucucagacugcugugcuagcaaugagcgaggcuccgugggugugggacccucugagccaggugcaggauauaaucuccuggugugccguuugcuaagaccauuggaaaagcgcaguauuaggaugggagugacccaauuuuccaggugccaucugucacagcuucccuuggcuaggaaagggaauucccugaccccuugugcuucccgggugaggugauaccuuacccugcuucggcucaugcucggugggcugcacccacuguccugcacccacuguccgacaagccacagugagauuaaccugguaccuuaguuggaaaugcagaaaucaccugucuucugugucauucaugcugggagcuguagacuggagcuguuccuauucggccauguuggaaccacccuuguaauuuugcaauuucaaggugcuauuuucuaaauaugucuauaagaucaaacuugugaaucauguuaauuguucuauuucuauacauuguuccaucaauugacgagagauguguuaaaaucuagccucccgaguucacgccauucuccugccucacccuccugaguaacugggacuacagguguccgccaccacacccggcuaauuuuuguauuuuuuuuuaguagagacgggguuucaccauguuagccaggauggucucaauuuccugaccucaugauccaccugccucggccucccaaagugcugggauuacaggugugagccaccgcguccagccaugaaaucacauucuuaaucuucagcaauacuuucuugcuuuaaagucuauuuuucugcuaucaauagagcuguaaucgauaucuuuuagauauuugcauaauuucuuuucccauuuuugucuugcuacuuuucuguaucuaauguuuuagauaugacucauaaaaugcacacaauuuacuuuugcuuuuuuuuuuuuuuuuuaaagagacaagucucacuaucuuguccaggcugaaccuccugggcucaagugauccucccacaucagcauccuaaguagcugggacuacaggugugagccaucacacccagcuacuuuugcuuuuuuaucaaucugacaaucuuugucuuuuaacugaaauauuugguccauucauauuacauaugauuacuguuauauuucaauuuaaauauaccaucuuaucuugcuauuuuuccuaccuguuuuauguuucuuuaucucucuuugcuugcuuucauuuagguuuguugaguauauuuuauccuuucauauuuuuucuucuaccauuuugggagucuuacauuguguguauuucuauuacuuacuggcuauccuauaaacuacaacauuaaucaaauuaugaagguuuaauauuaacaucuuuaccuccuagauaauacauggauuuuagaauccuuuauucuauuuauccacaugcugacuuuuuugcuguugucauauguucuaaauuuucacacgcacaccuggcuuaaacaauagaaauuuauuuucucacaguucuggaggcuacaaguccaagaucaagggguaggcaggcuuguuuuguguguguguguguguguguguguguguguguguguauuuuuuuuuugucuguuuguuuuuugagauggagucucccucuguaguccaggcuggaaugugauggcgcgaucugggcucacugcaacuucugccuccugggcucaagcaauucuugugccucagccucccgaguagcugggauuacaagcgcaugccagcauguccagcuaauuuuuguauuuuuaguagagggggguuucaccauguugggcaggcuggucuugaacuccugaccucagaugaucuuccugccucagccuuccaaagugcugggauuacaggcaugaguuaccacgccuggccagcaggcuugguucuuuuuuuuuuucuuuuccuuuucuucuucuucuccuucucuuuauuuuuuuuuuuagaggcagggucuuguucuguuucccaggcuggagugcaguggcacaacccuagcucacugcacccuuguaacaagaacuacaagugcacacuaccacaccuggcuaaggguugguuucuuguaaggccucucucguuggcuuguaggugucuguccucuuucuauaucuucauguggucgucccucugugccugucuguguccuaauuuccucuuuugcuuuaacgcauaaaagauauuuucauuagguuuucuuuuugagagagggguucacauuguuuauuuuagcauugugaagacaucauucauuauuuucugauauuugcuauuauuuagaaaucagcugucaguuuguuacucauuaugguaauguacaugucuucugacuuaucuauugcaaaauucgcaaacauaaaauuuaccauuuuaacaauuuuaaagugugaaguucagugccauuuaguacauucacaauguuauauagccaucaccacuaucuaguuccagaacauuucuauaaccccaaaaggagauucaauacuuauuaagaagccacuccacauucacuccuucugccagcuucuggcaaccacuaaucuguuuucugucucuauggauuugcuauucuggguauuucauauaaguggaauguggccuuuugugccuggcugcuuucacuuagcauaaugcuuucaaggagcauccauguuuuagcauggaucaguacuuugauuuuuuaugaauaaauaauaguccauauauggauagaccacauuuuguuuaucuguucaucacuugaugaacauuugaauuguuuucaccuguuugcuauuaugaauaguacuucuauaugcauuuguauauuaguuuuuguuagagugccugcuuuuaauucuuuuggguccacacccaggaguagaauugcugggucuauguuaauucuauguuuuccuuacugaggaacugccaaaauauuuucuacaguggcugcccuauuucacauucucaucaucaaggaagguuccaauuucuuuauauucuugcuaacacuuguuauuuucccgcuugacauuuuguuuuuguuuuuuuuuuaauuuagccauccuagcagguuugaaaugcuaucucauugugguuuugauuugcauuucccuaauaacuaaugauguugucuaucuuuucaugaguuuguuggauccuuguauaucuucuuuggagaaguuccauugaaguccuuuacccauuuuaaaauuugguugucuuucuguuguugaguuguaagaguucuuuuuauauucugggauacuaggcccuuuaucagauauaugauuugcaauuuuuuucuccuauacuguagaucaucuuuuuacuuucuugauaguguucuuugauguacaaaagcuuuuaacuuuaaagaugccuacuauauauauuuuuauagaguuguugcuugugauuguggugucacaucuaagaaaccauugccaaauccaguaucauaacaauuuaccucuuuguuuuuucuuacaguuuuaugguuuuagcuuuuauauuuaguuuuuugauacauuuuuaguuaaaugauuuuuuacagacagggucuugcucugacacccaggcuggagugcaguggugcgaucauggcucacugcagccuccaccuccugggcucaagcgauccuccuaucccagcuucccuaguagcugggacuacagguguguaccaucaugccagcuaauuuuuuuuucuuguuuuguagauacagagucucacuguguugcccaggcuggucucaaacuccugagcucaagugauccaccagccuuagccucccaaagugcugggauuacagaugugagccaccacauccagccuugaguuaaauuuuguauaugguaaagauccaacuucauucuuuugcauguggauauccaauugucccagcaccauuuguugaagagacuauucuuuucccacaaaauggucuuggcacuuuuauugaaaaucaauugaccauagauguauaggcuuauuucuggacucucaauucuauuccauugaucuaugugucuauauuuauguaaguacugcccuguuuugauucuuguagcuuuguaguaaguucugaaauugggaaguaugacuccuccaacguuguucuuuuucaagauuguuuuggcuauucagggucccuugaaauuccaucugaauuuuaggauagauuuuucuauuccucaaaaaaaaaaaugucuuugggauucugauagagaaugcuuugaggccggagaaucgcuugagcccaggaagcagagguuauggugaguggagauugcaccaccacacugcagccugagcgacagagugagacuccgucucaaaucaaaaaacaaacaaacaaacaaaaaaacccagaaugcuugcuuugaaucugcaaaugguuugugguaauauucuuaucuuaagaauauuaugucuucaaauccauaaauccaggaugccuuuucauuuauuuaguuauuuaauuucucuuuuaauuuuuaauuuuuaauuuuuuucuaguugcuaauuuuccauauuugcugucuucagaccagacaguucuuuaguuucuuucaacuggguuuuuuuguuuuuaguggacaagacuugcaccuccuucguuaaauuuauuccuaaauauuguauuaucuuugaugcuauuguaaauagacuuuucuguuuuccuuuucauauuuguaauuguuaguauauaaaaauacaauugauuuuugcauguugacuuuguaaccugcaaugguuuuuuucaacugccuaauaauguuggauaauuugucuuuuauuuucauguuuccauauguuauuacuuuaaagauuuuauacauaauuauuucauauuauguauccgauaaugucaauaucugguguucuucaaguuuuaaaucugaauugauuguuucuguucacuuguacucaaguugucuuguugucuugcauguuugcugaucuaugucugugaucuuauaauuuuaauauguaggaauccuggaggccuaaacuggaggugcuuuuuuucuagaguagguugagaaugguucuuccaggugccagaggauaauauuuaucugcaacuucucuagcuuccuucugggauucaugacaaugcagaauucucacacugaguucuccuugcauuuugcucaaggcuuagucuuccaguaacaacauuaauaugggcauucugucugaggaaaggucuuccuuuuuauauuugcucauuauucaccucuccgcuaugauuucagcucauuauuuuaaaauagaaguuuguggggguuuuuguugauggggaggcuggagauuccccuuucuuugcuaaauacaacaaugcauugucagugauauagccuuuuuuauuguuguacaauauacauaaaauuuaccauuuuaaucauuuuuaaguguacaauuuagugguauuaaguauacucacaauauugugcacccauuaccacuauccauuuccagaacuuuuucaucaccccaaacagaaacucuguacucauuaaaaauaacucuccauuucuuccccauuccaagacccugguaaccucuuuucuacuuucugucuuuaugaauuugccugcucuagauaccucauuauggugguuaauuuuaugugucaacuugacugggccauggggugcccauauauuugauuaaacuuuauuuuaugugugucugugagaguguuuuuuggugagauuaacauuugaauugguagacuaaguaaagcagauuguucuccccaguguggguagaacuuauccaaucaguugaaggccuaaauauaacaaaaaggcuuacuguccucuuaguaagagacaguuccuucuauuugacuaccuuuaaacugggacuucaguuuuuuuccugccuuugggcucgaacuaaaacauuuuaacucuuucugggucuguagccugcuggucuuugaacuggaacuacgaaucagcucucuggggucucuaggcugccaacucacccugcagaucuugagacuuggcagacuccauaaucacaugagcuaauuccuuguguguguguguguguguguguguguguauguaucuccucuugguucugguuuuguuucuuugggaaccaugacuaauacagauuuucacaccaagagugauucuaaaggaacagaauuuuaaggauaaauuuuauaaauuuguuauuggauuucuggaauugguucuguaaccugaugaaauuuaaagacacuaaugacuauuuucaguaguaaaaauuguccauggcaugaucuggcaauagaaauauguaggccaggcugggcgcgguggcucacgccuguaaucccagcacuuugggaggccgagguggauggaucaccugaggucaggaguucgagaccagccuggccaacaugaugaaacccugucucuacuaaaaacacaaaaauuaggcaggugccuguaaucccaacuacucgggaggcugaggcaugauaaucgcuugaaccugggagauggagguugcagugagcugagaucaugccacugcacuccggccugggugacagagcgagacuccaucucaaaaaauauguauaugcaaaauaucuccauuggauacuccuaaucaacuacuuuuaagaagcaagggucuuggugacuauguauauugacacuugugaacauauuugucaaacuaaugaauaugaugggauuagucgguugcuccuaauguugcuggaaaaagugaugaaagaaaaggaggagcucaggaauuugaauucccagcucaagagcugcauaaaugacuugacagauucuauguaugcccugaaggagacccuuaucuacuguagccacagagcugagauugcugaaaaucaaaugccaaaucucauccugugacuaacugaauuacaaagcaagccaaacucccagcuuugcagggugucuacuguuaaagcaagggcagugauugggaaagaauggggcacuacaaguuggauuagguauguguggaagacccugauuaagcuggggacauugagcuccuaaauauugaugagucuucuuugucagugaaaguuuucucuccagcccugugguggcaguaucucuacuccagucuaaguggauuaacccugcacugccugaggaaacuguaauggcuuccccugaggcaacugccaugcaagauaaugcugauuccuucaggacccacccuaccaccccucuuuguuauuagaucuauaacuacacucaagucccagcaggcgaggugagguaugaaggugacccaugacaaggugcacuacacuccaaaaucaugacuugaguuuucuaauuuacacaagcaggaauccagagaauauguauaggaauggguacuaaggaugugagauaacgguggaaggcacguaaaguuggauuaggccaaauuuauugacaugggcccacuaagcagagauucuggacuuaauguugcaucucagggaauuaggaaggccucuaacaguuuaauugguuggcugaaacacagaccaaaagauggcccacagugagcaaacuagaaauuucagacuugcccugguuuaauguagaagaaaggagauugaaaugcuagagugaauuugucauuuaagacauacucaccaacacugggagaguucagaagacacagaucucacuauuacuuugaggaauaaauuugugaggggaaccucagcauccuugaagggcucugugaucacucuucucuguaggugacaccuuacagcaggaccugcagucacugaauuagaaaaccuaaauacaaugggaauaauuggauccugggguggaaggggccaaugggcagcacucaacugccaaaggcaagguaagugugguuaccauaagggacagcagagucaaagcagcaguuagaauaguaugacuugcacagaccuaugguguuggcuaguagauuauaguguuccuagaugugauauagauagaaugccuaccaaauucuugaacugcauaaguggaaaaguucuaggucaagugaacaaaagucuaaccugaauaauaaaaacagagucacggccucucaaucaauucccagacuugagcagguuuacagacccagcacuccuugaaugaaggggaggcucagucuccuugaggaaggacucugguacacugccaagaauacugccacucuuucucucagccuuccccaaagggacauauggccuuucuaucagaauaaaugugcacugaagaaaaauaauuaaucagaccuuucagggacuacuggacaauggcucugaacuggcacuaauuucaggagacccaaaaugucacugugguccaccagucagaguaugggcuuauggagggucaaaugaucaauggaauuuuagcucaaguccaucucaaaguggaugcagaggaucugugagacuaucuugugguuauuuccccaguccuggaaugcguaauuggaacagauauauugagcagcuagcaggaucuucacauugguucccugaccuauggagcaggggcuacuguagugagaaauccuccuguaauccucugugaauaacuguucuccuuuugugagauagcucuuggccuacuacugggccuuaguagauacugaaugcuuagccacagaccaccaaguugccaugugaccugaacugcccaucaugaacuagguguuaucugacccaccaagccauaaaguuggguaugaacaauggcacuccaucaucaaauggaagugguauauacaugaucaugucugagcagguacugaaaacacauguaaauuacaugaagaaguagcccaaauguccauggugccuguuucugcuacccugccuucucucucccagccugcacuuauggccccauugggaguucccuaugaucaguuuacagaggaagaggagucuugggccugguuuacagacgguucugcacgauaugcagguacuacacaaaaguggacagucccgaucugagauacccaugaaggacagugggcagaauuuuaggcaguguaccugguuguggacuuugcuuagaaggagaaauggccaggugugcaauuauaugucaaguaaugggcuguagucagugcuuuguccagauagggacuuggaaggaacaugauuagaaaacaggugacaaagaaauuuggggaagagguauguggacagaucucucugaaugggcaaaggaugugaauauauuuaugucccaugugagugcucaacgaagggugaccucagcagauaaggauuucaauaaucaaguaaauaugaugggccgggugcaguggcucacgccuguaaucccagcacuuugggaagccaaggcgggaggaucaccugaagucaggaguucaagaccagccuggccaacauggugaaacccugucucuacuaaaaauacaaaaauuagccaggcauggugaugcgugccuguagucccagcuacucgggaggcugaggcacgagaaaugcuugaaccugggaggcagagguugcagugagcugagauugugccacugcacuccagccugggcaacagagcaagacuccaucucaaaaaaaaaguagauaugaugaccuguucuguggauaccagucauccuuuuuacucagccaccuaugucacugccugaugggcucaugaacaaaguagccaugguggcagggauagaggcuaugcaugggcucagcaacauggacuucuauucaacaaggcugaccuggcuauggccacugcuaagugcccaaucugccagcaguagagacaaacacagaguccucaguauggcaguauuucccaggaugaucagccagcuaucuggcagcagguugauuacauuggaauauguucaucauggaaggggcagcguuuuguccuuccuggaaggaaacugaacuacugcuucacaauggagguauggaagagugugucuggaauacaauagaucccuuagagugucucuuaguauuaccaggcccuaugauucuggucaaugggaaacuacagcaacccaauccaugcaggacuacuaguggcccaggcucuucaggaauaaagguuugggucaccucaucagguaaagaaccacaaucagcugagaugcuugcugaaggcaaagucaauacagaauggguaguagaagaagguaguuaucaauaccagccaaguuuuguuauaucauguuagguggaauuaugaccucauuuuugucucuacuuagagauaaaggagauguguaugaugggugcuacauugacaagggguggacuugucaugguuaauuuuauguaucuacuuuacuuggucauaaggugcccagauauuuacucaaacauuauucugguuauuucugugaagguguuuuugaaugggauuaacaucgaagucaguagacugaguaaagcagauugcucucccuaaugugggaggcaucauccaauuaguugaaggccugaauagaacaaaaagacugagucuuccccaaguaagaaaguauucuugcugccugucugccuuuggacuggaacaucagcuuuuuccugcuuucagucuugaacuaaaacaguuuagcucauccagagagacagagagagagagacagacagacagaaucuccuauugguucuauuucuuuggauaucccugacuaacacacucauauaaguagaaucauauaauaucuauccuuuuaugucuggccuauucacuuagcguauuuucuuuuuuuuuuuuuuuugagauggagucucacucuguugcccagguuggaaugcaguggugcgaucucggcucacugcaagcucugccucccggguucaugccauucuccugucucagccucccgaguagcugggacuacaggcacccgccaccacgcuuggcuaauuuuuuguauuuuuaguagagaugggguuucacuguguuagccaggauggucucaauuuaccgaccucgugaucugccugccucagccucccaaagugcugggauuacaggcaucagccaccgcgcccggccuucacuuagcauauuuugaaaguucaucauguuguggcacuaaucagagauauaaccuuuuuuaaaugggaauuuuucuucuagaauauccaaugucuagacuucaguucaccaaacugccaguuuggugaagucuuucauccagccuugauggauaagggaauucuucuuggacaugauguuuaccugagacuuaacgaaugagucaggugaaaguggcaguagaggguagcuagaaaaauguuccagguagaagaaauaguaucuauuuaaaagccugguaugagauauaauggcuguauuuagugaccugagaauuucuuaguauggauggagcuuaaagagccaaguggcaagagacuguauuagagagauugguaaggaccacaucaugguuaauucuuggugaaaaaagaauauaaaaaauaccaaagagaggaacuauuccuucccccauuacucauggggugauaagacuuuaugucaugucuuuuaaucaggacaauuuguugaauuauccagcaaacccagauuaagaaugaagacuuccuggaccacuaaacuuaaaggucaaaaaggcuugggaaucaaggugcugaugaggagaauuaacucuuggaucuacucugcccuuuucucaguauuuuaccuuuuucuuaaagucacuguguucucucagaaugccuuuuacaaugucuugcuaccauagguacuuaauaaauuuugcucugaaaauuuggucauauaucaaccuuuuuauguuauguuaagcucuaggagaggugguauuuuuuuucuuucuuucuuucuuuccaaggagaccagcuuaccuuuacuuugccauucugaaaaaagagaguccacugauggccaucuugacugcuggagaugaggaacuccuucacauacaugcugguaagcagagauuuuacucccugaguaguuacuccugugacuuucauugucuucuggaaguccacuugcagccacucuuuuggauuauucaccugagggcaauagaguuggacuaguagccucuuggucaccauuuacucccagaaauucccaaaucccucuuaaccauaccacagcacuucucacucuacuuucuuuuuugagacggagucuugcucugucacccaggcuguagugcaauggcaugaucucagcucacugaaccucugccucccgaguucaaccgauucuccugccucagcuucccgaguagcugugguuacaggugcccaccaccauguccagauaauuuuauauuuuuaguagagaugagguuucaccagguuggccaggcuggucuugaacuccugacuucaggugaucugccaccuaggccucccaaagugcuaggauuacaggcgugagccacucugcccggccuccuuccuuccuuccuuucuuucuuuuucuuccuuccuucuuuccuuucuuucucucucucucucucucugccucuuucagacagagucaggcacuguugccugggcuggagugcaauagcaugaucucagcucacugcaaccuccgccucccagguucaugcgauuauccugccucagcaaaagagugaucuagaacuccugaccuugugaucggcccgccucagccucccaaagugcugggauuacaggcaugagccaccgcacccagccuccacuuucuauuggcuagucagucucucuuauucaacucuaagcaacuucagggccaaaauuuuucacaauucaccuuuguaucccuaggcucauccuagggauacuaagaugugcaguaaauguuuacuuuucauugauguaaugagaaaccuggaaagaaagcuaauuguugauauuuaucuguaaaauggacuuuagcuucuacaauucuuugacagauauuagcucaguacuagauauagagauucuucuuccaggagguucaauuagagaucauuucccccaaaugccugugugguugucugcccauaaccaaacuuccuugacacacuuuuuagaacuaacaguugacagaaauaccucagaagaaacagucaaggccuuccccgauuuuuuccccaaccacugcucugagucaguuaaacaguaaaucuguugccucuuaccugaggucuccaggcauuacuccucccuuggaggugaagucgagcuuuugaaggagaccagguggcaaacauauugguaaaguaggaugaagcaguaaucugugcaucugauauugcuuuacucuccauucccaauggcaugcugcaaccucaaagaaaagaaaaaagaagguuaucacaaggacaugcuucagccucaguuauacugagcagcuuccacugauauucuagggcuacugucaucauaauaucauuucucagguuuuaacuuuugcacagauucuguuauugguuuuuuguuuuguuuuguuuuguuuuuguuuuuuugagauggagucucgcuuugucacccaggcuggaguguaguggcaugaucucagcucacugcaaccucugccucccgaguucaagcgauucucuugccucagccucccgaguagcugggacuacaggcgcacaccaccacacccggcuaauuuuuuguauuuuuaguagaguugggguuucacuauguuagccaggauggucuugaucuccugaccucgugauccacccgccuuggccucacaaagugcugggauuacaggugugagccaccacgcccggccaauucuguuauugcuaucuguuuuccagccagcucuucccacuuugugugacucuuuaauuuucuuuguuucuuuucuucuucuacuuuuauuuuagauucuagggguacauggguagguuuguugcauggguaaauugcaugucacugaggcuugguguaugaaugauccccucacucagguagugagugcaguacacaauacauaaccuucuaacccacaccccccucccaaccucuccccuccugaguguccaucauuguguccaugugcauuuaauguuuagcucccacuuaugagaacacaugauauuugguuuucuguuccugcauuaguucauuuaugauaauggccucuagcugcaucuauguugcugaaaaggacaugaucucauucuuuuuuauggcugcauaguauuccaugguauguauguaccacauuuucuuuauccaaucuguuguugaugggcauuuagguugacuccaugccuuugcuauugugaauagugcugaaaugaacauaugcgugcaugugucuuuaugacagaaugauuuauauuccuuugauuauauacccagugaugggacugcuggguugaaugguauuucuggguuugcccaggacuaugcugguuuuagcacugacaauuuuguguccugauaccgggaaccccucccccagucucaggauaacuagaacaguuagucacccuacccaugguugagggaagaaggauaugggaugacuuggcacuuacuauuuaaaucacagcccaucaacuccaugcgaagagugcugcgaaugcuauaaugaguugggugcaaacggauguaucgagcaauaauuggaggguuaaaaauauuguguuuuaucccagaugaauccacauugccaaagaagaccuguauggagagauuagcacaaauacauggaaagugaauacagaguaaaaagcaauuucugucaaucauaucuuccuucuaauuugcuuugugcguuucucaacagcauccaacaucuacauaagacaacuaugguuagauggauguuacgaugguagacacaaaggaggaaagcaccaagaagaagugggaacaaaggaaauuauuaggucuggggcaagugaaguuauuuucuacuuugaguuccuguaaaaggcucauaaaaguugaggaagccauuugggcucugcuacuccagcaugguccacagaccaggaguagcagcaucaccugagggcaauucaaaaugcagcaucaggagaacgguaucagugaguugaugggauaggaggucccuagcucuuguucccccacaggaacaauaauuugacaaugaucuauggacaaaagugucuuugugggagccuugggauucagguaggagguugagaaacccugguagagcucaagaacaaagaugaauacuuuaauaaggcaggcccacauucuagcggcaggccugucaacuguaguucugguuguggacccagaagcagcccaccacccuggggacuuagcuccagaguuguuuguaugugguccuaccacuaucccuaucugcccaggaaucugggaggagcaacucccauuggcaaccccaguaacagggcucccaacuguggacucugaagcagcccuguaccuaaagcagcuucaguaccacacuaccauggucuuggggaaguuuugccuacuuaggaaacaggugggagucaugccaguccaccucuggaagcaggcccaccaacuagaccugacuguggacucagaaguaacccugugagccaacuccagucuugcuguaccauguucuggagacaguccugccugaauccacacuuaccugugcccccauaacaggcccacugacugugggcccaaguggggacccugaagcagcccuuugacccagcuccaggcccacugcaucauggucugcaggcaguccugcccacucaaggacccagugagagcuacaccuauccaaagcccugguaaugggcccauugucugaguacccaacuucagaccagaagaggugucagcucacuccaaugcacagauaccaaugcuaggcuauguggaucaugaagaaucaggcaaauaugacaucaccaaagggaacuaauaaagcuccaguaaccaacccugaagaaauggagauucaugaaauuuuugacaaagaauucaaaauaaucauuuaaagaagcucaauuagcuacaagaggauacaggaagacgacuaacaaaaugaggaaaacaauacaugaacaacauuagaaguuuaauaaagaaauaaaaaccauaaaaaagaaccaaauaaaaauccuguagcuaaagaauauugcugaauauagcugaagaaugacugaacuaaaaaauuuaauagcgaucuuuaauagcagacucaaucauucagaagaaagaauuuguaaacuugaagacaagucauuugaaauuaucuaguuagcggaauaaaaagaacaaugagaaagagugaaggaagaacagaggacuuaugggacaucaucaagcaaaaugauagaugcauuauagaaaucuuaaaaggagaagagagagagaaaggaaacuuauuuaaagaaauaauaggugagaacuccccaaaucuauggaggggaagugccaucuggauucauuaagcccaaagauaaccaaauacauuaaacccacagaagucuacagugagaugcauuauaauuaaauuuucaacaaagacaaaagagaauuuugggguaguaagaagaaagugaauugucaccuauaggggagcuccauaagacuaugaguggauaucucagcagaaaccuugcaggucaggaaagagugggaugauauauucaaaguacugagagaaaaaaauccaaucaacaauacuuuaucuggaaaaacuguccuuuaagaaugaacacaaagauaaagccuuucucaaacaaaaacugaggggguuugucaccaugagaccugccuuauaagaagugcuaauaguucuucaaguugaaauaaaaaaaaaacaguaacacaaaagcauaugaauccuuucacugcuaaagguaaauauaaagagaaacauagacuauuguaacacuauaaugauuguuauaaaucacuauuaauauuaauuuauaaauuaaaagacaaaaauaguaauaguaacuauagugacagaaauuugucaauggaaacacaauauagaaggaaguaaaauaugacgucgauuacauaaaguuguggcggggggaaugaguaaaguauagaguuucuguaugugauugaagguguugucagcuuaaaacagacugccauaacuauaaaguguucaauuugaucccugugguaacccccccgaccgcccccccacacaguagauauacagaagauaaagagaaaagaaucaaaacacauccaagcaaaaaucaucaaaccacaaagaaagaaaaagaggaaaggaacaagaaaacuacaaaacagaaaacuauuaacagaauggcaacagaaaguccuaaccuaucaauaauuacuuuaaguguaaauugacuaaacuccccagucaaaagacacagaguaacugaaugggcuuuuuaaaaagccaacaauucagagaugggaaguaagaaacaaaaauaaacaggacccaacuacauguuguugauaacagacucacuuuugauuuaaggacauacauaggcugaaagugaagggguggagaaaguuaugccaugcaaacuguaaccaaaagagagcagggguggcuauacuuguaugagaaaaaauagucuuuaaguaaaaaacugugacaugagacauagaaggucauuauauaauaaaagggucacuugaacaggaagauguaauaauuauaaauauauauguacccaacacgaaaguaccuaaauauauaaagcaaacauugacagacauggaaggagaaauagauaacaauauaauauaguugacuucaauacuccacucucuauaaugaauagaucaucccaacagaaaaucaauaaggacaaaacagaacugaagaauaaaauagacccaauggaccuaaaauguauauacagaacuuuccacccaacaguagaauuaucaagcacacacaaaacauucuucaggacagaucaccuuucaggucacaaaacaagucauaauaaauuuaagaagauuaauaucauaccaaguauauuuucugaccacaauggauugaaacuacaaaucaauaacaauaagaaaacacgaaaauucacaaauauguggaaacuaaacaacacauucuugaacgaccauugggucacagaagaaaccaaaaucuugauaauauaccaaaacuuaaaggaugcaguaaaagcauacuaauagggaaauuuauagcaauaaaugccuauauuuaaaaagaagaaacauaugaaauaaacaacccaacuuaucaccuccaggaacuacaaaaagaagaaaaaaaaaacuaagcccaaagguagcagaacaaaggagauaauaaaugcuagagcagaaauaaauaaaaaagagaauaaaaaaacaauuggaaauaacugacaaaacuaagaguugauuuuuuugaaaaaauaaacaaaauugacaaguccuuaucuagacuacgaaaaaaagagagaagacucauauaaauaaaauauaaaugaaagaggagacacuacaacugaugucacagaaacagacagaaccauaagggacuauuauaagugucaacaaauugguuaaccuagaggaaauggauaaauuccuagaaacauauaacauaccaaaacugaauaacaaagaaauagaaagccuuaacagacuaacaacaaauagggauauuaaaucuaguaaucaaaaaccuuccaacaaagaaaagcccaggaccaauggcuucauggaugaauuccaucaaacauucaacgaaguauuaauaccaguauuucuuaaacucuuccaaaaaauacaagagagaacacuucaaaauacaauuuauuagccaacaucacccugauaccauauccaggcaaaaacaacacuagaaaagaaaacuacaggccaggccaggugugguggcucaagccuguaaucccaacacuuugggaggcugaagcaggcaaaucacuugaggucaggaauucgagaccagccuggccaacaaggugaaaacucaucucuacuaaaaaaauacaaaaauuagcugggugugauggcauguuccaguagucccagcuacucaggaggcugaggcaggagaaucgcuugaauccaggagguggagguuguagugagccaagaucauaccaccacugcacuccagccugggugacagagcaagacucugucucaaaaaaaaaaaaaaaaaaaaagaaagaaaaagaaaaugaaaagaaaagaaagaaaacuacaggccaauaucccugaugaacacggauacaaaaauccucaacaaaacaccagccaaccaaauucaacagcacauuaaaaggaucauucaucaugaacaagugguauuuaucccuaggaugcaaggaugguucaacaugggcaaaucaaucaaugugauauaccacauuaucagaaugaaagaugaaaaacacaugauuauuucgaucaauacagaaaaagaauuugacaaaacuagauauccauucauaauaaaaacuuucagcaagauagauacagaaggaacuuaacacaauaaagaccauauaggaaaagcucacagcugauaucauaaccaaauguggaaaaacugaagguuuuuccuuuuagauacugauaugguuuggcucuauguucccacucaaaucucaccuugaaucguaauccccauaaugcccacaugucaagggagggaccuagugggaggugauuggaucauggggaugguuucccccacgcuguucuccugauagugaguucuuaugagagcugaugguuuuauaaguguuugacaguuccuccuucacacacucucucuugccugcugccauguaagaugugccuauuucccuuucugcuaugacuguagguuuccugaggaaagaacaugggacuuaugggacagccaugcagaacugugagucaauuaaaccucuuaaagcuucauaagugaaggagaaaugaaauucuuuacagacaaccgaaugcugagggauuuugucaccaucagaccugccuuacaagagcuccugaaagaagcacuaaacauggaaaggaacaacugguacuagccacugcaaaaacauaccaaauuguaaagaacauugacacuaugaagaaacugcauuaacuaaugggcaaaacaaccagcuagcaucauaaugacaggaucaaauucacacauaacaauauuaaccuuaaauguaaaugggcuaaauaccccaauuaaaagacacagacuggcaaauuggauaaagagucaagacccaucaguaugcuguauucaggagacucaucucacuugcaaagacacacauaggcucaaaauaaagggauggaggaauauuuaccaagcaaauggaaagcaaaaaaaaaagcaagaguugcaauccuaaucucugauaaaacagacuuuaaaccaacaaagaccaaaagagacaaagaagagcaucacauaaugguaaagggaaaaaugcagcaagaagagcuaacuauccuaaauacauaugcacccaauacaggagcacccagauucauaaagcaaguucuuagagacauacaaagagacguagacucccacacaauaauagugggauacuuuaacaccccacugucaauauuagauuaaugagacagaaaauuaacaaggauauucaggacuugaacucagcucuggaccaagcagaccuaauagagaucuacagaacucuccaccccaaaucaacagauuauacauucuucucagcaccacauuacacuuauucuaaaacugauuacauaauucgaaguaaaacacuccucagcaaauacaaaagaauggaaaucauaacaaacagucucucagaccacagugcaaucaaauuagaacucaggauuaagaaacacacucaaaaccacaaaaauacauggaaacugaacaaccugcuccugaaugacuacuggguaaauaaugaaaugaaggcagauauaaagauguucuuugaaaccaaugagaaugaagacacagcguaccagaauuucugggacacacuuaaagcaguguuuagagggaaauuuacagcacuaaaugcccacaagagaaagcaagaaaaauugaaaauugacacccuaacaucaaaauuaaagaauuagagaagcaacagcaaacaaauucaaaagcuagcagaagacaggaaauaacuaagaucagagcagaacugaaggagauagagacacaaaaaaaccuucaaaaaaucauugaauccaggagcugguuuuuuugaaaaaaucaacaaaauagauagacuucuagccacacuaauaaagaggaaaagagagaagaaucaaauagaugcaauaaaaaaugauauuggggauaucaccacugaucccacagaaauacaaacuaccaucagagaauacuauaaacacgucuaugcagauaaacuagaaaaucuagaagaaauagauaaauuccuggacacauacacccucccaagucuaagccaggaagaaguugaaucccugaauagaccuauaacaaguucugaaauugaggcaguaauuaauagccuaccaaccaaaaaaaguacaggaccagacggauucacagacaaauucuaccagaggcacaaagaggagcugguaccauuccuucugaaacuauuccaaacaauagaaaaagagggaauccucccuaacucauuuuaugaagccagcaucauccugauaccaaaaccugacagagacacaacaaaaaaagaaaauuucaggccaauaucccugaugaacaucgauacaaaaauccucaauaaaacacuggcaaaccaaauccagcagcacaucaaaaagcuuaucuaccacaaucaaguuggcuucaucccugggaugcaaggcugguucaacauaugcaaaucaauaaacauaauccaucacauaaacagaaccaaugacaaaaaccacaugauuaucucaauagaugcagaaaaggccuucgauaaaauucaacaccccuucaugcuaaaaacucucaauaaacuauguaucgguggaacauaucucaaaauaauaagagcuauuuaugacaaacgcacagccaauaucauacugaaugggcaaaaacuggaagcauucccuuugaaaacuggcacaagacagggaugcccucucucaccacuccuauucaacauaguauuggaaguucuggccagggcaaucaggcaagagaaagcaauaaaggguauucaaauaggaaaagaggaagucaaauugucucucuuugcagaugacaugauuguauauuuagaaaaccccaucaucucagcccaaaaccuccuuaagcugauaagcaacuucaguaaagucucaggguacaaaaucaauguacaaaaaucacaagcauuccuauacaccaauaacagacaaacagagagccaaaucaugagugaacucccauucacaauugcuacuaagaaaauaaaauaccuacgaauacaacuuauaagagaugugaaggaccucuucaaggaaaacuauaaaccacugaucaaggaaauaagagaggacacaaacaaauggaaaaacauuccaugcucauggauaggaagaaucauuaucaugaaaauggccauacugcccaaaguaauuuauagauucaaugccaucuccaucaagcuaccacugacuuucuucacagaauuggaaaacacuacuuuaaacuucauauggaaccaacaaagagcccucauagccaagacaauccuggacaagaaggacaaagcuggaggcaucaugcuaccugacuugaaacuauacuacaaggcuacaguaaccaaaacagcaugguacuggggccaaacagauaugcagaccaauggaacagaauggaggccucagaaauaacaccacacaguuacaaccauaugaucuuugacaaaccugacacaaacaagcaauggggaaaagauucccuauuuaauaaaugguguugggaaaacuggcuagccauaugcagaaaacugaaacuggaucccuuccuuacaccuuuuacaaaaaucaacucaagauggaucaaauacuuaaacguaagaccuaggaccauaaaaauccuagaagaaaaccugggcaauaccauucaggagauaggcaugggcaaagacuucaugucuaaaacaccaaaagcaauggcaacaaaagccaaaauugacaaaggagaucuaauuaaacuaaagagcuucugcacagcaaaagaaacuaucaucagggugagcaggcaaccuacaggaugggagaaaauuuuugcaaucuauccaucugagaaagggcuaauauccagaaucuacaaagaacuuaaacaaauuuacaagaaaaaaacaaacaaccccaucaaaaaaugggcaaaggauaugaacagacacuucucaaaagaagacauuuaugcagccaacagacauuugaaaaaaugcugaucaucacuggucauuaaagaaaugcaaaucaaaaccacaaugagauaccaacucacgccaguuagaacggugaucauuaaaaagucaggaaacaacagaugcuggagagguuguggaaaaauaggaacgcuuuuacacuguugaugggaguguaaauuaauucaaccauuguggaagacaguauggcgauuccucaaggaucuagaacuagaaauaccauuugacccagcaaaucccacuacugggcauauacccaaaggauuauaaaucauucuacaauaaagacacaugcacauguauguuuacuguggcacuauucacaauagcgaagacuuggaaccaacccaaauguccaucaaugauagacuggauuaagaaaauguagcacauauacaccauggaauacuauacagccauaaaaaaggaugaguuccuguccuuugcagggacauggaugaagcuggaaaccaucauucucaaaaacuaucacaagaucagaaaaccaaacacugcauguucucacucauaagugggagcugaacaaugagaacacauggaaacagggaguggaacaucacacgcuggggccuguugggggguggggggcuaggggagggauaacauuaggagaaauaccuaauguaggugacggguugaugggugcagcaaaccaccagggcacguguauaccuauguaacaaaacugcauguucugcucauguaacccagaacuuaaaauauaauuuaaaaaauaaauaaaauaaaaagcauccaaauagaagagaauaguaaaauuaucucuuuuugcagaugacaugaucauacauguagaaaacucuaaagacucaaaaaaaaauuguuagaacuaauacaugaauucuguaaaguugcaggauacaaaaucaacauacagaaaucagugguguuucuauacacuauaaaauaucccaaaggaaauuagaaaauaaucuuauuuacaauagcaacaaaagaauaaaauacuuaggaauagacuuaaccaaagaaaugaaagacuuguacaaugaaaauauagaaaacauuuaugaaggaaauuaaagaagacacagauaaauaaaagauauuccauauuccuagauuggaagaauuaguauuguuaaaauguccacacuacccaaaguaaucuauagauuugaugugaucccuaucaaaaucucaaugguguucuucacagaaauaaaaaaaaaauuuuaauuaauaugaaaucacaaaagaccccaaggaggcaaagcaaucuuuuuuuuuuuuuuuugagacagagucuugcucuguugcccaggcuggagugcaguggugcgaucuuggcucacuacaaccucugccucccagguuuaagugauucuccaccucagccuccagauuagcugggaucacaggggccugcuaccacaccuggcuaauuuuuguauuuuuucaguagagacgggguuucaccauguuggccaggcugcucuuaaacuucugaccucaagugauccacccaccucagccucccaaagugcugggauuacaggcgugggccaccacaugcagccuggcaaagcaaucuuaagcaagaagaacaaagcuagaggcaucauacuuccugauuucaaaauauacuacaagucuccaguaaucaaaauaguaugguacuggcauaaaaauagacacaucaaccaagggaacagaauagaaaagcccagaaauaaguucacacauuuacagucaacagauuuuugacaagggugccaagaacacacaacggggaaaagagagucucuucaauaaaugauauugggaaaacugaauauccacaugcagaagaaagaaauugggcccuuuucucacacuauacauaaaauucaacucaaaauugauuaaacacuuguauauaagaccugaaacuauaaaacuccuagaagaaaacaggaaaaaagcuaccugauauugauuugggcaauaauuuuuuuauaugacaccaaaagcacaggcaacaaaaacaaaaauagaaacugggauugcauuaaacuaaaaacuuucugcacagcaaaagaaauaaucaacagagugaaaagacaaccuauggaauggaugaaaauauuugcaaacuguauaucugauaauggguaagaaacucaaacaacucauuaguaagaaacaacccaauuaaaaaugggcaaagaacccaaauagaauuuuucaaaagaagaaauauaaaaggccaacagauaaaugaugcucagcaucacuaacccacagggaaaugcaaaucaaaacacaaugagauauucccucacaucuauuagaauagugucuuagucuguuauggacuauaacuuauuauggacucuaauuuauuaugcugcuaugacagaauaccacagacugaguaauuuguagugaacagaaauguauuuggcucacaguucuggaggcugggcaguccaagaucaagaggccagcaucuggcaaaggccuucuuucuauaucauaacauggcagaagggcaaaaagagggcaagagagagcaauucaaauucacagccuuaggugcuuuuguaaucggcauuaauccauucaugaggguggaguccucauaaccuaaacaucucccauucggcccuaccucccaacacugucgcauugggaauuaaguuuccaacacauguuuuuuggggaaaacacucaaaccauagcaaauagcuauuaucaaaaagacaaaagaugacaaauguuggugguaauguggagaaaaggaaaccuuuguacacuguugcugcaaaaauaaauugguacagccauuaugaaaaacagcauagagguuccucaaaaaaacuaaaaaugaauaccaugugaucuggcaaucucacuucuguuauauauccaaaggauacaaaaucaguauguugaauaucugcacucccauguucacuguaacaguauucacaauagucaagauauggaaacaaccuaaguguguccauugauggauggagggauaaagacaaucugauauauauauaucugauggaauauucccacaauuauaaaauauuauuuggccuuaaaauagaagaaaauccucccacuugugauaacauggaugaaccuggaaaauauuaugcuaaguguaauaagccagacacugaaagaaaaauacuucaugaccucauauguggaaucuaagauggucaaacucauaaaagcagacaguagaaucuuaggugcuagggacuguggugugggggaaacagggagauguugaucaaaggguacaaaauuucaauuaugcaagauaaauuaguucuggagaucuaauguacgauauaguaacuauaguaaacaauauuguauacuugaaauuugcuaaaagaguaggucauaaauguucucaccacaaaaaaagguagcuaggcaaagagauagauauaucuuaauuagcuugcuuguggugaccauuucacaauguaucaaacaucauauaugaaaaacaaaauauaucaaaacaucaaguuguaccucuuaaauauaugcaacuuuugucaauuauaccuaaauaaagauuuuuuaaaagagaugcaguuccuugggcaccaugucaguucuacugaaucagaaucuaaauuuuaauaagacccuuagcuguuucauaagcaguaaaguuugaaaacacuggcagaggacacagucagcugugaaagaguacugggaaugcacagccuauccuccacccuggucucagaaugaucuucuaagaauguaguguguguguguguguguguguguguguguguguguguagagagagagagagucuauaaugugggcauuaaugaaugaucccacuguaugaauuaaugagacacguuaguauccaaaacgugggauuugacaccuugacaugucuggguucuggacaaaauuacauaacauauucaagagaaagggaauacaguuugagaaauaugguaguaaugccaauucgaaaggccuagauuuaaaccauggcauacagcauaagaaauacugaaaaugauaucacucauagaacaccugggauuuuuuaucugcuugaauacacuaaaauagguaucaguguaagucuauuauaugaucacacaucaguuuaguaucaugggaauuuuuuuuuuuuuuuuuuuuuugagacggagucucgcucugucgcccaggcuggagugccguggcgcgaucucggcucacugcaagcuccgccucccggguucacgccauucucuugccucagccucccgaguagcugggacuacaggcgcccaccaccacacccagcuaauguuuuguauuuuuaguagagacgguguuucaccguguuagccaggauggucucaaucuccugaccuugugauccgcccaccucggccucccaaagugcugggauuacaggcauaagccaccgugcccggcuggaaauuuuaaaaaauuauucugccauguagcauuuuuuucuucccagggaauagaaaauauuaauaaauuuguggcuuuguuccuaaacaaguuauaccagaaaucacaauauucuuuuuuauaaauauaucuguauugggggguuaaaauagaaugaauaacauauucaaaccauauaacuuuguuuaaagauuuaccaaggauuuuguuuucucugcugcucuccuuucuauauaggagaaaauuugaccuucuauuuauggccuuuagauuuggcuuuugcaagagcuaguauaauuaaaucccagguaauaaguaaacacuccaaaccaccucucuggggugggauggugcaaaaucauuuguagaaagcuaccuguuucgucuagcuaccuccugcguaaguggguacuggcagcucuugggggccugaauuuuaugucucauuuugacuaaaauaaugaauguguagucugacuccaaaaggggauagucaucuuugauuugagauaggucucguuauguuuccaaauuucugauuuaaaagaaauuuguugcuacagaauaaucauugagaaguagaagaaguuuugaaaugaaguauauaucaauguaaaaugccauuccguuuuaucagcauccaaaaaguuuauguugaacuuaagaguauuauauagcuaauaaauguugaucauuaacuugugacuaaaccguaugugcuaggaagaauaugaucucucagugauguccacauuuuaauccccagaacauuugacuguguuauguugcauggcaagagggauuuaagguugcagauggaauuaaguuugccaauuagcugaugucaaaauagggagaauauccuggauuauccaggucggcccaauguaaucacaagaggccuugaaagugagagagagaggcagaagaggagagucaaagggagacgugacuacuuaagaauagucacaaaggugcaauguuacuggcuucgaagauggaggaaggaagccaugaguuaaugaauguguguggccucuagaagcuggaaaagaaaggaaaaaggauccuuuucuuuuucuuuuuuuuugagagggagucucacucugucgcccaggcuggagugcaguggcgccaucuccgcucacugcaagcuccgccucccggguucacgccauucuccugccucagccucccgaguagcugggacuacaggcgaccgaaaaaggauccuuuucuagagcuuccagaaagaaaugcagcccugaugacaccuugauuuuagcccaguaagacuugggucagucuucugcccuaucgaacuguaagauaauaaacuuguguuguuuuaagccauauuaaguuugugguaauuugccaccccagcauuagaaaacuaauacccuguauacauuggcuuugccuucauucguuacucaaucuuugugccuugauuagaaaccugcuuggggagacaauuuauuaauucaacaaauaguuaaugacugacuauacaaauccuagauuccauauauuaugugccaggcauugugcuagaaggccucacugguaaauucuacuaaauguuuaaggaaggauuaacauuaauccuucuuaaacucuuccaagagacagaaaaggagaguaaacuuuacaacucauacuaugaggccaccauaucuugauaucaaagccagacaaauauaucacaagaaaagaaaauuacaaauugcauguaauugaauaugugaguauaauauucccuuaugcaucuaggugcaaaaaucuucaacaaaauauuagcaaaccaaauccagcagcauguuauaaagguuauagcccaugcucaaguggaaauuaucccaauaaugcaagacugguucaacauaagacaaucaaucccccagucaacuccacauuaauaaaauauagggaaaaaaaccccugcaaguucauucugguugaugcagaaaaaucacuugauaaagcugagcaccuuuucaugaccaaaaaaaaaaaaaaaaaaaaaaaccacuaagcaaacuagaaauggaagagaaaauccacaacaugauaaagagcauucauaaaauacccaaaacuaacaucacacucaaugguagaagacugaaagauauuucccuaacauuagaaacgagacaagaaugccugcuuuuacugcuucuauucaaaauuguauuggaagucuuagccagagcaauuaggaaaaaaagaaauaaaaggcauccaaauugaaaaggaauaaguaaagcuaucuuauucucagaugaacaugagcuuauguauggaaaaccccgaagaauccacaaaacacuauagagcuaauaaacgaauucagcaaaguugcaagauauaagaucaacgugcaaaaaucaguuguauuucuacacacuagcaaugaacaaucugagaugaaauuaacaaaauaaaaaauaauucuauuuaaaauagcaucaaaaagaauaaaauacuuaggaauaaauucagcuaaggagguaaaagacuuguacacugaaaacuacaaaacauugcugaaagauauuagagacagcauaaagaagugaaaauauauccuguguucaugaauuggaagacaauauuauuaagaugauaguacuacccaaagugaucuacagauuuaauacaaucugcaucaaaaucccaauggccauuuuuuuuuuggcagaaauggaaaagccaaucuuaaaauucauguguaauugugcaagaccucaaauagccaaaauaauccuaaaaaauaacaaagcuggauaacucacauuucccaaauucaaaacuucguauaaagcuacaguuaucaaugcuuugugguacuggcauaaggacagacauauauauaaauggaauagaauuaagaagcaagaaauaaacccauaaauauauucauggguauguaccucaaauauggaugguucccagcuuauaaugguuggacuuacaauauuuugacuuuaugaugguaugaaagcaacaugcauucaguagaauccauaugcauaaaaguacuuaaaguacacauacaaccauucugccuuucacuuucagugcaauauugaauaaauuacgugagauagucaacacuucauuauaaauuuggcuuuacguuauaugauuuugcccaacuguagccuaauuguaaguguucugagcauguuuaagguaggccuggcuaaauuaugaugauugguagguuagccgcugauaugguuuggcucuguauccccacccaaaucucacaucgaauuguaauccccgugugucagaggagaggccuggugggaggugauuggaucauggggguggauuuccccuugcuguucuugagacagugagugaguucucaugagaucugaugguuuaaaaguguaugacauuuccguccuucacucucugucucuccugcuccaccaugguaaggcgugcuugcuuccccuuuaccugcugcugggacuguaaguuuccugaggccucacagucaugcuuccuguuaagccugcagaacugugaguccauuaaaccucuuuucuucauaaauuaccaagucucagguaguucuuuauagcagugugagaauggacuaauauagcuguauuaaaugaauuuacacuaauaaugguuuuaacuaacaauggguuuaucaggauauaauaccaucccaaguugaggagcgucugcaauuuaaaacaucuguucaaacaaacacuuguacaggagcguucauggcagcacuauucacacuauccaaucaguaauguaggggaucaaaugccaccucaaaauaugccacuuuggcauauugauuauuuuguguuuaaaggcacuugaaaguagcagaugcaagaagggcacacugaccuuccuuuuuuuuucaugaaaggaagagaugaaacucugaugugaaagguauuaucuguauaccaggaagaagaaacacauucuuauugccagagauggggaguccaggcuugagggaaagcugcaccaaaaaaccuuguuacacaacucuuaccuucuuagugacuuuuccacaauuaacucuccuagcccaaaccccaaugucuuguuauguuuucacaauuuaccauacuuuucccacccuaguauguaaguauucagcuguaauuaaucacuugagucuucguauuucuuaugagggcucccauguacauguaaaaaaugccaaauaaaauuuuguaugcuuuucuuuuguuaaucuaucuuauuuaaguccuagcuggagaaucuaagaggauagaggacaacauuuaccuccccugccauggaaaucauuuaaugaacuguucaucaacugaugaguagauaaacaaaauguggccuauuuauacaacagaauauuucucguugguguugucucaaugcuuaacacaguauaccuggcacuacccuucaauauuuuuugaagaaugagcacaugaauuaucaugucuccagcuagguucaccaguaugaguaauauguagugagugucuacugugugccauuuuacuaccuaaacuuuuuauggacucuguccccuagucuuaucuaccaaugccauugucuuaguugagauaucugucauuucuugacugguauaauacagcagcuuucuaauuccaaucucaguccucucuguucuauucuccacacacaauccucucuguucuauucuccacacagcuuccagggugauauuucuagaggcaaaucagaccacgucacucccaagcugaaagaccacaguggguucaguguagccuacaggguauucuaaaaccugagcauggcauaauagaaccuccaugucuuggcuccugccuaccucuuucccagccacaucaaccacuacugcuccacuggcaucguacucuccagccuuaaugaauugguugcaacuccccuccucccaccggugccuuggcuucucaucaugcuacagauucuuuaacacacacauuguccuccaagaagcuugccagauccacuccuauucuuucaacgaaauguuuauugaccacucuuuauacacuaugaccaaauaggauuuaucccacaaauguaagguugguucaacaugugaaaaucaauuuauauaauacaccauauuaacagaaugcauggcggagcgggggcgggggagggggcucauggucaucuuaaucauguacaaaaaggaucauuugacaaaacgcaguacccuuucaugaaaauaaauucaacaaaccaggaacagaaagaaacuucuucaaccugauagagggcauccaugaaaaacccagagauaauaucauacuuaauggugaaagacugguugauuucccccuaagaucaggaaugccacuuguaacucaacaucguacucaaaguucuagucagggcaauuagucaagaaaaagaaauaaaaggcauccagaucggaaaggaacaaguaaaaccaucucuauucauagaugcauagauggcauguucuuauauagaggacacuaaagaguccaacaaaagaaaaaaaaaaaaaacugagacgguuuggcucuguguccccacccaaaucucaugucgaauuguaauccccaccuguugaaggaagggccuagugggaggugauugaaucaugggggcggacuucccccuugcuauucuucugauagagcgcucacaagaucugaugauuguuugaaaaugugcagcgcuucccccuuugcgugcguucucucucucuuccuccugcuccaacaugugaagaaggugcuugcuuccccuucgccuuccgccaugauugcacguuuccugaggccugcccagaagcagaagccuuguacagccugcagaaccaugaggcaauuaaaccucuuuucuuuaggaauuacccauucucaggcaguucuuuauagcaguguaggaacggacuaauaugccaacccugucugaguaugcucagcaaagcauauucggcucagcaaaguugcaguauccaagaucaaucugcaacagucgguuguauuucuacacccuagcaaugaauaacaugaaaauaagauuaaggaaaugauucauuuuacaguagcaucgaaacaauaaaaugucgaggaauaaauuuaacuaaagguguacaagauguauacucugaaaauuucaagacguugcuaaaauaaauuaaagaagaccuaaauaaaucgaaaggcauuuuguguuaacggauugggacacuuaauauuguuaagaugcccauaaucuccaaggcaauauacagauucaucgugaugccugucagaauccaaccugccuucuuuguaaaaacugacaagcugauccuaaaauucauaagaaaauguaaggggcucagauagccaaaacaaucucagaaaagaaaaaaguugaaggacucacacuucccaauuucaaaacguacuacaaaaccgcaguaauccgaaaagggugguacugccaucgugaucgauacauuaggucaauguuacagaacucagagucaggaauaaacccauauauuuauguaaaguuuauuuucaguaagaguuccggcaccccucaauggguggaggggaagaauaauccccucaacaaacugcgcugggacaacuggauagccacaugcaaaagaaggccccuggaccccuaccucacaucauguaaagaauuaauucaaaauggaucacagaucuaaauguaagggcugaaacuauaaaacucuaagaagaaaacggagauguaacuuugcacgaccuuggauuaggcaacagcuccuucaguaugacaccaaaggcaaagccacagauaucuuuucauuuggcaaguuggacuacauccaaauguaaaucuuuugggcaacaaagggcucuauccagaaagugaaugggagaaacauuugcaagucacauaucugauaagagucuauuuuccagaauauaugaauaaguuuuagaagcccacagccaaaauacaaucaaccgaauuaaaaaaugggcaaagggcuugaauagacauuccuccaaagcagagguacagagggccaagaagcacaugaaaagaugucuuagucuguuuucuguugccauaauugaauacccgacacugaacaauuuauaaagaaaagaaauuuauuucuuaccguucuggggacugggaagugacccggcaucuggggacggcagaggguaucacacggcgagagggcaagagcguguaugucguuucaggccucucuuccuauucuuauaaagccaccagucgcauccugggggucucaccccgaugaccuuaucuaauccuaauuaccgucucagaggcugcgccuccaaucaacaugugaauuuggggauuaaguuuccaagacacacaauuugggggaugcacucaaaccacagcaacaucauuagccauuugggaaauacgaaugaaaaccaccaugagauagcacuugacacccaguaggauggcuacuguaaacaaaacaaaaugaggcaaacagaaaacagguuuugaugaggcugugaagaaauugggacucucaugcacuacuguugggaaugcgaaagauuacagcugcuguggaaaucaguuuggugguuccucaauaaguuaaacagaauuaccacacgagccagcaguuugacugcuagaaauagacccaaaagaacugaaaagagauauucaaagaaaaaccuguagagagauggucauggcagugccacucacaauagccagaagggggaaauaaccuguccaucaacugacgaguggguaaacaaaauguggccuccuauucauacaacagaaucguacucagucauucaaaggaaggaaguagugauucaugccucuacauggaugcacccugaugaaaccauuacgcuaagugaaagcagccagacacacacggccucacauuuggucguauaauuccaucuauaggaaaucuccagaacaggcuaaccucuauggacagaaagcagauggacuagggguugccagggacuaucgggaacguguguaugggcgggggcagggggugugugugggagggugugggggcugguaguggugguguggaaggaggcgugcggcaagugacugcuuauagguacagggguuucgguuucuuuucgggguguugaaaacguuuuggaacuagguggucgugauggaugugcaacauugugaaggcgugguacccguccuccccucgcccaccccuuugucuuucccacgguguucccauccaguagaaagggaaaguucccacuggcaaagagagggucaccagcgcgauucccccugccccgccccaccccacccccacggcccuccagccacuucuaggcccaggccugcucccucgaggccaaugggaaagugaugaggucaccugacggacgugugucccuugugaggggccgucaccacaugcgugcccgucgccggaugugcgugcccauuggucucggcucccuagccaaugaggggcugggcccuggucgcuaggauacacaguacuggacgcgguaacuguccucuugagagccaucuugccuagcugggccaagccgagauagcacacucaacgcccagcaugccgaggaggaggagacgccgaggguccuccggugcuggcggccgggggcggaccugcucucgcaccguccgagcggagcuuucguuuucagugagccagguggagcgcagucuacgggagggccacuacgcucagcgccugagucgcacggcgccggucuaccucgcugcgguuauugaguaccugacggccaaggucccggagcuggcgggcaacgaggcccagaacagcggagagcggaacaucacuccccugcugcuggacauggugguucacaacgacaggcuacugagcacccuuuucaacacgaccaccaucucucaaguggccccuggcgaggacuagcuucugacacccggccccugggaccugacagguccacucguccacccacccggccccaaaucccccggccugaacccccggccuuaaacacccuccccccacaacccaggccccaaagucuugggccuucauuaauucugucaauaaaauguuucaaggaagccaucugcccgcuucagucacuuugccuuggggugggggugggggggcggugagauggguugggggguugugagaccuccacagcuggagggauggagagguggugggggucugggguugggugggagccagggauggcacagaggagcagucucuccgggugacagugcaggggaguggcccugggugggaaggggacacccccgcugguucugagcaagucagggccugcccgggaaaguccucagcaugaugguguucguuggggcgggugggccucaagaccaugacugcaguguugcgacaggacggacuucuaaggcaaccgggguggggacggagagguggacccggugcuuggcaaggggcccuggaccggaagacggaggacugaguagucggggcggggggggggggggacaacagucuagaaaugcgcagacauggaauuagggucacgaguuucguuugggucauguucagauggagaggcugugggaugccuuuagcaaccuagaccacuugcauugcagccgagcuagcagcagcuggugccccgccaggccccgcguaccuucccagggucuuggauccgcauccccgagacccucgauuugcauacgccgcucacagcccggccaggccccgccuccgaucccgcucuuugcaccucaucagggcaaggggcaggcucgggcuggggagccggcgcgggcacggcggcagcccgccgagggggacgcagggcacgucgccccgccccggcccgcccgccagcugcggcggcgcgucgggaagugcuuggggcggcgagcauggcggcagcggcugcaggccugggcggcggcggcgccggcccgggacccgaggccggggacuuccuggcccgcuaccggcugguaucgaacaagcugaagaagcgguuccugcggaagccgaacguggcggaggccggcgagcaguucggacagcugggccgggagcugcgcgcccaggagugucugcccuacgcggccuggugccagcuggcgguggcgcgcugccagcaggcgcucuuccacgggcccggggaggcgcuggcccucaccgaggccgcccgccucuuccugcggcaggagcgcgacgcgcgccagcgccuggucugccccgccgccuacggggagccgcugcaggccgccgccagcgcccugggcgccgcggugcgucugcaccucgagcugggccagccggccgccgccgccgcccucugccucgagcuggccgccgcccugcgcgaccugggccagccggccgccgccgccggucacuuccagcgcgccgcccagcuccagcugccccagcugccccuggccgcgcugcaggcgcuuggcgaggccgccuccugccagcugcuggcgcgcgacuacaccggcgcccuggcggucuucacgcgcaugcagcgccuggcgcgggagcacggcagccacccggugcagucacugccgccgcccccgccgccggcaccccagcccgggcccggggcgacgcccgcccuaccggccgcgcugcuuccuccgaacuccggcucggcggcgcccucucccgccgcccugggcgccuucucggacgugcugguccgcugcgaggugucccgcgugcugcugcugcuccuccugcaaccaccgcccgccaagcugcugccggagcacgcccagacccuggagaaguacuccugggaggcuuuugacagccacgggcaggagagcagcggccagcuucccgaggagcucuuucugcugcuccagucuuuggucauggcuacccacgaaaaggacacggaagccaucaagucgcugcagguggagauguggccacuguugacugcugagcagaaccaccuccuucaccucguucugcaagaaaccaucucccccucaggacagggagucugauccaucccauucacccagugacuucuuuuugcccaggccuggacuuuuugcaucagucacguuaaccagaugacuuugccuguuaccaaaccucaugcauccacguuugcgucuggggaggaauaaaaagacaucguucccgcuucugcguuuuguuauuccuacugccgccauaggaauuauuucguuggcugaacguuaccagcaccccgagaacacauuuugauagaaucagaguagaggacauggcugucuucuaaaaagccacgacaugaaaaugacaaucccuuucgucuccuuccuccgcugcuuccaccuaacgcagccuccugccuccgccuuuguuucauagugaggauuuuauuuugcacggcgcccucccucuaaauaccuacccuagaugauuucauccugccccucacuucuuaacauauuccugugucuuuguaauggccaaauuucuccuuccacucguccgcacgguacgucuucaugggagucauuuuauuccuuacagcuuccuuguaaccacagcccuaaauccaugauaaagcuacucuuguacuccucaugugugguuuugguguccgucgucuauaaaaugugacucucuuaccuacuugucaggaggccagcagcagaaccagauagcuguuugggcuccaggauguauucguuccuuugaaauuugcgcuaugccuccuaugugggcaacgaaccugcagagaucaucuaugaugugcuccguacucgggugacugcaaugcagauacauccagugcagcgggucuggugccgaugcaucgauuugcauuggaauucacgguucugguuccauucgcagagguauaugcagucuggaucacaacagcuuuuauuuguaauagggauuuuuuuuuuuuuuuuuuuuuuuuuuccccccgagauggagucucacucugucgcccaggcaggagcgcaguggcgugaucucggcucacugcaaccuccgccuccuggguucaagcgauucuccuaccucaaccuccagggugccugggauuacaggcgugcaccaccacgcugggcuaauuuuuguauuuuuaauagagauggggucucaccauguuggccaagcuggucuccaacuccugaccucaaaugauccacccuccucggccucccaaagugcugggauuacaggcaugagccaccacgccuggccuguaauagggauuuugcugcaacuuuuaguuaaguaggugaaaucagagugcguggcccuuugguguugugcgaucacgugacugcaaggcagccuccguguucccccaaagcaggauggcguuccguuugagaacacuuaaguuuccaaggcuuucuggcucaaauggagcaugccccccaacuacgcuguuuucuuauuuauugcgucuuuuuaauccuuuugauggugacaacaagaacucuucagaauauagccucuuucucaaacuuucaacccuggggaaaugcauccuuugggccgaaguugcacacaauccugaucuucggggcugagauguaaggacacaguuuggaguagguguuuuuguuuugcgucuuuuugcaggggagagguguggaggguugucacugugaguugagugccuccaaaugggugggacuuguaggguguucuuuucugcuucuauuucuauuucgacaguguggaaguaaugggaagcacaggagaggcccauuccaccaucauuccucuuucucucacuuggcugccaggaaggguccuacggagcccugaacgccuagcccaaauuauuguaaaagcgguugaagggcucaugcuccuuugcucuuuggcucuuuccugguaugcuccucuuaacccgggcugcagaccuggccggcuggcuucuugucagguucaggaguuacggagcaugacuggugaccaguuugggauuugggcuucaggagaagccuccuuaggccucugguccaaacuccuugcgucagggaggugaggggaaggauaaccagacggucagguaguggguaucugagcauaauucuaggaaacacuaaaacuccucguuuuccauuugccgugggcucauucauguaucucccucagaagcuuaagagcagugauaacugggccgaggccagauuucagcaguuuugagaauucccucguaauguaucacaucaguaucaaaagucaacacugauuucuagcaugccaaaagcaaauacuuucagaggacaugauuaguuugcuuuuuaacuugaaaacaauuccaaauucacacuuaaaacaguguaaaccgucggaaaugguggcagcgaagcagugaacccuuaaaggcuguugggguuccccuucuccccauugugagguauucccaaaaggauaaauguugcuuaugaaagaauauuuuauacgugaauaguacaaagacaaagacguuugagaaccgcuacgccggaggaagguggucaagacugaaauuagcguguuaggcaagaucugguuccuaggugcugaggauucuggugccaaggauuaauguuaaccgugcaggcaucucuaccaccguuagaggagaccagcagcccacagacucuuucugucaagggcgggauagaaauguguuagucuuuacagaccacagguggucucuguugcacagucuucuuuguuucuuuguauguuugucuuugcaauccuuucaacguguaaaaacuauucuuaacucacaguccguacaaaagcaggcuaugggccaaauucuggggcuauaguuugcccaccccugaauuagaacccaggacauaguaguugcucagugacuguucaaggaaugaaccucaugagaguaguuaauaacuguaaguaauuuauccuuaucguuaaaauacaaagauugaagaauaagugaacuaagcauucaccuccagauuguaggaaacaaaccaaaagaaaggaaaauagaauuuuuaaaguuuugaacagagauugaugaacuagaaacagcucuuucaaaaccacguuuggguuuaaaacugagcugauucuuugaaaaauuaauagaauagacaaacacuugccaacucuugauacagaagggaaaaaaggagaaaagacauauguguguauacagauauagauguauggcacaggaagggauauaugacucuaaugugcacauuugcagacauuaacucaaggcaacacaaaugagaauagcaauaaucauauaacgauuggaaaauauagccuaguaucucucacuaaauaaagcacauggcucauauggcuuuuucauuuacucucauuaaauacuggauuccuacauuaaauaagcuauucuagagcaauagucuucauggaaaaaaauggaagcuuucccacuuuauuuucaaguuuaauauaacccucaugccaaaaccugguaaguagagcuacugaaaaagcuaaacccauuucauucaugaauauagauauagaaauuauaaaugaaauguuggcaaauuggauccagcuaaguuuuaaauaacuaacacacuaugacugacgaaaguuuucccagaaauggagcacaguagugcucuugcacuggucugugagagccaauuguaaguaagcaucucuucccaucccuggggccaggcaugaugggaguaguauuuaugucagggaaaucugccaaugcuauaaaucaaggccuuuacuucuuaaccucuucucacuuugcuccccuguggguuguuaauuucuugucagcacacuauugaauguuaaguauaauuugacaacacaaaagagaaaugugaccaugucaaagaugcuggaaaagcauuugauaaaauucaguugccauugcaaauaaaauagggauaggagaaaacuuuuuaaacaucauaaaaaguauuugaaacuaacagugaacauuauauuaaacagugaaacacagguuacauucucauuaaagucaagagcaagacaggcuuauuuguuauguguuuaccagauccugucagcauaaugucaucaguguaauggacaggcauugugcuugugggauguaaagauguuugaggucccuugagucuauauuaugauagaaaacaagagagcuaacauugcccugaugcaugggcaguaaacuuaauacucuuguuccuacuugguaaauucaaauguauucugauuuuacuaauguauggaaaugaagaaaaaacauucucuaggucaauacuuccauaucaggugccuggggcuguguaaauuugcuucaacagagauaugauaucuggaauugcaauuguuuuuuggcaucaccaccugauuaaauuugugaucugcugucauuuucugugacucgccuggcuuucguaguguccaaacagggucucuaaggagaauagucacugguuugugaggcaccuaucucaguuauagccacugaaaggcuuuuacacaaaagagggaugacugcuucagagacuggggagugguugccuccucaggcaaaggagguucaggggaauuuggagguuugcaauucucagccucauccaugucugccuaaaugccuccaucucaggccucagaguuucacuccuucccaccgguacucuuaccacagcauaauagaucugguggaguuaagcauuuaauugucacugcagcucugcaacuuaugcucagccccuaagucguaucugccuacaaccacaggauacggaguauuccucaaaagcucuaugcaugcauccugauuuuccauguauguucaucaguguucuuauuuuguauauauucauaacauuucauuucuuuuuccauguguaugcccucuagggcuguaagaagacagaccacucuacaaucagguaaugcuacguuuguugccacagugacuaaaugccacugucauuuaaucuccccagugucuuacuugccaucugcaacucaucccauaguaucacuggugauaaucugagaaacuauaauacuaacacaugucauggauucccuaacugcucauuuucuuccuuggcaaauauguuaucucuguguuucuugaauauauuagcaacauaaccuuagaauugcauuuugaaaaucuguuuccugggguuucuucuagcaccaauuacuguaugaaacaagggauccagcaaggaacagaaaacauggaaauuaggauaauuuguggaagguuuaauaaagauacuaguuaggagggugggaacagaguauuaccauccuguaaacccaaaauaaaauucuaauccccccuccuuucggcaaagggccuuccaaaguuaaccugaaaaacguucaggccaugaugggaaaguggggaucaaauaugccuuauuauacccgccucccuuuuggaauucagaaaaaucugaccagcauuaacaucaacacagaccuucagacugauagaacagacucuuuaagucugauaagaaacauuuacaaucuauucucucugaagccugcuaccuggaggcuucaucugcaugacagaaccuuggucuucacaaccccuuaucuuaaccccgauguuccucucuauugauucuaagucuuuacacaauaacuuaacucuuucaaccaauugccaaucagaaaaucuuugaaucuaccuacgaccuggaagccccgccucgcuuccaguuguccugccuuuccaaacucaaugaauguacaucuuccaucuauugauuucggucuuaugucucccuaaaaugcguaaaaccaaguuguagccagaccaccuugagcacauguucucaggaucuccugagggcugugucacaggccauuggucucucauauuuggcucauaauaaaucucuucaaguauuuuacaggguuuaacuuuuuguuuguugacaaucccuaaaccugaaaggaucagaagagagaaacauccugaaagagagaauuggauagauuauuguaguggcuuuaaaaaaugaccaccaauuauuuaacauuucucccauuaaaaauuagggucuaugucucuuccccuugaaucuggguggauaugcgauuugcuuauaaccaauagaauguauugaaagugaggacuaaacucugauuuuuuuuuaucuugcccaaauuccuaucuaaggggucuggggagucaugcccuacaaaucauaaauucucaucagauggguuuuauuuaaccuuauaugucaugauuuacuuuccaaccuuacucuggcauaacauuaugagacaaggaagaaaaucaaaauauuuuaccccaaaacauguuuuuuugccauauuuugaaauggcccugcaaagcuguucuuuguggagggaaauuugcaacuguaaagaaucucuauuaacauagcuagaucuuuuucucccagccccucccaauccuaaagagauuaacuaagaucugaauacaaaacauuugucaucuauugucucuaaggggagccacuauaagacuucaaaagaacuuuggucuccacaauguuuaucuuaaccugaacauucccuuucuaucaaucccaggucuucagacaaacucaaccaauugucaaccagaaaauguuuaaauucaccuauagcccggaagcccccagguugaguugucccgccuuucuggaccaaaucaguguauuucuuaaauguauuugauugaugucucaagccucucuaaaauguauaaaaccaagcugugcccugaccaucuugggcacauguucucaggaccuccugagggcugugucaugggccauacucacucauauuuggcucagaauaaaucucuucaaauauuuuauagaguucaacacuuuuugucaacaaaagugaugcuacauaacuuagaagacucggucagaaaagguuauguagucuucaccuuguuaacuguaacacucacacuuggaggcccuaaaaugacguguaagaaguccaacuacaggccgggugccuguaaucccagcacuuugggaggcugaggugggcggaucaccugaggucaggaguucaagaccagccuggucaacauggcaaaacccugucucuacuaaaaauacaaaaauuagcugggugugguggcaugagcccguagucccagcuacucagcaggcugaggcaggagaaucacuugagcccgggaggcagagguugcagugagccgagaucacaccagugcacuccagccugggcaacagagugagacucuguccuccccccaccuuccuacccccccucaaaaagaaguccaacuaccuugaaacaugcuguaaggaaggccaggccucagggauaauccauguaaaguuacaucagucaacaaccccagauucuguccuagcugacagucaguaccaaccaccagaaaagcaagagaaggaacuuccagaugauuccagcacccagcuguuaaauaauccuaacugaggcuccagaaaccacccauccccacugugucccagucuugaucuacagaaucugugagcaaaacauaaugguuauuguuaugacagcaaguuuugaaguggcuugguacacagcaauaguagcuaguacagguagaaaaagccacucugagggaaacagugaccuuaaguggggagauacagugaacuccucugcaaggagaaagucagaagaauaaauaugccaaucuuuugccagugcucccuguuggugaaauccaaccaaaagcuggaggacaagguaaccuguugauguauucuauacaagcucaccucacagaacaagaagcaggguagagaagcaggaaaauggaucuaaaggggcaaacaaaaguuaucuugcuuggggucauuugaagacuuugaacuuuauucuaaagacaaugggaagacauugaaaaguuuuaggcaggcgacugaugauuauccugaaaaugaugugcagcuuuuaucggagaacagauuagaaacgggggaagacuaguuaggaauguaauacaauagaucaagugugaggugaugggacccugggcuguggcaacagcgguauaaauggaaacagaagaaagagaugugagaggcauugcaaauaaaggauugaccagauuugugggcauaaaaaugagggaagaguagacaauaacgcugagguuuuaagccuuuaagggucuugagcucaccucuagagaauucaucaauucccaaaguuucacccauccuuuuauguggaagucaugaaucuucaucuccauccaugguuuugcccccuaaacuugucuuucaccuacugccugcuggacauuucaaccugauuguccuacuauaaccucaaaccuaggauauccauaagcaagcucacaaucaucaauccacacaguccugaaucacauauuucuaucaauacagcaucucuucauuucuaucaucuaugagccuugacacuacuacauuuuugcugauauguccguaauaacucuauugcucauaagugaaaaauuauuuuuuggaauuaaguuuguggaagcuaagaguguuuguccaauaucugaaaucugccaaaauucuuuaaaguauucaggcauucccuuuaaaugacuaauuacauaccauuaagguuccaguggaauuuccucgauaagucugccacuucuucccaucaagacuauacaugaugauaaacugagagauguagaggcuggagaacuucugacgggcacccugggucuugaugccgugaauaaucauuggugccaacagauccaccuaccaauuaaaauaacacuuuauuuuaaccuauuuuuaaauguaugugcuaccuccugaaacuaauuauuagcuuaggaagaaucuacauugcuacagguguguccaucauuaccuuaggugugcaagugaagcagucaccaauguugaaaugugcaugugugugugaagcugugggauacacaguagaaaugaauggaaagaugcuuauugaguucccagccugcuucuugacaaaccaaaccacuaccaaaucauugagcccccauuucguacacacacacacacacacacacacacacacauacacacaaacacacacacaccuuuuguggacucacauaagcuaauggacccacauaagcuaaugcuuugcccacaccucagccucagaccaaagccaauuuccuccccucuccugaaaccagacccaccccaacaucacugucagugaugaacugcuacaccuccuucaaguguuaguucagaaacuauuuuuccugguuagccuucucugacucacccagacaaauuuagugcugcuucuucuaugcuucuacuucacuuuguauauaacuucauuauagcaaauuauugcaccauauuauaagguugcuuugcuuuucugcuuuccuuauuagacugagauccuuaaggcagugaacccauuugagucaccuaacuuucugugucucaacuuaucuguaaagugaagauaauauuaguuuuuaucucaaagggcugccauagggguuaaagaguuaauacauguaaugugcugaguucagggccuggcgcauacuaaacacucaaucaauguuagcuuuuauauucucucuagccccagcaccuaauaugguaucugguauaauacugcuguauagcaaaugcuuuggaaugaaugagugaauaaugggaaaguaguacagaauggacacuucuuaaagaagaggucaugggcugcaagaacauuagaaguaucaguuacuguccuaauaagcaagucaaauuuagcacguuuucacacaugccugacacacacaauuggacuggucaucacucuuaugcuuaauaacugucuccuucagcugacuguaaguuccauucauacacucauucaaagaauauuuuuuagcacuugcuaugugccaagcacuguuuuagauacagggaauagaguaguaaacaagaaagaaagcccugcccucauggaacuuacaguugaguaggagaaauagaccuuauaucauauauguuuuuauuuguuuauagcaucaaguagugauaagcgcaggagaaaaaugaagcaggguaacaggacagagugucaaggucuucagaaguugcagcccugucuuuucccagauagaugguauucccaaucaaagacacuucauuuuaaccucuugguauuguggcauaaaaaagugaaagcaccaggcacaaaaaucaugauuucuacugaauugacuuuuacuguuucuucauauagauagaguauaagaguucuuucuuggaccagugauuauuguauuuuccagcagccuugcuagaauaaagcugcaauagaaccaggcuacaauaaagccuuggcagccuaccuacauucugcaacugacaaaugcuugacaacugaugaaugcuugacaaacugccaggcuuauccacuucaucuucuugugccucuucuacauuauaauuggcaccugggagcaguuugacaauuacagacucaacagcuucaccuaugugcccagccagguguuucaguguaacuacaagacacaucucucuacuaggaaguaagcaaggugguaaugaguuucacuguauaaaaguacaaacacugcagcugcguaucuccauggggccugcugacuucccccugugcauugccuggucuuggucaccuggugcuccucaagccagcccagugcucuugugucuuggggccaggcuguugugcacucuucaggccuucucacgagaauagaugccuucuccaacucccuuccuugucagcacccccuuucaacuccaucuccaugguuuauuuuauaaaguuacgagaucuauaaaaagucuagcuggaccuuaguaggacagauggcaaaaccaccuugaagauaaggcgauucaauagugguagaugauaacauaacuagguggauuuguaacugguuuaauuaccacaagugaacagugacaguuaauagaugguuaucaacuuaaagggagcauuccggaaacaguguaguacaacgauuaccaguuaggguucuggagcccaacuaucagaauuugaauuuuggcucagucacuuauuagccaugugacuugggccacaauaaccucucuaugcuucaauuucauuaucugaaaugaagaugauaguaacaucuaccucacaagguuguaguaaggacuuaacagcuugauuuguauugugcacauacuaaggaagucuugucuacuucaauauuuugaucaugacuuugcugcaguauuagaaaguuuacugaucaaaucaguaacuggaaaaacuaggaaauacuuugggacacugaagaucggcaagcugaaacaaugggccaaaucuaguaaguggaaacaacagaguauaucauucaggguucauuggcuaggcacagacaggacacucuauuuacuagucuuaucagguuguaucuagugaggaagauauaauuccgcccucccaaauaagaauguuauuacaaaaaauuaaauagcacagacagacacaggguggccaaauagauaaacauguucucuauauagggauacacuuaagguugaaaauaaccauagaaauacaaggugaagaacauaacauguuguuuggcagaagcacaaaccaacaaaaaauacuuagggauuagugaacagcagcucagauugagucaaaauuggcagugucuacaaaacaaugcuguggcauuaauagacaugcuauuugcaaagauggaaaccaaaauguuuucuccauuuccuguuugggcuucuagaaggcaucuagccuuauguuuagguggagaggcugagcaggcacuuccaagcugcccucagcuuuugugaggcauggaagagacccaagaguuuccaucugucugucuuugaaggggccucauugaucauauguugaaaugauaguauuuucagauauguugaguuaaauaaaauguauuauuaaagugaauuucacauuuuugaaaacguggcuacagaaaauguaaaaguacacaugugguuugcauuugugaaccauuuguuuuauguuaaaauaaaggggauuggaguacuuaaggacacgugggcaguuggaagcaucuaauaauaacauauacugucuugagagaugacgaguucaauauuauagaaaauauucagauguucuaaucccaguagaaggacuaaaauacagaaacaggacauaucaauauacucaauucuauccccauaucucuuuguucaugacugcuuuuguacaaaucauuaaggcauucuguucuuuaguuuucucauauucauagaauccuuugagcuugcaagaggaauaaguaaugcaauugauugaaugugauacauuucccaucauugauuacauuuucuaaccuugauccaagaaaagggcuccuuggugcuccaggcauugauugauccggaauaaugaagucuggccagcuuuggggcccacuguccuuugcccaaguaaagaaacagagauuaaauucagcuggguuaguccuagacacuugagaauaaaauuauugucuugagaaagguuaaucuaagcuguggugaaaauagagaaaaacauaaaggcuuuauggcauaccaguaucaauuacuaucuaaggauauugcuuauccuuguuguccauuuuauuuucuaaaauuuauaauuuuguuaauuguuagcaccucuaacuagcugauacugcaauuuguuaccaacacuaccaaauaauaauauuauuucuucuuuucuuucuuuuuuugagauggagucuugcuuugucacccaggcuggagugcaauggcaugaucuuggcucacugcaaccuccaccuccugaguucaagcaauucuccugccucagucuccuagguagcugggacuacaaucgcguaccaccaugcccgacuaauuuuuguauuuuuaguagagacggaguuucaccauguuggccaggcuggucuugaacuccugaccucaggugaucugcuugccucagccuugcaaagugcugggaggcaugagccaacgugccccgccuauuauuuauuacgcaauguauguucauuguagaaaaaucagaaaaugaaaaguaaaaauuaguaaaaauacaaauaaaagacauuuuaaaauguaacccuuccaccuagugaaaaauguuacuauuuugguguaaaacucucacgccuccuuuucaagaggauuuuuuuuuaccucacaacaacauagguuggcaaacuuuuucuguaaagggccagauaguaaaucauuuaggcuuugcauauuauauggucucuguugcaacuauguuacugcugcuguagccauagaugauauguaaauuaauggacguggcuguguuccaaaauaaggcuuuauuacggaugcugaaauuugaauuuuauaauuucacaugucaugaaauagucuucaucuuuuugacaauuauuuaaaaauggaaaaucuguucauagcucacaugccauacaaaaacaggcagugugcugcauuuagccugugggcaguagugcucuaaaacaauuucugagaauucucuauagacccuagucaaacuuuaccauuacugcucauaggaaaguauagcuuccugcugcacugaaaagaauugacucaaggaagaaauacugaagguagggaggauauuuaaggaggcagugucauugcccagguaagaaaugauggugaccugaguuaagauggccacagugggaaguggagaggaggagauguauuugagaggcacuuauggaauagaacuaauagaagcauggagauggauucauuaucugagauucuccaccagauuauuaaaaaaagauauaaucagcccagguucuuggagcaaaaauaauaguauuuaccauauuguccugaagcuguaaucugaaaaucucuaauguguccagaagccauucccaggggagucugacacucugaaaugaaacggguggaacacaguaacuagaagugcacaaaauucagcuucucaaauguaagucaaugaaaaugggagaacgucaacaaaugcuauuuuuuaguguuuaaaugugccaagaacuguacucaacguuuuacuguauuaguucauuuaauuaauccuaacaggugcuagaaugauucacauuuuacagcugaagaaacugggguccguacauaaauagaccaguggcucucuuacuuguuuaggguuaaaucuccaaacucuuccaaguaguauuucuaaguuaucugguaacuaaaucaacauuaaauuccaaaaucugcuacuggagaucuucgagcuuuaccaaguugugaaaaugaggugguauuuuuuuuuugucaauuauuuagagcuucagguacaaaguguucaaagcuucaaguauaucugcccuacucugagaacucugaugauuucuaccagcaauauucauuuuaaauuugauaaugauguaaacuuguauuuauuuccugacacaagcaaccauuccagaaaggaagaaagcuguaaagaaguaggcugaguagguagggaaccucugcccacauugcuacucacuauugcuguacaccagaaaaagugugcucaucccagcauguagaugcucgccaauaaggcauuccacccgccaaauuccagcuuuggaugguaacauuuccacugucucaaaaacaccuuauaaaaaccaacaggaacagaaauuauuucuuuucacuaaaaaaugagcaugagauacauugguuuaugcgaaauaucagaguagaccuaccaaauuugguaguuccacuacuuuuggaccccucaaaugcaaagugcuugcuacgugacccuuacaguuggggguuguggagauugaguucugaccacuccccuccccccaggagaugagaaacagggugacugaauucuuugaugguugggacaggagaaugcuacugcauuaugauugaccuacauucccagggucuuucugagcaaaagguguguuucccauuggccagauguggacucugugaaacagauaagucagggugaguucccucuggauccaguccacuagagcugccuacaaggguaaaguuaccccagcaacaagaagcugcaggugaacacugagggcugagaaaugagucacaagugaccacccagaguaaagguggaagaaaucaugucaaggggauuucaugacagucacguaagggagucucuaaagaguucccugaaagugcccugcaggagaaagagucaacaaguauugccaggcacaaacaguguuaagcuaguuuacaacaauggugccagcuguaaauagguaagaacuaucuuauccccuuaccuuuaaccuauccauguuggaguucaaaacagcagcuauaaagggguuguggggaagcacgaucaucacaagguacagaaacagaggacucaaccaugucucccuuuuccaaugcagacuuccagccugaugcaggcucaaguuggaggaggggagauugaaguuaaaucaaguuuacaauuuugauuaauaucuugggauggacauuguaauuucugauuugaacuguauuugugacauaaagugacuuuaguccuguuuauuacuuaagggugagcagaaaaguuacagggcuuaucagaauuuuuacgaagaaauaaggaaaguuuacccccgcuauuaaacuggaugguuuuuuuuuuuuagagacagggucuugcucuguuguccaaguuugagugcaguggcacuuucauagcucacugcagcaucaaccuccugggcucaagcaauccuuccacuucagccacccaaguaggugaaguagcugggacuacagguauauaccacaugucuggcuaauuauuuuuuguagagaugggggucuugcuuugucacccaggcuggucuugaacuccuggccucaagcaauccuccaaccuuggccucccaaagugcugggauuacaagugugagccaucgcaccuggccaaaucuauuuuaaagggacagugaagaaccaaaauaaaauuguguugugaucaacauuaugaguagugcuuaaucaauauacugguuacauacauaaacaaaugacucuuuggaugacuacuggugcccuaugggauuugagaugguaaaugauaaaggaauaaauuccuuuucccuaggaaaguacugugacauuaauuauccauuuauucuguucuauuuccuuuuuagcaauuuuucuauaucugaaauuaucuuguucauuugcuuugaacaaaugguuuaaaaagcauuugaaaaaguauuacuuaagagcauggagcuugucugcuuugaucacugauuguguucccagugccuagaccauuuaaaguaaguacucaacaaauagaguagguagaagaaagagcacaaacaagcucauaccuggauagagauuguacagugccauuuuauacuccucuuuuuuucguacagugaacacauguccacugaaaugaauagaauggauguuuucauugcugcccaugcugagcagauaccaucgaauccuuugauccugagccauuacuaagccagguaguguauccauuauguagccauugauugcuggagaaggacacagagaagccuguuaaaaucuauuauauaaguuucuuucucuccacuccaccaaaaaaacugacaucuaugaggauuccacucccacagauauacucuaaauaaauacaauguucaagucccuggaucaagucucauuugucaaagugcaaucugcauuucacagugauaauguuuggauguggaauauauuaccauggaagcgauaauucucuuuaaaagugggaucuuccaucuggauauugcagggagcccugcaguuucuuuccauauuuucagugaaguaccagcuuuuggucucaucaaagauggugaaaaacagagcaaauuccuguacugucacuugucucccaugagcaggguucaguguguuaguguggcagaccagaagggguccaaucaggccugagugcacaucuuuuuccuagggagggaagacaucaauccuaugaguauaagcucucucaccuaugaaccagaguggauuucucaucaauuuuuaugccaguccaaccugccucccaccuuccaaaaauauaauccauccucuucaguagauuccagaaugacauuucuaaaacacaaauauaaugaucaacucuccuauuuaaagcuucuuauugcacguaggauaaauaucaaaauucuuaguacacaaagaccauuucuuuuaaaccaaaaaguggucagcacaauagacaccugcuuaccaggucaacaucagagaaauaagcccaggcuuugcagucaaacucaucuuuagugggugccauaugauguugcacuuuccaaaaguaaguuuugguuucauuaggcuugacaaaguuuuuucuagguucugcuccuugccucugaucuuccucauaagaaauaaggcuagaauagaaggaauagggacgagaggccugauuucugaaaguuaccuguagaacaauaacgacaaaaaaaaaaaagcaagaauaaucuucuaggaucuuaagguccuuaggguuuacaucccuaaaagaaauaccugucuuuuggucuuuaucaaaguuuuuaauacccuggaagaagugguacagaagauggaugcuguuagaacucaaaccuaauccugaggagguuuuguauucuaaauuuaagguaugaacucaaaguugcaaaggagaaaauuccuaaacacauaaaagccauuccagaguaaaagggaaaauguuacugcagggguuauaagagaccauaacgccaggaguugauauguaaguuaagguucuucaugacaaauucuagaaugaaugcauauuaucuuuuaaaaaaggcuuacuuuccagauuaaaaauuauacauauuuaucauagaauauaauggaaaguaaaauaaaauguaaggcaaaaauugcccacaauuccauaauuuuagauccuucuacauccuuaauauacaccaucaauuaauugaaacaacgaauagauauuuucagaaaaaaauaaaacuacuuugaucuuugguucacacaaugcaccaaaauaacuuuuagucuacaggaaguauuaaaaaguuaaauguaaaaaauuaaacuguaagagaaaaacugaggaaaguauagguguuuuuuaaaaaaucucuggauaggcaggaauuuuuauaaacauaaaagcaaugaaagugucaaaaaguaaagauugauggguuacuaccuaaaaauuaaaaccuguuuuauuucaaaaaccaucauuuauaaaauuaagagaaaacaaaaacuugaaaaaguaccucucauuaaaauguucagugguuuacuaucuaauauauaagguaacauaaucaauaagaaaagcacuuccuccaugaaagacaaaugugcaagggacauuaccaaauaauuaauaagaaaaacucuuaagaugcucaaauacauugcacuucuggaauuuuaucuuagaaaaacuguugugauuacagcguuauuuauauagugaaaaaagaaacugucuaaaagcuuguucaaaauaaaugguuacauaaacuaugguuccauaaauucauauaauagacuauuaugcaguauuuuaaaaacauacauaggaaguguuuuuaaugacguaagaaauguuuaugaugugauauuuaguaaaaaaacaagaaucagaauucugcaugguauaauuugaauacauaaggagaaaaauacauaggaaaaauagaacguacacaaagauaauuauggaauuauuuuucuauacuuuaaaaauuuccaaaagugggaauacauuauagucagcaagaaaauaaauauauaaaauuaauuuucuuguaauuccacuguccuuaacucaccaugauauuaucuucaacuucugcucuuauauauggccccaggagucccaaauguucauuuaguucuccacgguauaagggcugaguaaaggagccaucaguaaauuccuggaaaacaacuuucuugaacugagggacacugccacucugagcccuggagaaaaaaagcagaggaaaagcaauaauuuuauguaccaaguggguagaaaugccucacauccucauuuuccuaggugccugagaagcauuuugcauaguuaaccacuucaucuuccuugaaauacucuugccaagcuuuauuagcauguaaguuccaugaaagcugggguuuugucuguuuuguucccuguuguauucccagcaccuguaacggugcuuggcacaaaguaggugcucaaaaaauauuugucgaauguugaaugaauguaaaguuuauaaacauacuccaaauauaagagagucccauggucaagcccuuggaucucuuuucuuuuuacuuuuuaaagcccuauuaaaauugugaacuaaaaaaauugugaacuaaaacauauacaauaaagugcauaaaacacaaaugccuuugguacauaaaugcaaucaucacccagaucaguaacauugccaacaacccacaagacucacuggaugucccuuuucaaucauacuuucucccuucccacugaagguaaccaccauucugaucuuuaugauaaucauuucuuugcuuuucuuuauaauuuuaccaguuacguauacauccuuuaaaaauauaguuuaguuuugccuguuuugaaguguguaaauaaaacauacuacauauauucuuuuguuucuucuuucacuuagcauucugguugugagauucaucuauauuaucauauguagcuauaguuuguucauucccauuguuguauaguauuauaugaauauacccuaaucacggacauuugaguuguuauaaucuuuggcacuuucauauggaccugcuauaaccuucuggugcauaucuuuuggugaacauauaugugcauuucuguugggcggaauuacuagguaugcauguguuuggcuuugguagguauugccacacuguuuuccaaagcagcuggaccauuuuccauuuucauuagcaauguaugagaguuccauuugcuccaaauuauuacaaauaucugguauugacuguguuuuuacauuuuuggauguucuaugagguugagcaucuuuucuuaugaguagcagucauuuggauguccucuuuuguggagcaccuauccaagcuuuuuucugccaaguuuucucuuggauaaucugcuuuuuucuuguugaaucaaaagaguacccuauauauccuugauaugcuuuuuuauauauuccuugauugcuggagaagaaggacacagagaagccuguuaaaaucuauuauauaaguuuccuuuguguguccuuuguguuauguauugcaaacauuuaccauuccguggcuaaucuuuucauuguuuuuauguuaucuuuugaugagcauaaguuuguaauuuuaauguguggaauuuauaaaaaaaaaccuuauuggcuagggcuuuuuguaucuugaugucaauucucuuucuuucccuacccugugguuauugauauauucuuuuacauuuucuuucuaaaauguuuaugauuuuauauuucacuuuuagacuuguaaugcaaugugaauggauuuuuguguauggugugaguuaggaauccaauguaauguuuuaucuauauagauaccaacauuuuccagcauuuuauugaaacucuacuucugugacaccuuugucauaaaucaaguuucuauauguguuagacuaguuuuggauuuucuauucuauuucauuuaccuguuugauuaucccuauaccaacugcuacauuguuuuaauuauuauagcuuuaaaauaagucucaauauauuagacagcaauuacucucaucuuauucuuccucuucaagaaggacuuggcuauucauaaaccuuuacauuuucauauuaauuuuagaaucagcuuguugagcucuacaaaaggaacgucuugggauuuucauucagguugcacugaaucuauaaaucaguuugggaauaaccgacauuuucaaauaucauguuuuccaauucauguacgugguauaucuugaaaguuauuuagguacucuuuaaaguuucucaguaaauuuccauaguuuuuuuuuccauagacauuuugcaaauuuuuagcuagacuuauuucuagguacuuguuaguauucuauuccacuauuuauuuuguuuuuacuuccucauugugucucaccaagcugacacacucaaacuuaacuuucccccuggucaggacucuccuagaaaguggcucucuuggcuuaugaccauucucaagggagagaccucaagacuaaauuagaaagaaaccauagcaauaaaaaucacaaugggggucaucuuccagcuucuaaccagaaggaaaucaaccaccuucagcucagcaaaccugcaagcaaugugagcugugugacaauccaacagagguggagagccagcacugauuugggcuggaugguucaggaagccagcugcuuccguuggcgagucauuuucgcugucacaagccauauugccaugauaaacaucuuugacagacacauucuugacacugaagcccacauuguccccaagaagagcuucauuuaaagcuucauggugcaauucaaaagacuuuauuucaguuguaauguuaacuggagcaaagcugaccaaucaugcuggguuugagggcaccagucaccacuaggcccacaaagacauuaccaauacuaccaauuuuguagacuuccuggagagguaggcacaagccuugucaguuggaugagcuggugguaugauauaauccagagcuucaagcggugugcuacacugguauugccaucucugcaggugacucuccacccuuuaaccaaggcauguuagcaaguugucagcauuccaaccagaaauuggcauaaauacuacuguguugcgguuguagccaguauucuuaauguagggcugacuuccuuauugauuuccacauagcucuguuggcgauggcauaguucagugaaauccauuuuuuaacaccaacaauuaguuguuucacuuccaguguguaaaccagaagggcaugcucaugggucugcccguucuuaaagauacuagcuucaaauuuguuaacaccacuagcaauaaucaggacaguacagucaaccugagaggugccuaucaugauguauuuuuaaauugauacacgauaauuguacauguuuuggggauacaugugauauuuugauacaugaauacaauguguaauaaucaaaugaugguaauuggaauaucaaucacuucaaccauuugucauuuauuuguguugggaacauucccagucuucucuucuagcuauuuugaaacauacaauaaaucauuguuaacuauagucacccuacuguaauaucgaacacuacaacuuaucccuucuauuuaaguguaauuuuacuguggggaaaagaaagagagaucagacuguuacugugucuauguagaaagaaguagacauaagagacuccauuuuggucuguacuaagaaaaauucuucugccuugagaugcuguuaaucuguaacccuagccccaacccugugcucgcagagacaugugcgguguugagucaagguuuaauggauuuagggcuaugcaggaugugcuuuguuaaaaaagugcuugaaggcaguaugcuuguccauggaauacuaugcagccauaaaaaaggaugaguucauguccuuugcagggacauggaugaaucuggaaaccaucauucucagcaaacuaucacaaggacaaaaaaccaaacaccgcauguucuuagucauaggugggaauugaacaaugagaacacuuggacacaggagggggaacaucacacaccggggccugucaugggguggggggagggauagcauugggagauauaccuaauguaaaugacgaguuagugggugcagcacaccaacauggugcauguauacacguguaacaaaccugcacguugugcacauguacccuagaacuuaaaguauaauaauaauaauaaaaaaagucaucaccauucucuaaucucaaguacccagggacacaauacacugcggaaggccgcagggaccucugcccuggaaagccagguauuguccaagguuucuccccaugugauagccugagauauggccucgugggaagggaaagaccugaccgucccccagcccgacacccguaaagggucugugcugaggaggauuagugaaagaggaaguccucuuugcaguugagauaagaggaaggcaucugucuccugcucgucccugggcaauggagugucucgguguaaaacccgauuguauguucuauuuacugagaaaagagaaaaccgccuuaaggcuggaggugagacaggcuaguggcaauacugcucuuuaaugcaccaagauguuuguauacgugcacaucagggcacagcacauuuccuuaaacuuauuuaugacacagagaccuuuguucacauguuuuccugcugacccucucuccacuauuacccuauuguucugccacaucccccucuccgagaugguagagauaaugaucaauaaauacugagggaacugagagaccagugccggcgcggguccuccguaugcugagcgccgguccccugggcccacuuuucuuuccugugcuuugucucugugucuuauuucuuuucucagucucucgucccaccugacgagaaacacccacaguguuucucgucacugugggugacgaggggcaggccaccccuucauuuuacaccuauuaaucaaccucucuucauuccaucccacccccccauaccauucccaaacuccuuuaagcaccauucuacucucuaucuccgugagauccacuuuuuaagcucucacauguaagugaaaacgugauauuugucuuucuaugccuggcuuauuucacuuaacacagugacauccaggcucaucgauguugccacaaaugacaggauuucauucuuuuuaauggcugaguaauagucuauuguguauauauaccacacagucuuuauccauucaucuguugauguauacuuagguugauuuuauauccuagcuauugugaauggugcuguaauaaauguuggugugcaacuaucucuuugauacacugauuuccugucuuuggauauauauccagcagugggauugcuggaucacauggucguucuauuuuuaguuucuugaggaacauacauacucuuuuccauaguaucuguacuaauucacacucccaccaauaguguacaagcauuccccuuuugccacauccucaucagcauucauuauuuuuugucuuuuugauaaaagucauuuaacuggagugaaauauccauugugcuuuugguuugcauuuaucugguaauuagugauguugagcaguuuuucauauaccuguuggccauuuguauguuuucuuuugagaaauguuuauucagaucuuuguucauuuuuaauaggauccuuugcuuuuuugccauugacuuguuugaguuccuuauauauucugguuauuaauacccucucaguuguauaguuugcaaauauuucaucccauccuguagguugucccuucacuuuguuaauugauuccuuuguugugcggaagcuuuauagcuugauauaaucccguuugucuacuuuugcuuuaguugucugugcuuuugauauuucccaggccauaaaauauuucccagaccaauguccuggagcauuuccccaauguuuucuuccaguagcuucauacuuucagguuguauauuuaagucucuaauccauuuugauuuaauuuuuguauacagugagagauagggguuuaguuuaauucuucugcauguggauauccaguuuucccaacaucauuuauugaagagacuauucuuucaccaaugcauauucuuggcacuuugucaaaaaugaguuggcucuaaauguguggauucauuucuggguucucuguuguguuccacuggcauauguuucugucuuuaugccaguaccaugcuguuuugguuacuacagcuuuguaguauaguuugaaauaaaguagcaucaugccuccagcuuuguucucuuugcucaggacugcuuuggauauuuagggucuguauuagucuguuuuccugcugguauaaagaacugccugagacugcauaauuuauaaaggaaagagguuuaauugacuuacaguuccacauggcuggagaggccucaggaaacuuacaaucaugguggaaggugaaggggaagcaaggcaccuuuuucacaagguggcaggagggagaggugacagaaggggaaaugccagaugcuuauaaaaccaucagaucucaugaaaacuuacucacugucaugagaacagcaugggggaaccugcccccaugauccaaucacuuccuacugggucccucccaugacacauggggauuauuuugccuuacaugaaauguaaggcaaaaauugcccuugcccacaauuccauaauuuuagauccuccuagauccuuaauauaaacaaucaauuaauugaaaaaaugaauagauguuuucagaaaaaaauaaaacuacuuugaucuuugguucacacaaugcaccaaaauaacuuuuagucuacaggaaguauuaaaaaguuaaauguaaaaaauuaaauuguaagagaaaauugaagaaaguauuguuuuuuuuuaaaaaaucucuggauaggcaggaauuuuuacaaacaauauacuacaauucaagaugagauuuggguggggacacagagccaaaccauauguuuccacccauggccccucccaaaucucauguccucacauuuaaaaacagaaucaugccuuuccaacagucccccaaaguguuagcucauuccagccuuaacccaaaaguccaaguccaaagucucaucugagacaaggaaaaucccuucuguuuaugagccuguaaaaucaaaagcaaguuaguuccuuccuagauacaauagggguacaggcauuggguaaauacacucauuccaaaugggagaaauuggccaaaacaaaggggcuacaggccccaugcaagucugaaauccaauagggcagucauuaaaccugaaaguuccaaaauguucuccuuugacuccgugucucacauuuaggucacccugauacaaaaggcaggcucccacagccuugggaagcuccacccccauagcuuugcaggguacagcccugcuccuggcugcuuucaugggcuggcauugagugccuguggcuuuuccaggcccacggugcaagcucucaguggaucuaccauucuggggucuggaggacaguggcccucuucucacagcuccacuaggcagugccccaguggugacugugugggggcucccaccccacauuucuuuuccucacugcccuagcagagguucuccacgagggcucugccucugcagcacaccuccgccuggacauccaggcauuuccauacauccucugaaaucuagguggacauucccaaaccucaauuuuugucuucugugcacccacagaacaaaggcugggggcuugcacccucugaagcuauagcccaagcuguacuuuggccucuuauagcuggaguggcugggacacagggcaccaagucccaggcugaacacugcaggggagcccuggacccaggccacgaaagcauuuuucccuccuaggccuccaggccugugaugggaggggcugcugcgaaggucucuaacaugcccuggacacauuuuccccauuaucuuggugauuaacauuuggcuccuuguuaauuauauaaauuucuguagcuggguugaauuucuccccagaaaauggguuugucuuuucuacugcaucaucaggcugcaaacuuuucaaacuuuuaugcucugucacucuggaaugcuuuguugcuuagaaauuucuucugccagauaccccaaaucaucucucucaaguucaaaguuccacagaucucuagggcaggggcaaaaugcugccaaucucuuugcuaaagcauagcaagagccaccuuuauuccuauuccuaacaaguucgucaucuccaucugauaccaccucagucugaacuucauuguccauaucacuaucagcauuuuggugaaagcuauucaaugauucucuaggaaguuccaaacuuucccagauuuuccugucuucuucugagcccuccaggucucuaggaaguuccaaacauugccacauuuuccugucuucuucugagcccuccaaacuguuccauccucugccuguuacacaguuccaaaguugcuuccacauuuucagguauccuuauagcagugcccccccuaccucgguaccaauuuacuguauuagucuguucucauacugcuauaaagaacugcuggagacuggguaaucuauaaaggaaagagguauaauugacucacaguuccgcauugcuggggaggucucaggaaacuugcaaucaugguggaaggcguaggggaagcaaggcaucuucuucacaagguggcagugggaauaagugccagcaggggaaaugccaaacacuuagaaaaccaucagauuucaugagaacucacucacuaucacgagaacagcaugggggaaaacugcccccaugacccaaucacuucccacugggucccucccacgacauguggggauuaugggaacuacaauucaagaugagauuuggguggggacacagccaaaccauaucugggucuuuugugguucuguacaaauuuuaagacugcuuuuucuauuucugugaaaaauguuauugguauuuugauagguaauacaugaaaucuaguaguauugauauuuuaacaauaugaauucuuccauucuaugaacaugggauagauaccuuuucauuuuuugugugucuucuucaauuccuuucaucaggguuuuacaguugucaguauagagaucuuucaccucuuugguuaaauuuguuccuagauauuuauuuuuauuauagcuauugaaaaugaaaaugcuuuuaugauuucucucucggauuguuagcucuugguauauagaaaugcuacugauuuuuguauguugguuuugcuucuugcaacucuacugaauuuguugaucaguucuaacaguuuuuugguggaguguuuagguuuuucuaaauauaacauuauaucgucuacaaacaaggggaauuugauuucuuuuuuucuaauuugaaggcccuuugcuuaauugcuccaucuuggacuuccaggacugcauuuaauagaauugaugaaagugggcaugcuugucuuguuccagaucuuagaggaaaggcuuucaauuuuuucccauuugguguaauguuagcugugggcuugucauauauaacauuuacuguuuugagguaugcuccuuuaaaccaaauuuguugagaguuuuuaucaugaagggauguugaauuuuauucaaugcuuucuugacauuuauugaaauaaauauaugguuuuugucuuuccuucuguuaaugugguguaucacauuuauugauuuccauauguugaacuaucuuuguguuccuaggaugaaucccccuugggcaugacaaauacucauuuuaauguguuguugaauuuaguuugcuaguacuuuguugaggauuuuugcaucuauauucaucagcgaaguuggccuguaguuuucuuuuugcuguuguugugucuuugucugguuuggguauugggauaaugcuggucuuguagaaugaguuuggaaacauucuuuucucuucaauuuuuugcaauauuaaauaguuucaguauaauugguguaaguuuuucuucagcagugaagucaucagguccuggacuuuuauuuaaugccagacuuuuuacuacugcuucaaucucauuacuaguuauuggucugcucaaguuuucuauuuccucauaguucaaucuugguaaguuguauguguccagaaauuuauccauuucuucuaguuuuuccaguuuguuggcauauaguugaucauaauaguuucuagugaaacuuuguauuuuuguguuaucaguuuuaaugacucuuuucaucuuugauuucaauuauuugggucuucucucauuuuuuuuccuuagucuagcuaaagauuuuaaauuuuaucuuucaaaaagccauuuuaaaaauuucauuggucuuucauauuguuuucuuuuucucaauauuauuuauuucuaugauuauuauuauuauuuuccuucuacuaauuuuggguuugguuugcucuuguuuuucuauguccuugaguuacaucauuaccagguuuauuugagucuuucuuuuuugauguaggcauuuauagcuauaaacuucucucuuaguaccgcuuuuguuguaucccauucauuuugguauguuguuuccauuuucauuuguuucaauaaauuuccuucuuaauuucuucauugacuuauugguuguucaggagcauguuguuuaauuuccauguauuuguauaguuucaaacguuccucuugucauugauuucuaguuuuauucuacuguagucagaaaagauacuuaauauaauuuuauuuuuuuaaauguugagacuuguuuucuggccuaauauauagucuauccuggagaauguuccaugugcugauaagaagaauguauauucuguaguaguuggauaaaauguucuguaaaaugucagguagguucaucugguccagaguauauucccggaugaacuggagcuccuuuauauguuauuugcuucuuuuuucuugcucuuuuuaggauccccucuuugucuuugaccuuugagaguuuaauuauuguaugccuugggguagucuuauuuggguugaaucuguuuggugaucuucagccuuccuauaacuggauacuuacaucucucuguagguuuggaaauauuuucuguuauuucuuugagcuuuuuauucauugcucuuucucucuugaaggcccaugacucuuagauuuguucuacugaggcaguccucuagaucuugcaaguguucuucauuccuuuuaauuauuuuuuguccuuugacuguguauuuucaaauagccugucuuugagcucauugauuguucguuuugcuugaucaguuccgcuguuuagacuuuccagugcauuuuuuuuuuccguucaguuguauuucucagcuccagcauuucugguuuuuuaaauuauuauuuugauuucucuguuaaauuuaucucauaaauuucucaguugcuuuuuuguguucuuugaguuuccucagaacuuuuauuuugaauuauugauuugagagcuacaauuugccaucucauuaggguuggucacuggcuccaugcuguuuccauuuggagaggucauagcucccuauuugcucuuguuuuuuaugcacauauaucuaugucuuuguaugaaugcuaaguuauuuauuccagucuuugugucuggcuuaguuugguuuuucaggaguaugccugucuaaagguuauguaugaauuagagcuuccuuacucugagauuacugccucuuuuuuggcacuagauggugcuguaagcccagauuugcugcagcucuugcaacggcuuggauuacugccuauucccgauuugggggaggucccaaacuggauauccugguugggugagacaucugguuaggauuuuguguccagaggaaccacgggcugaacauucucucucauuuggugucuucuuuggcuuagaugaagagcagccaauguguuuugcaugcugggguugcuagccccgccuccauccuuugucucuagcugcccucaggauuuuuuuacccuagaggcaaucaggcugcuucccacggauugaggcaggaaugauuuuucugcaaaggaacccaagauggugggaaagcuggcucuucaucuagaugucacuuuuucugauguacauacugucagucugggggaacuuuucugcauggugccuggcagcuugggaaggggaugcugcaguuaaacaggcccauuuuuguuaucuucugcuugcaguuuuucucuucuauguggccacucagauccucacagccucuguuuugaguuaugggauauuccuggugauaagcuagacacugaauaguuguuuuugguuuuucuggaggagagugaagccagauugcuucuauccaccauuuuggugauaucacucuaaucauguuuuuuuuuuuuuuuuuuuuuuuaauaaagccccugugugcuggggcaucaaugauggucacaggauauuuuuggccucagguuucuuuaggagauaucaauggugauauuccauucauguucaguuuauaguuauccaagacccaagcauacucaaaugagcccuuucccaucucagcagguucuuucucaaauuuuucaaugguuccuuuguugaucacaucacauuuauagaucagaugaccaguaguguugaacuuuccugagucuacauguccaacguugaugauagugacaugaaccuuuuccuuucccaauuuuggcuuagauuuagcagugauuuucaugauacuuguguuaugacagcaaaccaacugugaauaaagcaauucuauauaucuuaacgcucauaaaacauuugaccauguuuuaugauacuuaucucuauuuauccacauauuuaacuuuguuugcucuuuaucccaucuugucucucaugccuuccauucuguaucacuuuuuuauugucucaaguauaacauuagaauauuuuaguggacuuuugcuaauggugaaguuucucuguuuaugcuugucugaaaauguauuucuuucaccuucauucuucaauaaaauauuuuuuagauuuucauuuuuauuauuauguuagagcaagugaaguagcagcaaaaguguccaucauacaaucuggcuuucccugguccucagggcaaggaggaaacuugggcagcagacaaucacucaauccuggcagacucucagaaucucacuuggacccuaaagugcaucugcuugguggcauuguucuucauuucugucuucagcauccauuuugacuucauccuuuggauauaaugcaugucucacuuucauguaacagcugcuccuguguugccagucuaucccagggcucucuauuacugaagcacucggcccauggccucacaauauuuagcaacuaccacagcucuugacaagccaaaucacuguuuguaguaucucaucaaggagugaugacccacucuggcaucagaaggcagaaucaguuccaugcuuucaucaucauauucuaaguccuuuccuaagggcgacuccucagccucauuaggguccuccccuuccuugugaucuggguagcuacuccuaaacucauacaagucugcaaauuccaaagcagcaucaccaucuguaaaaagcuuacaccagcuuuugucauaugugccuguacagcuucuguugaguagaacuuccccuucucauugcaacacaagcaaaucuucucaacacaaacuuucucucccaaguaauuaaucagucccuuaagaucugaaagauauucuauaucaguaauaaagaagcaguggacuuuggucauacuugugucauuuuguuaauugcuuucuuucuuuuuuuuuuuuuagauccuuugauccuuucuucuucuguugcauucuuccuuuauaguuugauggcuuucuguagugguaugcuuuggaccuuuuuaaaauguuuuguguaucuacuauaggcuuuugcucugugguuacuaugaggcuuacacaaaauuagcaggcuauuuuaaacugauaacaacuuaauuuuuauugcauccacaaacucuacacuuuuauucccuuccuccuacauauuauuauuuuuuuugagacagggucuugcucuguugcccaggcuggaguguaguggugugaucauugcuuacuguagccuugacccccccaggcucaagcaguccucccaccuccaccuccugaguagcugggacuacaggcaugcaccaccaugcuuuacuaauuuuuaaauuuuuuauagagaugagaucucacuauccugcccaaguuagucucaaaugccugggcucaagugauccucccaccuuggcccccacaaaguguugggauuacagccaugagccacugugcccagccuauuuuauguuuuugaugugacaguuuacauauuuuaauaauuugcauuccuuaacacauuauuauagcuuuaguuuuuaaaauagcuuucuuugucuuuuaucuuuuauacuaaagauauaauuaauuuacccacugccauuacacuacuagaguguuuuggauuugacaauguacuuauuuuuacuagugaguuuuauccuuucauauguuuucauauuacuaauaagcauccucuuucuucagcuugaagaacuccuacuagcauuucuuauaaagcagaucuagcuuuugucuuucugagaaaaucuuuaucaccccuucauuucugaaagauaaaauuacuggauauaguauuuuucauugcuaguuuuuauuuccuuucaggauuuuaaaucuauauuuucacucccuucuggucuacaauauuucuucugagaaauccacuaauaaucuuauacaaaggauaugaacagacacuucucaaaagaagacauuuaugcagccaaaagacacaugaaaauaugcucaucaucacuggccaucagagaaaugcaaaucaaaaccacagugagauaccaucucacaccaguuagaauggcgaucauuaaaaagucaggaaacaacacgugcuggagaggauguggagaaauaggaacacuuuuacacuguuggugggacuguaaacuaguucaaccauuguggaagucaguguggcaauuccucagggaucuagaacuagaaaugccauuugacccagccaucccauuacuggguauauacccaaaggacuauaaaucaugcugcuauaaagacacaugcacacguauauuuauugcggcacuauucacaauagcaaagacuuggaaccaacccaaauguccaucaaugauagacuggauuaagaaaauguggcacauauacaccauggaauacuaugcagcccuaaaaaaggaugaguucauguccuuuguagggacauggaugaagcuggaaaccaucauucucagcaaacuaucgcaaggacaaaaaaccaaacacuguauguucucacucauaggugggaauugaacaaugagaacacuuggacacagguaggggaacaucacacaccggggccuguugggggguggggggaagagggagggauagcauuaggagauauaccuaauguaaaugaugaguuaaugggcgcagcacaccaacauggcacauguauacauauguaacaaaccugcagguugugcacacguacccuagaacuuaaaguauaauaaaaagaaacaaaaacaaaacaaaacaaacaaacaaaaagaaauguucuuuacauccucucuccucauucuucccauacucaauuaacagccagucuuauaugcuuaucuuuaauuauacccaacauccuuccauuucuuuccauuucugucaccaccacacuggucuaaauaacugucuucuuuuaucuguaugacugcaauagcaucuuaacugguaucucugccuccacucuugcccauggaugcugugugacacgauuccauauaaucagucuuuccuagaguccuagaguuuggauauaaaugggagaccugcuuuugucucccuacauuuaucauuuucuaauucauucaacauacauuuauuugaacaucugccacgugccaggcacuguucaaaguucuggggacacaacauugaacaauaccuccaaaguuuguguucuuaaugagcuuaacuuauagucagagaagauagacaauaaagaaauaaauauauaauauuucaggcacuguuaagugcauugaaaaaaaauggugggagcaauauuuacauacaguguucagggaaagccucacugauaaaaugaaauuugagcagcguccugaaggaaguaagagaacuugcauuagaguaucagggacauaauuuuaaguagagagaacagaaacuguaauggucuagagauaggcacacaucuaguccauuugagaagaacaaggaggucaguguggcugaggcaggauuaacaggagacaaugguaacagaugaaggcagagagguugcagagggucaaauuucguagggucuugaaggccauggugaaggcuuuggaauuuacugagugagaugaaaauccacuggaggaucugaagcagagaacagugaucagaauugcaauuugaaaaauuacuuuagaugcaauguugggaaaagacuauaugaggguaagguuggaaacaggaaggcuuuguaucaacucucaucugaauuauugcaauggcuucuugcaauaauucagaugagaaaugaugauaauuuagaugugguugguagucacugagguguagagaagaggcuggggugugugugugugauuuauagacuugauuuuauuauuuuaauacccuuuuauuauuacagaagcagugcauaugcagugcagauaauuugaaaauauagccaaauaacauucaaaaaauaaaaacaucacuuuuauagcaucugaagugacacuguauccucucuuggcuuguaaccugcuuucccuggucaauuaucuucaucguuccauuucaguacauuuucaucuuauucaauacuaaguccauaaucaacccugacuauuuuuugaaaugauagccaagaggauccccacccaaaucucaucgugaauucccauguguugugggagggaccuggugggagguaauugaaucaugggggcagaucuuuccuaugcuguucuugugauagugaauaagucucaugagaacugaugguuuuaaaaagaagaguuuuuggcugggcaugguggcucacaccuguaaucccagugcuuugggaggccaaggcgggcggaucauaaggucaggaguuagagaccagucuggccaauauggugaaaccccaucucuacuaaaaauacuguggacuuuugaguuaaugcugaaaugaguuaugacuuugggggacuguugggaaggcaugauugguuuugaaaugugaggacaugagauuugggaggggacagggggaaugauaugguuuggcugugucccuaccaaaaucucaucucaugugguggcacaugccuguaguaccagcuacuuggaaggcugaggcaggagaaucacuugaacccgggagguggagguugcagugagccaagaucacgccacugacuccagccugcgugacagagcaagacucugucuaaaaagaagaaaagaaaaaaaagaguuuuccugcacaagcuuucuuucuuugccugcugccauccauguaagacaagacuugcuccuccuugccuucugccaugauuuugaggccuccccagccauguggaacaguaaguccauaaaaccucuuuccuuuguaaauuucccagucucagguauaucuuuaucagcagugugagaacagacuaauacaguaaguugguaccaguagaguggggugcugcugaaaagauacccaaaaauguggaagcgacuuuggaacuggguaacaggcagagguuggaacaguuuggagggcucagaagacgacaggaaaauguggaaaguuuggaacucucuagagacuuguugaauggcuuugaccaaaaggcugauaaugauauggacaaugaaauccaggcugagguggucucagauagagaugaggaacuuguugggaacuggagcaaagguaacucuuguuauguuuuagcaaagauacugguggcauuuugcuccuguccuagagauuuguggaacuucgaauuugaaagagaugauuuaggguaucuaccauucuggggccuggaggacggugguccucuucucacagcuccacuaggugguaccccagcagggacucugugugugugcucugagcccacauuucccuucugcacugcccuagcagagguucuccaugagggcccacccccgcagcaaacuucugccuaggcauccagguguuuucauacaucuucugaaaucuaggcggaaguucccaaaccccaguucuugacuucugugcacucgcaggcucaacaucauguggaagcugccaaggcuugggacuuguacccuaugaagccacagccugagcucuacauugaccccuuucagccauggcuguagcggcugggacacaaggcaccgacucccuaggcugcacacagcauggggauccugggcccagcccaugaaacaacuuuuuccucuuaggccucugggccggugaugggaggggcuggugugaagaccucugacaugcccuggagacauuuuccccauugucuuggggauuaacauucggcuccucauuacuuaugcaaauuucugcagccugcuugaauuucuccucagaaaaugggauuugcuuuucucuaacauuaucaggcugcaaauuuuccaaacuuuuaugcucugcuucccuuaugaaacugaaugcccuuaauagcacccaagucgccucuugaaugcuuuguuguuuagaaauuaauggaagugccuggaugcccaggcagaaguuugcugcgggggugggccuucauguagaaacucugcuagggcagugcagaagggaaaugugggcucagggcacccacacagagucccuacugggguaccaccuaguggagcugugagaagagggccaccguccuccagaccccggaaugguagauccaucagaaacuugcaccagcaucuggaaaagcuacagaaaaugccagcccaugaaggcagacacaagggaggcuguacccugcaaagccacagggguggagcugcccaagaccaugggcacccaccucuugcaucagcaugacucagaugcaagacauggagucaaaggagaucacuuuagagauuuaagauuugacugccccguagaauuucagacuugcauggggccuguaggcccuuuguuuuggccaauuucucccauuuggaauggcuguauuuacccaaugccuauaccccauuguaucuaggaaguaacuaacuugcuuuugacuuuacaugcucauagguggaagggacuugccuugucuuagaugagacauuggacuguggacuuuugaguuaaugcugaaauguguuaugacuuugggggacuguugggaaggcaugauugguuuugaaaugugaggacacgagauuugggaggggaugggguggaaugauaugguuuggcugugucccuacccaaaucucaucuugaauucccauguucugugggagggaccugauaggagguaacugaaucauggcaguagguccuucccuugcuguucucaugauagugaauaagucucacaagaucugaugguuuuaaaaagaggaguuucccugcacaagcucucucucuuugccugugccauccaugugagauauaacuugcuccucccugccuucugccaugauugugaggccuccccagccauguggaacugugaguccauuaaacuucuuucuuuuguaaauugcccagucucagguaugucuuuauuagcagugugaaaauggacuaauacaggauccuuuacagauuagauguuaauguaagaaaaaaagaguuggaaaacuucaagaucugugacugaauaacugaaauagggaaugguuuuacuuauuuauuuuuuugagaucaagucugacucuguugcccaggcuggagugcagugaggccaucucagcucacugcaaccuccgucuccccaguucaagcgauucucgugccucagccuccugaguagcugggacugcaggugugcaccaccacgccuggcuaauuuuuguauuuuuaauagagaugagguuuugccauguugcccaggcugaucuugaacucuggggcucaaccaauccaccugccucagcuuccccaagugcugggguuacaggagugagccaccaugcccggccaggaaugguuuuugauugccauggagaaggcugagcaaucagcagguuuugggaaggggcaggaauuaagagucuaauugugugcauguuaagguagggaguugauauguaaauuuugacuucaggagagagaucugagaauaucuccagauauucaacuggaauuaucugcagauagauaguacuuaaaaucaugaggcuaaacaaugucgucacagagugaguauaaauagaauaaagaagaaguuggagaacuaaucccuggagcacucuaaccuuuaaagauuagggggaugaagaaggacucgcaaaguugacaaagauuggcaguaaguuuaguagaaaagugaagaaaagugguguuagagaaaccaagugagaaccuguaucaacgauggaguaaucaccucucaaauacuacugagaauucaaauaagaugagggcuaguaaucaguaauguaaagaucaauaaugaccuugaaaauguaguucuuaugaaauaauagagauaaaagcuucuuuggaguggguuaaagaggagagaauggcaggaaaagaugcaaaggcugcaagcagggacaauuauuuuaagacgguuucuguaaagauaggggaggaaauaauagcaugauugauguugaugagauuaaucuaguggagagauaaauugaugauguaagggagaaaaggagaaauugcuggagcaacauuuuuuaugaagggagaagagaugggaaucaaguacaaaacuggagagguuggccuuaggagcacagacacucuauuuauuguaauaagugugcaggcagaguauauggguacaaaugccaguaaaugugauguugggagucuguggagguucauugcacagcaucagcuaagagugaaaaugggcauuggagaauggaaaaaaggugcucgagauuuaaggaaaacacagaaaaucuaagauagagguccaggagaaugagaaagucaguggacuagggaaauagucuaugguugcaaugcagcaauaagggcuuacuugagcuagaaagcaaggugggaaagugacaagucaugcuugucccuucuuguuccucaaacaugguaaacuuuuuccauucucagggccuuugcauuuucucuucccucugucuggaaacaucuucucucagagcuccaucagcuggccuguuaucaucauuuaggucucaacuccucaaagaugauuucuaugaccaccacagcuaauguaacacucuaccguauuacucuaucauauuauucucucuaccauauuauucuauucuaucuucugaacaacacaauugagauugccuuauuuaguuuuguacuaacuugucucuugcucuuuccaauagaauauaagcuccugcugugcugcacuccaauguguacaaaagugucuggcauguaguagguguuccauaaauauuugugacugacugacucuccuuauguuuauauuccacauuucucuguacuacuugacugcucaaccucccucuacucaccuaaaaauaaaaucauccuacuuugcccucuggauccccaguaucaugaaaaccaauccuccccaaguccuuaaccucuuuaacacgaacuugcuucuuccuucugccuugcuuaaaguucucugaugagacuaagauuuccccugcagcucauaagguugauaggugagguugacuuucuuccugcuccccauugcuccuucuugucccugauuccucuacccucuuguaaaccucucuucucucuaucucaccagaguaagaguuucaagacaccuugauuuuucauccucuaacucucauuguuggugucaucaucugguaaagucaaaugucacaagagcagagcaaaggaauaaccaaugcauucauaccuguuucuuagaacauguggggagcuacucaucccauaaucccagagccucuccacugcagcaauaaaauagugucguguuuucuuuugaaagcugcgggggcucugauuuucauccucaucauaaaugucaaaaucuuccuucuucauuucaacugauaugguaucaucauagucaauuuccucuugaucugacugaagaguaguacgaguuauuucccguugauggcguuucaagacugguggguuuugagagcacagccuuucaguccuaccuugcuuugcccaggugacuucuauuucgggcuuauuuugucccucauuuauugcugcuauugcaugauugcuuucacaagcguucagggacaaaaugguauccuuuuucuuaaaagcuguuuuuucuggugacuucucuugggauuuccacucuucuuuugguaucugaguaccauagugguuaucccaagcaagaggauccaauagcuuggagggagucuuugcagagcuuucuguugcuacucucagaaagggaacuuuuccaggucuguuugcuucauuccacuuaaucgcucccucuguucccugaagaaggcucccuuccacgagauccagauggccaggagacccauugcuaguuuccguagggaauagguccuucugauaaaugugaacuuuuggaagcaauucaacuuugccagauguuuugggcaagucugguuucgggagaacaguguucucaacuuucuuguaugugacugaauuuguggcacuuguccccagggagccaaccucucuuugaucaccagucaucuccaagguuagaauggcuaaagaaagguuauuuuuuuuggcuccuuguaagaaaugacugcuuucuuggaccccagaaucuuucuuucuauaagaugcugcuggaagaugagaagaguugucuuggaauaggacccuggucagauauauaggucuaauagauggaaaugaugauaccuuugcaauggguaauggagaucuauuugcuugagggaugcuaugacuccucguaaggcaaucugauaagggagacugaguaauggccccuuucuccuucucauuguagucuaucugugugagggugcucggggucaaauguuucauguuuuuggaccacuggguugaggugucauccacaauuauccuuuuuucaaguucuguuucuucuagugggagucugaauuguuucaaagcucucuuacuacguugcgugacaaaauucugcuggcuuguauuaggagauauccuuguggugcaugcauauuucucuacaauuugcuugguuugauuucccaagccuuccaaguuuucuuccuccccuuuuuuugagaaaugagcuguguguuucuuuguucuauuuguugaaucauuuaaugaccuaaaaucuugaaguacuggagcauaugccccgucauaugaaccuucuacauuuugccuagugcucaguaagaaaagguucuucaugaaauucuuagugccagucacuguauguaucugaggcaaaacuacauucucuuggauuaauguuuccuucuuuucuauuucuuccugaauuuuuuuuucuugauuguguguauuauuuucauguaaauuauccaaguuaguaagaaauagguuucugcugcuuggaaaaaccaucucuuugaguccuacguccuuuguaaauucacccuuuccuacuaccacuuuguuuuucucagacaagaaauucugaccuuccacagauuuuucugguccuaaggauacuaauugcuuuggacuggggccuugcccagaguucagagaguucuuuccaugaguccuuuguauccaccuugcugauucuggcaagaauagcaucuuaaagaacgacauaucuggauuuugugcaucugguggaauggggcccucuuuuuucuguuggaccauuuccauguuuuuugaugaaguaguuuuauuugacauaugauuuagccucaaagcuguagcauuuuuguccauaagcauucugucaugaaucaaaggugucacuuuuuuaaacucagugucacuuucuaauauauuuugccagacugauggacuauucucaauuaauaaugaugggccaucaaugugagucuuucuauuaguugcugaauuauuggaaguuuuguuugucuuuaacaaagagaugcuaacuuugaauaaggcauuaucuuuagucaacaaagcagguccaugagcucuuuucccuuuaaauaaccuaccacucucuguugacgauacauuuuuuccccaugaacuuucuuggcuauucauuaaaccugauucuaacaacuuugaaucauuauuuucuucacucaagcucagagguccaccagacucaguaaggggagaugacuuuuugccaaauagagugguaucuaauugacuaucauaaugaacuggcauacuuggggguccuaaggaacuuguauuaucaguaccugcugccaaauugucugauggaauuguugaaaucagauuauuugauguacuagaaacuuugaaaucaaguuucuucaacucuguugcugcaguuguccccaguuucucauuuaaucuuaauuggaggccugacucagggguaaauaccauguccccacugugauggagcuguggccugaagugugucauuucagacaggcuguuauuacugucuauugcuccaggugauggaucaucagaaaaagucucauauuuggcuucuuggagaucagauaaggauagcccauguggaguaggacucugucgcaagagcaucaacaaaucacuagaggagacauuuuguauuuuaggcauagguguucugugugcaaaccaagggucagucuucucuaugucauuuucuggaauugugguggcauuaaauugcuuuugccuagugcuagggugucuugaauucugggagaagcuucuugguucaauggcauuguuuuuacucagcaaguaugcugaaauaucuucauaacuguccucguaauaaucaccaguguucuugucacaacuagaaaccuucaguaaggcggucaugccucuguuccgaaagucugaguuguggcaccccagaauccauagaccuggagaugaggaagaauaagacucugguuacucauaacacagauucuaaaacguucuguuagagguucucucccauucccagauaaaugaaaaaauacuagucaguaucauuauaucacaggucauuggguuaaaucccuggaacauguaauauaaaagugguuuuugcauugcugcuguuguacuaugccuguuugugaccauaagaaaggacugugauaaaaaugaauagauauugggauuaaaauagggaaauguaauuaauauacacaauaauggagggucuuaauagugacacagaacucucugaauaugacagugauuuaauucaggaaaguauuuauauuggcuagauguuauugcuauaucacauaguggcacagguuccucuuaaauccaucagauugccuggauucaaaucccaguucuaccauuuaccagcugugugacuuugagaaagucacuuaaacuuucugaacaauagguuucuaauuuucaaaugaggcuaauaguaucuaccccaucauauaauacauugaaaucacauaacacaauaccuagcauccacugucacccacuugcagaauauguaagcacaaggaaggagcauuuaggucuaggauccagcuaauauaaaauucuaccaugguacuagcaauauuaauuucuaccaugaacaagauuagcugagugaaggaaugcaacaaguuauaauaggcuaauuacauggugguaaaguagaugcauaaacauaagagacaagauacaccuuuaccaagcuacccguuggguaccucaauagccuugucauuucacacagucuuuucagggaagaucuuaacugcauccaccuucuucucaagggaagcugcucccaaaagcccugugaaugcuuacauucuaugugcagccaaauuaucaaucaaguggcaaaggagaauaaaaacauauucuaacauauaaagacucagaaaaucuaccucaaaugucaccauuaucaggaagugauuauggaauguuugccaccaaaauaaaggaguaucucaaacaagaguaagaccugguauccaagaaccagguaccuauccugagggaggguaaauaaaagucccaaguugauaacugagccucaggccuagagagaaccagcucagacuggagcagggggaugcaugccucuaggaggucaaucuguaagcaaaaaggaauacauuauaugauggaacucuugaaaaaaagaggauaauucaaaggcagacauuauaagaaaaacagggaaacaauuagagauucucgucaaacuaguuaccaaaauggacuuuuauuuacccuccccucugagaggggccugguauuaggaauggugaccaagcuggaguuuaguuuuaauggcuuggguuaaaauuuuguaaugaaaauaucuuuuuguauuguaugugugacuaaugguaaauuuaaaacauuauaauuaauucauaaauuucaauccaagaacuuagaguugguuguuugaugaaaaagucaauaaaauaaauaaccaaauaaaaauuaagaaauuucacauauacaaaauuugaaguaagaaaagagacauaauuacagacacaaagaaaaugaaaauaauuguaauucccuuggagacaccucagcugucaaucuccuccuccaacuucugacauagguauaagcuaucuggccaaguuggggucuagucagcacuacaaauauauagaucagucuccugccucugugaucaaaccagggcuuucacugaacuaauuaauucuguaagcuauuauccgaucuuggaacuaguuacuagcuguugaguugagaagggaauucgacauccauuaaguagacagagaguuaggcuaagagcaagccacuuauccucucggcuagcaaaccuugaucagaacauauuuguaccuuguuuaaggacgagaaaacaugcaaucuauaaauauacuacagaacagggagaaggaaacagaagucaggaaacuuagaggcaauaccuacuucugaaaguaauccacugcagauucuagaggaaaaguaagaacaaauaucuugccauacuaaaacacaagaaggcacagcuuccauaauuuaaaaccacaaagacauagcuucuauaauuuaagacuggaaagggcauacacaaggugaaaugguaauucagcuggaugaaauagaaaagaauaauuauaagaaaacuuaacacauaacaagagaugaucaguuuguguguguauggguuccaauaaaaccuuacaaaaacggacagagaccagacuacccaagggccauaguuugcccacuccugauguagauggucacccacugugccuuucaugggguuucaaaagaugaccaguuuuuaagguagugaagaaagggcuggccuuucuucuugcuccuuucagaaauugcugcaaauaauuaaagacagaguacaauuaagcuggaagauaucugaagccaugaaaccacaaaauagaaguauaguuaauauaaaacagguaucaaaagauaaaaagaguggaugcucauggcuggcagauuucagaaaaguccaagaagacauacuuccucauaucuuauaccgccauaucuuccccauuuuuaauaucaaagucuaauuauuccuccuacuucagccucccaaagugcugggauuacaggcaugaaccacugugccuggccuuguuucuuucuucuaucaaggugcaaguauuauacuuugauaugaaaaacagucagucauucauuauaacaaugggaucaggguauacaagcuagcaucggugguuuuacuggacuccuuucaacacaagucucaaaagguaggaaagaugggaccagaagaaagaaucacauugacaagucauuuuugcacuguaagucuguuuugcaagguggggaggggaggaaagaaauucugaaauguaaacaacucugcagcuuugaucuugaugggcuggagagaaguaaaggcugaaaacucacacauacaaucaauaccuuucauaagagaauuccugcuaaucuaaaacucacuccuaaugccucauugauauuaauauaucuacauaaacuuucugcgaaaaguuuauuuagaacaaacucaccucaaugauaaauaauaagcaaaaaggaucaagauacuacaagauaaaaggaagaaaggaacaacaaggccaggugcaguggcucauacugguaaucccagcacuuugggaagcugagguuggaggauugcuugagcuuggaguucaagaccagccugggcaacaaagcaagacccugucucuacaaaaaauaaaaaaguuagccuggcaugauggugcaugccuguagucccacuacuugggaggcugaggugggaggauugcuugagcccaggagguugaggcugcagugagccaugaucacaccacuuacuccacccugggcaacagagugagacccugucucacaaaaagagaaaggaacaacaaaaacgaauaaaagaagagcaguaauaaaaaaaauguugccaaggagaagauaaaacuuguaaccaaacauaucaccauaaucuaaugagaugaccacaucugaaaaaccaaagucuaauguagaauuagcuauaagaauuuauagaagacguaugggucaauggaacagaauggagaguucagaaauaaacucucacauuuauggucaauugauuuucaacaagggugucaagaugacuuaaugggaaaagaaucauauuuucaacaaauggugccgggacaacuggauguuuacaugcaaaaaauaaaaaagagguuagaccucuucuucacaccauacacaaaaauuuauucaaacuagaucauagacauauauguaacagcuacaacuaucaaacucuuagaagaaaauauggaaguaaauguggccuugggcuagacaaagccuuccuagaugugacaucaaaagcacaagugacacaagaauaaaaagauaaauuguaugucaucuaugaguucaucaauuaacucaacaacccaggaaacaauuacugaaguaaaaauaggucaauaaaugucaacaaaacugaacaacuagaaggaaaaauaguuagaaaacaaacuagaacagcauauucaagagcugugugacaaaauugaacaguauaauauauguaaaugcaauaccagaagaagagaaagaauuagaagcaauauuugaagacacagaugauaaauauuuuucaaaauuaaugauaccaaauuacagauugaauaagccuagagaaugccaaaguaacacacacacacacacacacacacacacacacacacacacacaaaaaucaaaguaaagagcuugaagccauccagauuuuuuuaaaaagauacauuauguacaguugaaugcaaaugggaauuacaacaaacuuauugugaaaaacuaugcaaguagaaacaauggagcggcauuuuuaaagugcugagggaaaaaccaauaaaacaaaauguaauaaaacaaaaacaacaaccacaaacccagaauucuauacacagugaagauauaauucaaaaacagaaauaaagacuuuucagagaagcaaaaacugacaaaauuaauuaaccaacagacuugcacuacagaaaauguuaaaaaagacacacuguaaauauaaggauagagauagguugaaaagaaaagaaugggaaauauauaccacacaaacauuaagcaaaauaaauaugauagugcagguguauaaauuuuagacaaugcagacguuuaaggcaacaaguacuacuucagacaaaaaggacauuucacaaagaugaaagaauugauuuaauaagaauacaaccuuaaaguuguaagcaccugauuuuauauugccucauuuauuuugaaacauucuuacuaacaaauacaaaaaucaaaauaacaaacucaacaaucacagagaugucacaguuuccuccaugucuguaagaaacagauaaaauaucaggaaguuuauaaggauuuuaaaaacaugauaaagcaacuugacauaauaggcaaauauaugacacucuacccaauaacagcaaagacauauuuguuucaaaugcagugggccauuaaucaaauuaaauuauucacugggcauauagcaagucucaacaaauuucaaaugauugaaauaauauagaguauguuaugugaucacaguaaaacaaauaaaucagcaacagagagagagccagaaaaucgccauauauugggaaauuaaguaaaacacuguaaaauaacuaugaauaaaacaagaaauaacguaaaauuuauaaaauauuuuaaacucaaugauaauaaaaauaugacucaucaaaauuugugauaugggguuaaagcaguauauaaagggaaauuuaugcuuuguaugaacuuuuaaaaaguaagaaauguugaaaaucaaugaaccaaguuuuaaucucaagaagucaagaagaaaaagaaaacugaauccagagaaaguauuggaauaauaacaaaagaccagaaauaaaugaaaugcaaagcaaaauaaaaauaaaaauucaacauagaaaauaaacaaaacaaaaaaauuuuuuuaauuccaugaccugaugaacaaagcaaaaauuugauccuaugguaggauuaguaaauuugaugaaccuauaacaaaggcgacaaacuuuuuuuuuuuauuauacuuuaaguuuuaggguacaugugcacuagggggaggggcgagggauaucauugggagauauaccuaaugcuagaugacgaguuagugggugcaggcgauaaacuuaaaauagauaaaauauaaauaacaauaucagguaugaaaacggagacaucaguacagacauuauaaggaugauaaaagaacauuacaaauaacuuacuucaaguaaauuaaacaacuuagaugaaagggacauauuucuagaaaaacacaauugacaaaaacugauaccauaaaaaauauuauaauagcauuaaauaccaaagaauacacuuuacaaaaaugugcaagaccuguacacuaaaauuuuacaaaaacauugccaagagaaaauuuaaaagauguaaauaaauaacuaaaccaugcucauggacaggaauacucaauauugucaagagguaugcucccccaaauugaucugcagaaucaauguaaucccuaucaaaaccucagaagauauuuuuauugauaaaauugacaagaugauucuaaaauuuauauaaaaaucaaagagagcaaaguuggaggaauuauacuaacaaauauuaaaacuuacuauaagauaguauguuacugguacaaagauagaccaauaagucaauggaauauaagagaucagggguuggcaaacuuuuucuguaaaaagcaacauaguaaauauuuuagguuuguagacacauaugguccaugauacauauccuuauuuguuuuuuugcuuuuuuuuuguuuugugugacaauucuuuaaaaauguaaaaaaauucuuagcucaaugccauauaaaaacaagcugcaaauuuggcuuguggaucauaaccuaccccugaaauagaguacagaaacaaagcuacagugauacagucaucagauucauggcaaagacaacagugcaauucagugaggaaauuauuuuuuuccaacaauuggugcuagagcaauuaaauauccauauggaaaaaugaacuuuuaucugcaucacuccaucaaaauuaauuaaaaaugaaucauaaacuuaauugugaacaacacagcaaucagacuucuagaagaaaauauuuaaaauauguagaaagaaaauauagaaggauggcaucauguucuuaggauaggcaaaaauuucugaaacagaauacaaaaggcauuaaccauaaaaaacugaaaaauaagaauuaauuaaauguaagaacuucuauuaaccauaaugcacccuuaaaggagugaaaagacaaaccacagacugggagaaaacauucacaauauguaaauccaaccaaggacuuguaucuaggcaaaauaaagacccauucugaccaaaaacugacagagaacuuuuuacuagccaacacacacugaaggaaguuccaaagaaguuucuucagacaaaaagaaaaugaucauagauggaagcaagaaaugcagaaaagaaugaaagaaaugaaagguguaaauauauauauauauauaaaugauauugauuauauaaaacaauaauaaugucuuaugggguuuaaaauauauguagaauucaaauaaaugacaagagcacaaaagguaggagugagaaaaugaagucacguuguuugaaggucuuugcauugggagccaagauggccgaauaggaacagcuccagucuacagcucccagcauaagugaugcagaagacgggugauuucugcauuuccaacugagguaccggguucaucuuacuggggagugccggacagugggugcaggacagugggugcagugcacugugcgugagccgaagcagggcgaggcaucgccucacccaggaagcacaaggggucagggaauucccuuuccuagucaaagaaaggggugacagauggcaccuggaaaaucgggucacucccacccuaauacugcgcucuuccaacgggcuuaacaaacggcacaccaggagauuauauccugcaccuggcucagaggguccuacgcccauggagccuugcucauugcuagcacagcagucugagaucaaacugcaagguggcagcaaggcugggggaugggugcccgccauugcucaggcuugaguagguaaacaaagcggccgggaagcucgaacuggguggagccccccacagcucaaggaggccugccugccucuguaggcuccaccucugcgggcagggcacagacaaacaaaagacagcaauaaccucugcagacuuaaaugucccugucugacagcuuugaagagaguagugguucucccagcacgcagcuugagaucugagaacgggcagacugccuccucaagugggucccugaauccugaguagccuaacugggaggcaccccccaguaggggcagacugacaccucacauggccagcuacuccucugagacaaaacuuccagaggaaugaucaggcagcagcauuugcaguucaccaauaucugcuguucugcagccucugcugcugauacccaggcaaacagggucuggaguggaccuccagcaaacuccaacagaccugcagcugaggguccugacuguuagaaggaaaacuaacaaacagaaaggacauccacaccgaaaacccaucuguacgucaccaucaucaaagaccaaagguagauaaaaccacaaagauggggaaaaaacagagcagaaaaaccaaaaacucuaagaaucagagcaccuccccuccuccaaaggaaugcagcuccucaccagcaauggaacaaagcuggauggagaaugacuuugaugaguugagagaggaaggcuucagaagaucaaacuacuccgagcuaaaggaagaaguucgaaccaauggcaaagaaguuauaaacuuugaaaaaaaauuagacgaauggacaacuagaauaaccaaugcagagaagugguuaaaggaccugauggagcugaaaaccacggcacgagaacuaugugaugaaugcacaagccucaguaaccaaugcgaucaacuggaagaaaggguaucagcaauggaagaugaaaugaauaaaaugaagugugaagauaaguuuagagaaaaaagaauaaaaagaaacaaacgaagccuccaagaaauacgggacuaugugaaaagaccaaaucuacaacugauugguguaccugaaagugauggggagaauggaaccaaguuggaaaacacucugcaggguauuauccaagagaacuugccaaaucuagcaaggcaggccaacauucaaauucaggaaauacagagaaugccacaaagauacuccuugagaagagcaacuccaagacauauaauugucagauucaccaaaguugaaaugaaggaaaaaauguuaaggacagccagacagaaaggucggguuacccacaaagggaagcccaucagacuaacagcugaucuuucggcagaaacucuacaagccagaagagagugggggccaacauucaacauucuuaaagaaaagaauuuucaacccagaauuucauauccagccaaacuaagcuucauaagugaaggagaaauaaaauccuuuacagacaagcaaaugcugagagauuuugucaccaccaggccugaccuaagagagcuucugaaggaagcacuaaacauggaaaggagcaaccaguaccagccacugcaaaaucaugccaaauuguaaagaccaucaaugcuaggaagaaacugaaucaacuaacgagcaaaauaaccagcuaacaucaaaaugacaagaucaaauucacacauaacaauauuaacuuuaaauguaaauggacuaaaugcuccaauuaaaagacacagacuggcaaauuggauaaagagucaagacccaucagugugcuguauucaggaaacccaucucacgugcagaaacacacauagccucaaaauaaaaggauggaggaagaucuaccaagcaaguggaaaacaaaaaaaggcagggguugcaauccuagucucugauagaacagacuuuaaaccaacaaagaucaaaagagacaaagaaggccauuacauaaugguaaagggaucaauucaacaagaagagcuaacuauccuaaauauauaugcacccaauacaggagcacccaguuucauaaagcaaguccugagugaccuacaaagagacuuagacucccacacaauaauaaugggagacuuuaacaccccacugucaacauuagacagaucaacgagacagaaaguuaacaaggauacucaggaauugaacucagcucugcaccaagcggaccuaauagacauccacagaacucuccaccccaaaucaacagaauauacauuuuuuucagcaccacaccacaccuauuccaaaauugaccacauaguuggaaguaaagcucuccucagcaaauguaaaacaacagaaauuauaacaaacugucucucagaccacagugcaaucaaacuagaacucaggauuaagaaacucacucaaaaccgcucaacuacauggaaacugaacaaccugcuccugaaugacuacuggguacauaacgaaaugaaggcagaaauaaagauguucuuugaaaccaaugagaacaaagacacaacauaccagaaucucugggacacauucaaagcaguguguagauggaaauuuauagcacuaaaugcccacaagagaaagcaggaaagauccaaaauugacacccuaacaucacaauuaaaagaacuagaaaagcaagagcaaacacauucaaaagcuagcagaaggcaagaaauaacuaaaaucagagcagaacugaaggaaauagagacacaaaaaacccuucaaaaaauuaaugaauccaggagcugguuuuuugaaaggaucaacagaauugauagaccgcuagcaagacuaauaaagaagaaaagagagaagaaucaaauagaugcaauaaaaaaugauaaaggggauaucaccaccaaucccacagaaauacaaacuaccaucagagaauacuacaaacaccucuacgcaaauaaacuagaaaaucuagaagaaauggauaaauuccucgacacauacacccucccaagacuaaaccaggaagaaguugaaucucugaauagaccaauaacaggcucugaaauuguggcaauaaucaauagcuuaccaaccgaaaagaguccaggaccagauggauucacagccaaauucuaccagagguagaaggaggaauugguaccauuccuucugaaacuauuccaaucaauagaaaaagagggaauccuccugaacucauuuuaugaggccagcaucauccugauaccaaagccgggcagagacaaaaccaaaaaagagaauuuuagaccaauauccuugaugaacauugaugcaaaaauccucaauaaaauacuggcaaaccgaauccagcagcacaucaaaaagcuuauccaccaugaucaagugggcuucaucccugggaugcaaggcugguucaauauaugcaaaucaauaaauguaauccagcauauaaacagaaccaaagacaaaaaccacaugauuaucucaauagaugcagaaaaggccuuugacaaaauucaacaacccuucaugcuaaaaacucucaauaaauuugguauugaugggacguaucucaaaauaauaagagcuaucuauggcaaacccacagccaauaucauacugaaugggcaaaaacuggaagcauucccuuugaaaacuggcacaagacagggaugccuucucucaccuuuccuauucaacauaguguuggaaguucuggccagggcaauuaggcaggagaaggaaauaaaguguauucaauuaggaaaagaggaagucaaauugucccuguuugcagaugucaggauuguauaucuagaaaaccccauugucucagcccaaaaucuccuuaagcugauaagcaacuucagcaaagccucaggauacaaaaucaauguacaaaaaucacaagcauucuuauacaccaauaacaggcaaacagagagccaaaucauaagcgaacucccauucacaauugcuucaaagagaauaaaauaccuaggaauacaacuuacaacggaugugaaggaccucuucaaggagaacuacaaaccacugcucaaggaaauaaaagaggauacaaacaaauggaagacuauuccaugcucauggguaggaagaaucaauaucaugaaaauggccauacugcccaauguaauuuauagauucaaugccauccccaucaagcuaccaaugacuuucuucacagaauuggaaaaaacuacuuuaaaguucauaugaaaccaaaaaagagcccgcaucgccaagucaauccuaagccuaaugaacaaagcuggaggcaucacgcucccugacuucaaacuaugcuacaaggcuacaguaaccaaaacagcaugguacugguaccaaaacagagauauagaccaauggaacagaacagagcccucagaaauaacgccacgcaucuacaacuaccugaucuuugacaagccugagaaaaauaagcaguggggaaaggauucccuauuuaauaaauggugcugggaaaacuggcuagccauauguagaaagcugaaacuggaacccuuccuuacaccuuauacuaaaauuaauucaagauggauuaaagacuuaaacguuagaccuaaaaccauaaaaacccuagaagaaaaccuaggcaauaccauucaggacauaggcaugugcaaggacuucaugucuaaaacaccaaaagcaauggcaacaaaagccaaaauugacaaaugggaacuaauuaaacuaaagagcuucugcacagcaaaagaaacuaccaucagagugaacaggcaaccuacaaaaugggagaaaauuuucgcaaccuacucaucugacaaagggcuaauauccagaaucuacaaugaacucaaacaaauuuacaagaaaaaaacaaacaaccccaucaaaaagugggcgaaggacaugaacagacacuucacaaaagaagacauuuaugcagccaaaaaacacaugaaaaaaugcucaccaucacuggccaucagagaaaugcaaaucaaaaccacagugagauaccaucucacaccaguuagaauggcgaucauuaaaaagucaggaaacaacaggugcuggagaggauguggagaaauaggaacacuuuuacaauguuggugggacuguaaacuaguucaaccauuguggaagucaguguggcgauuccucagggaucuagaacuagaaauaccauuugacccagccaucccauuacuggguauauacccaaaggacuauaaaucaugcugcuauagagacacaugcacacguauguuuauagcggcaguauucacaauagcaaagacuuggaaccaacccaaauguccaacaaugauagacuggaguaagaaaauguggcacauauacaccauggaauacuaugccgccauaaaaaugaugaguucauguccuuuguagggacauggaugaaauuggaaaucaucauucucaguaaacgaucgcaagaacaaaaaaccaaacacugcauauucucacucauaggugggaauugaacaaugagaacacauggacacaggaaggggaacaucacacucuggggacuguuguggggugggggaaggggagagggauagcauuaggcgauauaccuaaugcuaaaugacgaguuaauggguacagcacaccagcauggcacauguauacauauguaacuaaccugcacauugugcacauguacccuaaaacuuaauguauaauaauaaaaaaaaagaacuaauaccagcucuucacaaacuaucccaaaaaucaagggggaaaaauacuuccaaacugauuccacaaggccaguauuacccugaaaccaaaccagacaaagacacacacauacacaaaaagaaacuacaggccaauaucucugaugaacauugaugcaaaaauccucaacgaacuacuagcaaaccaaauucaacaacacaguaaaagaucauucaucaugaucaagggggauucaucccagggaugcaaggaugguucaacauauggaaaugaaucaaugugauacaucauaucaacagaaugaaggacaaaaacaaaugaucauuucaauugaugccaaaaagauuaaauucaacaucccuucaugagaaaacucuaaacaaacuggguauagaaagcuuaccucaaaacaauaaaugccauauaugacaaacuacggcuaauaucauaccaaauguggaaaaccaaaagccuuuccuuuaagaucugaaacaagauaaggaugcccacuuucaccaauucuauaaaauguaguccuggaaguccaagccagaacaaguaagcaagagaaagaaauaaaggguacccaaauuggaaaggaagaagucaaauucuccuuguuuauagaugacauaaucuuauauuucacaaaaaacuaaagacuccaucaaaaaacuauuagaacugauaaacaaauucaguaaaguugcaggauacaaaaccaacaugcaaaaaucaguagcauuucuauauaccaagagcuaacaaccuaaaaagaaauuuuuuaaaaaucauuuacaauagcuauaauaaaaauaaauauauuggaauaaauuaaaccaaagagcugagauaucucuauaaugaaaacuaaaauacugauaaagggaauugaagaacacacaaaaaacugaaaagguaucuaucccauuuuaaugggcuggaaaaacuaauauuguuaaaauaucaaugcuaccagauuuaauguaauaccuauccaaaugccagugaaguuuuucacagaaauagaaaaaagaaucuuaaaauuuguguggaaccacaaaagacuccaaacagcuaaauaaucuggagcaaaaugaacaaagcuggaggcaugacacuacuugacuugaaacuauacuacaaagcuguaguaacaaaaacagcacgguacuggcauaaaaccagaaauauaugccaguggaacacgacagaaaacccagaaauaaauccacacauuuauagccaacucaccuuugacaaagugccaagaacacgcacuggugaaagaauagucucuucaauaaauggugugggaaaacuggauauccacaugcagaagaaugaaacuauaccccuaucucucacuauauacaaaaaucaaaucaaaauggauuagagacuaaaauauacaaccugaaaguaugaaacuacuggaagaaaacauugggggaaugcgccaggacauuggucugggaaagauuuugcagguaagaccucaaaagcacaggggacuaaagcaaaaguagacaaaugggauuauaucaagccauaaagcuucuggacagcaaaggaaacaauuaacaaagugaagagacaauuuauaggaugggaugaaauauuugcaaacuauacaacugagagggcauuaauaaccagaauauauaagaaacucuagucaauagcaaaaaaaacaaagaacccuauuaaaaauggacaaagaucugaauagacauuucucaaaagaagacauucaggcugggcacgguggcucacgccuguaaucccagcacuuugggaggccgaggcggguggaucacgaggucaggaaaucgagaccauccuggcuaacacggugaaacccugucucuacuaaaaauacaaaaaauuagcugggugugguggcgggcaccuguagucccagcuacucgggaggcugaggcaggagaauggcgugaacccggguggcggagcuugcagugagccgagaucgugccaccgcacuccagccugggcuacagagcgagacuccgucugaaaaaaaaaaaaaaaaaaaaaaaaagaagacauacaaauggccaacaaguauaugaaaaacugcucaacaucacuaauuaccagagaaaugcaaaccaaaagcacaaugagauauuucacuccaguuaaauggcuuuuaucaaaaagacaaaauaauuaaaaaaugcuggugaggauguggcaaaaggggaaugcuuguacacuguuggugggaguguaaauaaguacaaauacuguggaaaagaguaaggagguuccucaaaaaacuaaaaauagaacuacuacgugauccuucaaacuguuuauuaguugcaagggugaaaauaauaacuacucagaggagaaacuagaucccuguaccucaaggaagaaaaugcuauaaaugacagcaugugagcuagugggcaaaagagcauacgaauggcuagugaagcauucacagcuguugguacaagaaaaauauaauaacuaaccuggguuuuccaucgacaugaagacaguuucuccugagaaugggaauagggugagugugucuucauagaccauuuuguguuugaagguauauccagagaagaagacagaaaggaagucagucugugcuccaaugcuuagaauguaccaguaugccaccucaugcaaacaaacugacaacugcaaacuaucaaaaacauagccauugaugccugcaaaaacaauggggaaaagagauuuagacacaucacagauuuaguauuuuggauugugauugucaugauacaauuaggaauuauuauauguuaugcccauuaucuuauucccaggaagagauauuauaucuuccaaaaaaguagauuguuaauaaucaguugggccccaaucccaaugugaggagacagucauaaaccaucaugauaaagauuaauuuggauguuauauggggggcauuuugaugaguagcaagauguuugcauggucuuaaacuacacagaggagaaaccagaaaaaaaccuuugggugcuuaaaguuaccaucugaugaagguccagauucaaggaaaugaaagaagcaggacaaguaguuacuuguacuagaucccuguacuucaaagaagaaaaugcuauaaaugacagcauugguugauacaacuggaauaccaguuguaaauuauggaaaugugcuuuaucaauuugaagugucuguuauguaaaagauaucuuuauucacaggaaauguguacuaaaguauugagagguaaagggaugugaugucugcaacuaauuuucaaauagaaaauaaguaacagaaguguguauauaaagaaaagaaaaugaaaaacaaaauugcaaaauguuaaacauuugugaaucuggguaaagggugugugcaaguuccauguauuauucuuguaacuuuucuguacauuuuaaauuauuucaaacuaaagagcuaagcaaaaguaacauuggccuuagucuaugaagggaauuguuucugaaagccucuuccacacauccauucauccauccauucaauaaacacuugucuacucuguuacuagguacuguguaagaugguugcccacaaaccacuaagcaauacuuagacauuggcuuaguauaacuaauuaauaauugaaguuuuuuuccuauacaacauugagauauuauaaagcuauuauaauuaaaaaugcagucuuaaugcagaauagauaaauauaucaaacaaaauauggaguccagaaacugacaagauguaagcggaaacuuaauauauaauaaguugaaacuuaauauauaauaaaggcagcaucuccaaccaguacaggaaaaaaaucagcuaguugguaaaugauaauagaaaauaugacuauccacuuggaaaaaauagauuccacuucauuucacauaacuaacaaaaguaaaguccuuuuaaauuaaucugaauuuugccuaaggguaccuuugcacuugaguccuugcacaacaaaguugcagccuggcuuaguugaugaacuaacugaaagccuaauuuaggaauaugcuuuuauaacaaacagcucagucucagccgauuauagcagcugaacuuccaucaauugcaggcgacuaacagcuucaaauaaggcaaaaaugcccaacuguaaucaauuaagcugucucuaaaccucacuuccaauuucuauccauacuauguugcuggcugcuguucuguauuugguucugagggcuaucugauucuagaaucauguauaaaagccaauuacaaucuuuaaaauacauuuguuguauuuuugccuuuugacacuccacauggauuaaauaguuacaugucuuuugugaaauauguacacacuacuuuugggugcuguacuaguggcuaggguugccauaacaauauaccacagacugggagguguaaauaacaggaauguguuuucucacaguuuugaacacuaaaauuccaagaucaagguauuggcagguuugguuuuuacugacaccucuccuuggcuuggucuuuccucugugaauaugcaucccuggugucucuguguguacacauuuccucuucuuuuuuuuuuucaaauggagucucggucugucugccagucuggagugcaguggcgugaucucugcucacugcaaccuccaccuccuggguucaagcaaucuucugccucagucucccgaguagcugggacuacaggagcucgccaccauguccagcuaauuuuuguauuuucaguagagaugggguuucaccauguuggccaggauggucucgaucucuugaccucgugauccgcccgccuuggccucccaaaaugcugggauuacaggcgugagccacugugccuggcccacauuuccucuucuuauaaggacacuagucauauuggauuagggcccauuguaacaaccucauuuuaacuuaauaaaccccuuaaagacccuaucuccaaauacagucacauucugaaauacuaguguuagggcuucagcauauuaauucuaggggacaugauucaggacauaacagguguauacuaggaguggauuuccugagucaauaggguaugccgauguuuggcuuucgauguuuggauuuccugaccagaaauuuaugagaguucucauuacucuacaucuuuaccaauacuugguauggacagccuuuuuaauuuuagccauucugguguaucucauuggugguuuuguuuuuuuaauaucauccuauccaguuuauuccuuaacuugcauaaugguuaucugaaaucacuggaauguaagcuuccucaggcuuaauuacuagaauggcugauucuucucuauccaaucuuuuuaaauuuauuuuuuaauugacagggaaaaauagaauauauuaugauguacaucacaauguuuauauauguauauauuggaauggguaauuuauuaacuguagucaccauaguguacaauagaugucuuuaauuuauuucucuugucuaacuggaauuguguggcaaagucuuuaucucucugcauuucugaaggaaacauuuucuagguaaaguuuucccaguacucggaauauaucaucccacccucuucugaccuguaaaguuucugccuuauuggaauuuccuuguaugugguuugcuucuuuuuuguuguugcuuucaggauucucucuuugucuuugauauuugacaguuugauuguaacgugucuucauauagucuuguuugaaucuaaucugacuagagaucuuugagcuucuuguacguggauauuuacaucuuucuccagauuuggaaaguuuuugcuaucauuucuuuaaauacacuuucuuccauuuugucucacucuucuucuaguuacccauaucagaaauuugguaaucaucuuugaauccucuuaguccuuuaccaaacauagcuaauuauuuacaaaaucaugugccuucuaucuucuaaacaaauccuguacauguuccuuccucuucauuccuacugcaauuucccuaucauuuguaggauccaucuacgaaauaaaucauaaauccuacaauuuuuuaaaacacaaaauuauaaaacaaacaucuaggucaugaaauacaauauugcugcuauccccacaaaacacauguguuuauucucaaaugaacucuuucuaagagguagccacuaucuugucuuuuauuauaaucauguccuuacuaaccuuuauacuuuucuuccucuguaucccuaaacuauauaaguuaauuuugcccauuuuugaacuuuauguaaauaauauaauacuguauauauucuuuugacacuuaccauuuuacuaaaaauugucuuugugauacuuauucauauuguuguguauagcuuuauuuuugugaaucuucauugucacaugguauuucauuguaugaaaauagauuaucaauuuuacugcuaauggaaauaggagugauuuaugguuugggucucucuccuccugguccuuuuuuuucuucuuuucuuaucccucugucuuagcaucuuucucccuggacucuuccucugaagauccuuccccugugucucuuggucucugccuuugugucucucccugugcuuucucagacucuuuuucucaauuccaaucucuucuuucucaauuccagacucuuaucuccaccaaaagcuauauuagaaaucccagaggaaaaaaaauauauaucaucuucagugaaauuguuuucuggcucugcuuaugucacuauaucucucuaguuuucaucaccgucuccaagaaaaugagacaguuuaacuguccagauacuguggcaagugcacauccuacuuggaaaaagauguggugggaaagggagaaauuaugaauagaaaaaaauagaagaacaaauaucuaguaaauagcacaauaaggaaauuauaaaauacaauauucuaucaggcugaaggaauucuaaaccaaagccaugaggcuggagagaagagggagaaaagaaaaagcucugugccacuagaauuaaauacuaagcauuagacucuugcacaaaugugaaaucugaauccuucagaaggaaagcaauacccugaacuauguaaaaaauaaaaaugcaacucaaaggacuaaacaaccuuaaaauuuuuagaauaauggauaguaaaggacuuuaacucuggagaauaauauaucacuauuacuagaaauucaagcuaaauaugaggcucaacccaaaguuaaagggcuaaagcuuugagaggaggggcauagaauuguaacauaugccacauucugguaggugaguauaacucacauuauaacuuuucaagguucccaugcauuucguucaggauuuuuuuuuuuuuuuuuugaaacggagucucacucugucgccggccuggagugcaguggcacgaucuuggcucacugcagucuccgccuuccggguucacgccauucuccugccucagccuccugaguagcugggacuacaggcggccgccaccaugcccggcuaauuuuuuguauuuuuaguagagacgggguuucacuauguuagccaggauggucucgaucuccugaccucgugauccgccugccucggccucccaaagugcugggauuacaggcgugagccacugugcccggccuguucaggauuuuuaguugcauccagugggacacacagggaaauguggcucacuccaucuuaaacaucuuaauaaucagaauuucaaaaggcauauauugguuuugaaaagacuauacuacuuauccacuaauauagcaugagaacacucuuuuauccacaagcccacuaguaauuauaauuuuggcaguuugauggguauaaagugcuauccuauuguuauucuauuucgcauuucccuguaggauagugcaauuggaauuuuuuaccauauuuuugaccauucagauuugugguauauauaaauauauacacauguguauguaugcaaugggcugaauuguguucccccaucccaaauuuauaccuugcaguccuaaaccccaguaccucagcaugugacuauaccuggagauaguguuuuuaaauagguaguuaguuaaaauaaggucauuacggugggcccuagcccaacaauacugguaucuuuauuagaagaggagauuaggacaaagauauauaaaggagaaaccaugugaagacaagggagaaagccaucuacaagacaaggagagaagccucagaagaaaccaacguugcccacauccugaucucaagccuccagaguuguaagacaauagauaucugcugguuaagccacccagucugcaguacuuuguuauggcagcacuagaagacuaauacaauguauguauguguuuauauaugauuauauaauuauagagaaaauaugucuuaaaauauguuaccugggcauggaaugguuggugaaaagauguaauauagaaggagauagggaauuaaaagggagagggaaaucaaguaaauauugaaaggaaaaaauggugacuggauuuuuaaaauauggguuauaugaucacguguguuugaguaaaaauuauacauuuauagguaacauaauuguuaaauuuaugugcacauacaauucauucauuaucuggacaucacuuugauuacaucaauuuuucuuuauucaccacccacuggacuuaagugcugcuuuacucacugugcaugauguuggaggcuuggaacucuggauccucaagcugcacuccagcuggauuggggagaaagcguuguauauucucugugagguaccagcuucgguucucaucaaauacagaaaacaggaugacauuccucuugucugacauuaucuguuaauuacauauauugaaagggguaaagaaaugcuacugauguugucagguaggagcuagcagucuaugaugaaagcgauggcaugcaugugauauaucuaauccauugguuuaauuccauuuccucuuaggcauguaccagggcuugggaguugagggugggugcuaugagcagugaguauaugcuuacaacaaauguguccccaggacaagagggugacugaucccacugaacuuaguuuuuucugcacccaaggccauaugcuagcugauuuauuugguacagucuguagccuuauucucuucauguucagauuagaagauuuaacuccuuaaagaaccaagugguuauucagugccuuucuuaaguuaguuaagucaaaugagauacugacuuuccuaaacuuccaucuagcaacugaccuuccacaaggcuauaaaaaauuaaaaauagaaaaacagaaaucaaauaagaaagauaaggugaaccacaaaaaugucaaacaacacuaauaccuuaaauuuucuguuuaaaacauucaaauuuuuuucagaagagcauuuuguauaugaaccagauuuaugaauuagucgcuugcuaauuggaucugcuaagauuucauauguaaaccucacuaauauguauaaaccucauuuuuuauaaccuauagcuauauaaaccaaaauacugaagagaggagauuggagaauauagaauaauauuucaguucucuucccaaaagugacgaaaaaacuauaguuaggaaaaaucggucaggacaaguacuuggcaaaauuuauacuucucugaguuuaugugccauguguuuuauuggcaccaaaguucauauacuuuacucucuaaacauaugaaauguuuucagacuaguagggaucuuauguaucauaaauauaaucaaauggacauguagucaagccucagcaauauggcacugaguuauucuggggccgagcaaugaguuuuugugaagaacuaagcuuuucuuguucagagaauuuagcuuuauuuuuuaaagcaguagaaaugguccaaauucuagccauauuuugaaauauuuuauaucuuucccuauguuuugcccaaaaguauuuauuaagcuuuuuuuuuuuuuuuuuuuuuuuuuuuugagacagggugucgcuuugucauccaggcucacugcagccucgaccuccugggcucaagcuaucuucccaccucagccuccugaguaggugggacuacaggcacacaccaccaugcccagcuaauuuuuuuuuuuuuuuuuuuuuuuuguagacaaggucuuacuauuuugcccaggauggucuugaaauccugagcucaagcaauccuccugucucggccucccaaagugcugagauuacaggcgugagccaccgcacguagccuauuaagcucuuacuaagugagaugcacugugcuauauugugggaacuagcccccaauauuucaacauagguucuuuucuauuuuaccuaagugucggccggucugggaaauaaagagaaagaguacaaaagagagaaauuuuacagcugggucuccaggggugacaucacaugucggcagguucugugaugcccccaagccgcaaaaccagcaaguuuuuauuagugauuuucaaaggggagggaguguacgaauagggugugggucacaaagaucacaugauucaaaggcaauaaaauaucacaaggcaaauagggacagagcaagaucacaagguagggcgaaauuagaauuacuaaugagguuccauguccugcugugcaugcauugucauugauaaacaucuuaacaggaaacaggguucaagagcagagaacuggucugacuagaauucaccaggcuggaauuuccuaauccuagcaagccugggggcacugcaggagaccagggcauauuuuaucccuuaucuucaacugcauaagauaaacacucccagagcggccauuuuagaggccucccccugggaaugcauucuuuucccagggcuguuccuugcugagaaaaagaauucagugauauuucuccuauucgcuuuugcaagaagagaaauaugacucuguucugccuggcccugcaggcagucagacuuuaugguuaucucccuuguucccuggaaaucgcuguuauccuguucuuuucaaggugcccagauuucauauuguucaaacacacaagcuuuacaaacaauuugugcagauaacgcaaucaucacagggucuugaggcaacauacauccucagcuuaugaagaugacaggauuaagagauuaaaguaaagacaggcauaggaaauuauaagaguauugguuggggaagugauaaauguccaugaaaucuucacaauuuauguucagagaucgcaguaaagacaggcguaagaaauuauaaaaguauuaauuuggggaacuaauaaauguccacgaaaucuucacaauuuauguucuucugccguggcuucagccagucccucuguucggggucccugacuuccugcaacagugcuacaugcugcagacauguuaauuuugagguacuuuugagucacccauaaugagauguccauggaagaaaucuaggcuguagauauaaaucugugggucaucugaaaauaggugguaauuggacauauaaaaauggggaggaucagcuagagagagcuaaaucccagacugggaaugaguacuauaggaaaaaucuagggccuacauucuauggccuauccauccagcaggcacguuuacuacgugaaacucaaauuuaguaaaagcuaagcucauuucuuuuacugaccuauauugcaaaccauuauauuuucuucagguuauaaggggacauacacugagaaugaaacccagcacuuggaaaggcaagaacucaccugguuuccucuuugaucuacagauucuuuguagcagaugaggagagggccaaugaguccugaagcuagaucucucuccauauuaacgaaacuagaguaauagcgggucaggcaccgaggaucugauuuaguuggcccaucuucuacagucacuguccauuuauauuugaauauuucuccuggcagaauuggaaaauccuucaaauguuuuacaccuacccacaagcaaaaccauaaauagcucaauuagaguacaacaagccacauauugauaaucauguuguuguugcaaggguucuacaaaucuguauguacauaugaaguuucugagcaaguggaagcuaaagucgcaccuauuauaauuuuaagauucaaacaauuuuuuuaaaaaguaaaaagcuguaauugauuauccgguugacugugaaagugucaggccugaauauaugccaaagagcuuggcauuggaguuuuaagguguagucucugacuucugugaggaaagggagcaagaacugagaucugcccucaggguaauggguccucaggacaagaacugauuuuaguaauuaagucucauucuggguauguuucauaccugaagauacaaucuaaaucaaaauuuuaauuuuauauucauucuaagcucuuccucaccucaguaaguuaugccugaccuaugguuagaggauccauagaaagggaaugguguugaggugaggaguucgagaccagccuggucaacauggugaaacgccaucucuacuaaaaauacaaaaauuagccaggugugguggcaggcacuuguaaucccagcuacuugggaggcugaggcaugagaauugcuugaaccugggaggcagagguugagccgauaucaugccaaugcacuccagccugggggauagagcgagacucugucuccaaaaaaaaaaaaaaaagaaagaaagaaagaaagggaaugguguaguauguucuuucaauauuucugagccuucucuucccuuuuccaggagcugggggugagggaggguagguaauagaagaaagggcaaacagacucuuguuuaacagguccugcugcucuaucuuugacaacacuauuuggucaucaauguucucugugugggaggugcccaaaugcuggucuuuucauaggacacauguaugguuucuuuagaguuaccauggggaccucagcauuacauaguuccaugacaugagagauguuucuuucagcuauccuucugcaacucuccucuccccaucagcucuucuuacuuccagugauauauccaagacucuauugguucugcuauccccucagccugccuaacugccuucuuggguagaauaucuucaaaagggauaaagcccagcuacuuucaacaguauucacuuguuacagaauaaacucaugucaaacagcaggaagguaaacugcuccacucuugcccucucuucuugcccacuauuaugggcauuacagccuucaaaauucuccauggaaaagcagguuaccaguaacuauccacguaugccuccaaauuucgggacacacauucaaaaucuccccagaacucugucacuaugccauucuuccauaaagaaaugcaaauaaagaauucuuaucggcaauaaugaauauuagaaaacaggggaaggaauuuuuuuugagaugcagucuugcucuguugcccaggcuggagugcaguggggugaucuuggcucacugcaaccuucaccucccaguuucaagcaauucuccugccucagccuccugaguagcugggauuacaggcacacgccacaaugcccggcuauuuuuuuuguauuuuuaguagagauggguuuucaccauguuggccaagcuggucuugaacuccugaccucaagugaucugcccgccucggccucccaaagugcugggauuacaggcgugagccaccgcacccagcgggaaaauuuuuauaaccagucugucugcccaucaugugauacugaaggauucagaaaguucacccucuauguaccacauauuuagaaguuacuugagaauauacuuccagaaaaacaaaagaagaaaucaaaaaauagaaauguacaagggaaaaguaguuaaugcuauucacuacaagaaugucuuuaagaagaaaaagauuugguuccagcacuuugggaggcugaggcaggcagaucgcuugagcucaggaguucgacaccagucugggcaacaaguuaacaccccauuucuacaaaaaauaaaaauaauaaaaaaaauuagcugggcaugguagugugcgucuguggucccaacuacucaggaggcugaagugggaggauagccugagccugggaggcagagguugcagugagccaagaucgugccacuguacuccagccugggugacagagcgagacgcugucucaaaaaaaaaauaaaagauuuggauagcaagcaauacauagaaugauuaagaagcugaaaggccuaagaaauaggguugaagaagccuacauuucuuuuccgaauaaaagaaaacaaagucuuacuucaggauacaccuuuguguugggaacauuccaaauccucucaucuagcuauuugaaaauagaugucauuguugacuacagucacccuacagugcuauagaacauuaggacuuaugccuccuaucuagcuggaauuuugcauccauuaaccaacgucucccuauuucccccuccccuuccccucuuuagccucuaguaaccacuauuuuaucucuacuucuaugagaucaacuuuuuuccuuccacauauuauuuuaucuuaauaguaaaaucacuugagcuguagaaaagagagcaaucauagcauauuacccaguucugcaguuaacauuuaugaaaagaaacuugcuaaaauacuaaaauaauacaaaugcuguuuuuuaauuuuuuaagcuuuagagaaaauauauagacaaagcaaggaagaguuauuucaaauuacagcacaaaauguaaauguuaucaaguuuaguuuuguaaaaguaaaggaauggcuagcagcaguagagaaaagaaagguuuggggaaaggaaaagugagggguacaguuuuuaauauccuuaauuuaugaaguauggagucaaaagauauuuucaauccaugauuggaaaauaucuuacuaaaaguugauguuuaguauauuuuuaaaguucuaaugauagccaauccaacugaaaacacugauaaaacugaaacaacuugaauggaaaaaagcacaaaacaaaguaaguauauaaugucuaaaguugaaaaacaaagaguuagcaguauaaguaacuuuuuagagauguagagauaaccaccaaaaaucaaaaacagaaauucuuaaaaauggaugccucuagggaggcagcccuuuuguaguuuuaagcauacacaucuauuauuuugauaaauauucauccaaaauuaaauaauagaaagaauauacauaacauccaaucuacuaaaagaaaaaauaaaucuuuaaacagcaaacaauauaguaaauaaaaacuggaguugugaacuauuuagaaaugaauaugcgaagaacccugaaaauaucaaacuagauaccaaaagugagagugaaacccuguugagagagagagagagagagagcaaggaagagcaauaacauggaagcugcagcaaagaauccugaaaauaucaaacuaguuacccaaaguguggaauaccacacuagauaccaaaaguguggaauguagcugaaaaccguacucagaaaaaaaaauuaucuuaagugccagaagaaccagcuucaagauuuuagggcauuuacaguaguugcaguggaaccaauugcaguggaaucuaauuggcuguggaauauuugaacaucaccgcuagguaauaggaaaaacaugucaggcgacucuucacgaauuuacaugaaacaucaccugaggauuccuauaauugauuuuuauaacuuuagacuggagcuugagguccggccaacagcuggagaaaggaccaacauaauuuuaguuguuauugaugauauuuaucucaucuguaucuacagguaaaaaagagcuauaaaucgagggaauauuuaccuuuugguaaucuccuugaauacaaaggacggacaucagugauuccgugaggguagauguuauauggucugcuugcuugauucuuaaauauaaucugaaaguauaagcgagaucuaagaucaaauccuaaaacgacuaggaucaacaagaaaacuguggucuaacuccagauaaauaaaaguggccucuaucuacauuauaguaauuugaggcuagauaaaacucaaaauauuuggucuuuucaugaaauuguuccuuggcaugcauggaggauugguuccaggaccccugcagauaccacaaucugugaugcucaagucucuuacucaaaaugauguaguauuugcauauaacauaugcacauccucucauguacuuuaacucgucucuagauuucuuacaguacauaauauaacauaaaugcuauguaaauaguuguuuuaccguauuguuucuuuguauuauuguuuauuguuguauuauuaucuuuuauuguuuugggguuguuuuuugaauacuuucaaucaaugguuguuugaauaugagacuagaaauccagugauacugaaaaauaaaaauaaaaucuuaagcauccccaaacgacugaagagaccccuuucucggccaaggagaccccagagauggcuuaaaaacugaguuucugaccaugaugggaugggagaucgggcaugccuuguuacauucccucccucccuaaucugccguuagacuuucuuucuuaaggguuaaacauaaaccaguccuuucuaaagacgugguggauuccccucccuuugugcaguuuuaucauaacaaccgagaagcauugcuuccugaugagagaccacugaccauggacuggcucuggccaguuuacagaggcugccucuguguccucuguuucaucuuuugacauauacagccuaauuuucaugcaucuaaauguuaagucuccaccccaaagugaacauggaauguauguaacaugugugguugcaggugccccaucauaaauauucacagcuccuccuggaaccuguuaaauauguauacuuagccaacucauucagcauaaauucuuaucucauccuuccuucuucaaagugcuugcuuccauuugcugccagaggcuacacuucccagccugcaacccuuuccacuccaaauuuacaaacuuaggauucuucaguugacaauguagagggcugacaguacuuagguuucucucuaaaggccccuuuccacuucuuuaaaaauuguuucaauugcuucaggaaguauucucugcaccuucucacacuaauugaaauuuagaugccuggugaggacacugcuuccucucagccuuuauuacuauuugggcauuaaauucacugauaauagagaaagagacaguguuucaggagauaaaaucuucagugcaugagcaggcaugaccaagaggacaguugauuacaguauuaagcaaggguagcaggugguauugccugauugcaccagcuuuaaaagaaaacaaaggccuaggugcaguggcucaugccagcacuuugggaggcugaggcaggaggaucguuugagcccaggacuucaagaccagccuggguaacacagugagaccucaucucuacaaaaaauaaaaaaauuagcuaggcgugguggugcaugccuauaguaccagcuacuugggaggcugaggugggaggaucacuucagcccaggaaguugaggcugcaguagugagcugugaucacaccacagcacuccagccugggugacagaaugagacccuaucucaagagagagagagagagacagagacgagagagagagagagagagagagagagaauggaagagcaauaacauggaagcugcagcgaagaacccugaaaauaucaaucccaccuccagaucugaggugugugauaugaggauaaaaaugcaacuuccacuucugcucuugucuuaaaacccagucauucuuccuauccaugagcauggaauguucuuccauuuguuuguguccucuuuuauuucguugagcagugguuuguaggucuccuugaagagguccuucauaucccuuguaaguuggauuccuagguauuuuauucucuuugaagcaauugugaaugggaguucacucaugauuuggcucucugucuguuauugguguauaagaauguuugugauuuuugcacauugauuuuguauccugagacuuugcugaaguugcuuaucagcuuaaggagauuuugggcugagacaaugguguuuucuagauauacaaucaugucaucugcaaacggggacauuuuuuauggcugcauaguauuccaugguguauaugugccacauuuucuuaaucagucuaucauuguuggauauuuggguugguuccaagucuuugcuauugugaguagugccgcaauaaacauacgugugcaugugucuuuauagcagcaugauuuauauuccuuuggguauauaccuaguaaugggauggcugggucaaaugguuuuucuuuuguugcuuguugguuuugguguccuauccaauaaacuauugucuaauucaagaucacaaagauuuauccuguuguuuucuuauaauuuuguaguuuuagcucuuacauuuuaucuuugauccauuuugagguaauguuuaaguguaggauucagcaugguauccagaguauaaccugaauaaaucaaagaaugggguagaucuauauauguugacaugaaaugauauccaaaauauauuguuacuuuuuuuuuuuuugagacagagucucacucuguugcccaggguggagugcaguggugcgaucucagcucacugcaaccuccgccucccagauucgagcgauucuccugccucagccuccagaguagcugggacuacaggcaugugccaccaugccuggcuaauucaaaauauauuguuaccuuuuaaaaaucaagguacagaccaauuuacacugcucuuguuuuugugugaaaugcacacacacacacacauacacacacacauuuguacauguaugcacuacuucuggaggggaguauacaaacccacagcaaugacugucugucagacuaugggguuggaaguccaagagggaggaaaauuuacauuuuauugcaugcucuuguuuaucuauuuuuaaauuagccaguaaaaguaacucaaaauacacaaaaaguacccuauaaauauguaaaauuauugugucauuaugcauuuuaaaaauuaaugaauaaaaaauaaaauuauacaaucuucaaaaaaugaaaaauagaaaaaauacguacacaaaauuuaugaagaaaaauuguacaauaauagcuaauaaaaauuuugaagaaguacaaugaaagaagaugucauacagauaucaaacauaucacaaaguugaagucauuaaaacagggugguaacagauuaguuaaggagaauuaaaaaucccagauuuuagcaauuuaguauaugauaaagaagacauuuucaaauuaaugaaaaaaggauugguugugucagcugccauuugggaaaauuucuauuugaauuaugcacuacauucaaaaguaacuuccagggcaauuagauugcucacuguaaaaauaaagcuauacaaguaagagaauaaaauauagacuauuuuuguagugucuuggggguggcaaagacauucucaggcagaaaacauaagugaaaaagauccagagacauauaaaugaaaagauugauaaaagauaggagguuuugacuauauaaagaugaaaaaucuuugaaggacaaaaaauaucauaaaggaguuaaaguacaagugacaaugugaggaaaacauuugaaagauaaauaacaaugugucaauauccauaaucuauaaagaccuuuuacaaauacauaagcaaaagaugacugaccaaauagaaaacuggacaaaauuuacaagcaggcaauucacagagggaguuauacaaauagccaacaaacaugaaacaauauacaauuugaccacuaaccagggaaaugcaaaugaagacaacauauaaacauuuugcucaucaaauuggaaaauuuucugaagguuuauaauauauguuguuggcaaugguguggggaaaagggcagucauauacuuaugguaggggauauaaauugguacaaaauugcugaaagucaguuuggcaguaucuaacaaaacuccauaucuaaaaaccaguguucuucaugacauucuucagcggcugaauuuauggaaccaacgaccaaucuucaaauuucuugugaagaaaauaaacccuuauuuauuuaaaccacuguccauugaguauucuguuacuuacaccauacucauucuuaauauccuagaucaggagcaagcaagcauuuuuuggaaaaggcuggauaguaaguacucuaaaauuugugagcccuaucuagccucugucacauauucucuugcuccuccgccuucuccuccccuuccucccauccuccuuucuuuucuuugcaauauuuuaaaaauguaaaaucucaucuaagcucauggacuguucaaaagcaggccacaagccaaauuugguucacaggccauagucugcugacuccuauaugacauaauuaauggagaaagaucuggaaggauauguaucaaagucuaagcaguauuucaaaggagugucgaguuuagugggugacauuaaauuuuuauucuauauacucaaacuuuaaauacauacaaucagcuauuauuuguguaacauuuauagcuuuuaaaagaucauguccauuggagacaaggcugaauuaugagguauuuuagaaacucaaaacucuccagacuuuuucuucuuaccugaccuuaaaucuuuucuucaacuuaccaacagugugucuccaacuuccccauaaaguaaaggucccaagauuccugauucaugcugaauagcuucacgagucuuaaagguuucaucuguguaugccauaaaucggacuuuuuuguacuuccuaccaauccgcugagggccauuguucaaauauugacuuuuauaacuucuguauaagagaaaaaaagaugagagguugggaagaaaaauucuagguaggcucaaauccaacucuaaaacagcuuauaugauucaaucaaggcaaggagugagaaaaauacaagcuucucugaugcucagcuauguuaguuuccaaauguuaauacccuugccauuugauuccauaccuguaccuaaccuuaaacauggcuucaggauuuguugguuugaauaacugguaagaacuuuuugaguauggggaagagagaguaccaauagucaaaaagugcuuaccugucaucgggggcgaggacuaagggagcauagucccaguccuccucuucagcagcaauguaauguacccaaguuuuaggaugcuucuuggcaacugagcgaauuuggauaaaggaaggagaguugucaucaucaaaccugaccacauccauuucagaaucaguaagaucaucaucauagucuuccgcuucuucauuauuuuucauucguaguugggguuccucuggacagcugucuacuuugacauaagcuuccaugccaucuggagucagacaaaccaaacaaugucagagugucuugcuauauuaggcuguucuauaccagagacuagguaauuuauaaagaaaagagauugaauuggcucauguuucugcaggcuauaugggaagcauggugcuggcaucugcuuggcuucagggaggucucaggaagcuuacaaucauggggguaggugaagggggaggagacaugucacauggugaaagcaggagcaagacagagagugcaaguugccacacacuucugaaugaccaaauaucaugaagacagcaucaagccaugagggauucacccccaugauccaaacaucugccaccagaccccaccuccagcauuggaaauuacaauucaacaugagauuucagugaagauaaauauccaaaccauaucacuugccuuaacuuuuaugacuucuuucucucuuauuaggccuuccaggcucuccccuaaguacccccccuuuccacaucacuaucccuucuugccacaaaucauugauuuaauaacagcuuauugggaaaaauguuaguguagauauaaacuuuaagacauguuccaaguucauaaaaccaugacaagauacaacuuaaaaucaaggagauauauauuuuaagagcaugucugccugugacuaguuguaaacccuauggcaaauguauucaacauucucagucucaucuucaugcuuuguaaaauggauaauaauaauuccugcccuauuuauaccacagggcaauuuugaagaucaaauacuucuaagaagggagaccuguuuacuugauuaugaggaacagggaagguuuuaggagcagcaaacaacuagucugggguucauguagccuuaaacauaacucagucugcaucgaaaaacaaaguguuuggucugagguucaauaagauaaagcauuuuuuucugaaaaauaaagauuaaaauuaguggauagaaucugugaaaaggagaaaaacaaaacaaaaaauaaacugaaucgggguccaacuggacaaugauugauugacaaugaucauauacaaguaaaugaccuauuccucugugccugcaagaauguuguuugugcaucaacuuccuguuacucauucaguaugacacauuuuguccacuaaggucuugucaaaauuccauaaauauuaugugacacauggggaagagagauuucuauucuuaaucacuacagaagacaauaaacaaggucacuaauagaacauaaggaggaaaaugguggaugcauggcaagaucaauucucuuuucuaagucaaccaaggaaccugaggagaagguuaauaugagaguaauaggaagaaagaaaugcuauuaaauauaaaagauuaggccucuccgacauuuuucuccaauaacucuugcuaugguuugaaugucuguccccuccgaaacucauauugaaauuuaauuaucaucgugaugguauugagaggugaacauauaaaagguguuuaggucauaagcguuccacccucaugaauggacuaaugcaguuaucuggggaaaguguucaugggaguggauuuguuaucacaggagugagcucacccuccucuugcucucucucacccuuucuuugcccuuuugucauauaaugccuuccaccauguuaagacgcagaaaaaggcaacuugauauuggaccucccagcccccagaaaugugagccaauaaauuucuguccauuauaaauuacccauucugugguauacuguuauugcagcacaaacugacuaagagccuucaauggccacgagagggguagagaaagaggguuauuagguugauccaagauuaagaguuagcagaauaaauacaaaaguaaggaaaauuggggugaaaugaugaugcaaucugaauuugcacaacuagcaguuacaaauaaaguuacauuaacaauaauuuaaaacuguaguuaccaucguccuaauuugcuuacacagaaccuuugacccuuuccaaaguucccaccaaauaguccuuucaaucccauguuacuucuaaaauucacuagcuccugaccugcccucaguuucacaggugucucucaucuacugccagguaucuacagagugccucuggcugucuggugucugaagucaagcucuacaauagccugucauauuugcuauuuacugcucugggcauuacuaaugauauaguggagcccuuacaguugcaaucuggacaaugccuuuuuuucccauuucccuagauuucuccaaaaaaaaaaaaaaucucuucagcuacaacuugcaguuccucucuccauaauauuggagcguaauuaaugggauaaggcugagaaaccaagggcauacuauucuccucauuuucccaccucaaucauccauaagccaucuuuucuccaucacagacauuuaacuaaaaauccaugaguccuacuaauacucaagcccuuuuauagucaagguaaaaacuuuacacuggaagcuggaaacuaggggaucuuggcugaggucuaauacaguaacucuauaauguccccuucagcaacacacuauauuccuguacauuguccaguaaauuuuauuaaaaguaggacuggauauuuauaauauucauuuuaaagauccaagauauuaccauguuggugggaagagauaugacaaaacaguagaaacuguccaagguccaucaagaguguuugagcaguaaggaaaguuauuggcgagauuuccaaggacgccuggcgaugguuccucacaagaaaugugugaccuucgaggaauauugagugcacuucaggaguggugcccauuccaaucacaugccaauagacugauuuccuguggcauccaaucagaccuguaaaguaggaauaagacaccuauggcuaugaaguagagaaucugaaauggaaaacacuugcuaggacagaauggacaaauugacuuuagacacuuuauugcuaccuugacuuguaaacaaauuuaucaagaacauugggcuacuaucaaaccaacagcucuugccaaggucaccaaucaccaucaugcugcuaaauccaauggacauuuuucagucuuuauuugcaccuguugaccauucauucguuuuuaaaacucucucuucccuuggccucugugccaacaucucuguggguuuuuuucuccuacuucucagacugcuccuucuucugucuccccugcugaccucuucuggaacuccaggcucauacagccaaucacuuucucaacaucuccaccuagauaucucaaaaaacccacauguucaaaaccaaauuuacaauuuucaucacuucauucucuuccagaguuuuuuauaacagugaauggcagcauccugcauuugaauaugcaagugagaguuauccuuguuaccauucucaucucccauaugcaguuugacacugaccagggcaauauaaucaauaauagcuaauauguauugagcacuuguuuuaugucaagcacuguccaaaguauuuuacaaguuuuaauucauucauuccucauaacaacccuaugaauguagaaaccauuaucauccaugucuugcaggagaggaaacggaugcccagagagguuaauuaauuugcucaguauuugaacccaaguagucauguguucagaucccacacugguaacaacaagggcacagcugccuccuauuuuggcucuaaaagcuuucaaauguaucuaguuuuucacuguuacuacuaccacuaucuuaauccaaguuaccauuaucucgucugagcuacugauaaacuuuuuuuacaggucucccuacaguuggucauauucuccccucuaagacuuuuacccacaaagaaacugguguacuauuucugcauuccagaucugauuguaguauccgccagccuaaaacccacuggaggcugucauuccacauagaauaaaguccagacucucuacuaaggacuagaaggccccaauagguuugauuccuaauaccucuaacagcuucaucucacauugccucauuuucccaguuucaaagcuaaguucaagggguacuugcuuagggaagccuucucugauuccccagucuaggucagauuccuguauuauaggcuuacauagaauuauguaauuuuccuucagaguaaugcucaguuuguaauuuugcauguauuauuaugcuuauuugacuacaaucugucccuccacuauaagguaugugagaacaggaacuugcauguugucaaaauuaauuuccuuuuuaauuauaaaauuaugcauguuuauuaucaaauuauugaaaaauacggaaaagaacuaaggagaaaacaucccccucauacuucauuauucucuuggguugcugaaucucccaaauuccucuuuuauguaguuucugguuuuacuauaguacacauucagugacuauuaaggcccucuauauaugaaaaugucuuuuuucuucccccaaaauugauucauaguuugacuaaaaauucuagguuccaaauaauuuuucccuuagaucuuuuacaauauugcuuaauuauaucgccagucuaauucccauucuuuuguaugcguccuguuccucucagaagaagcuuuaaguaucuucucucugugcucugaaaugccacaaugauaauuuugugugugggucuuuuuauuuauccuaaugggcaauuuuauuuuuuuaacuguauuacuuuuuauugacacauaaauaauucuacaaauuuauggguacaaugugauguuucaauacauguauacauuguguaauuauucaaaucaggguaauuaucauauccaucaccuuaaauguuugucauuucuuuguugugagaccauucaaaauccucucuucuauuugaaauauacaauauauuauuguuggcuauugucacccuacugugcaauagaguaccagaacuuauuccuucuaucuaccuguaacauuguacccauugaccaaucucuccccaucucccacuucccccuuaucuuccuagaaucacuaaucucaacuacuaugagaucaaauuuuaaagauuguacauaggacugagaucauggaguauuugucuuucucugccuggcuuauuucacuuaacauaauguccuccaggcucauccacguuguugaaaaugacaggauuucaucuuuuuuaaauggaugaauaguauuccauuguguaucuauaucacaguuucuuuauccauucauccauugaugggcauuuaaguugauuuuauaucuugacuauugugaauaaugcugucauaaacauggggaugcagauguuucuucaacaugcugauuucauuucuuuuugguauauacccaguagugggauugcuagaaaauaugauagaucuauuuuuaauuuuugaggcaucucuauaccauuaucucuaauggcuuaacuaauuuauauucccaccaacaguguauaaggguuucuuugucuccacauccuugcuagcacuuguuauuuugucuuuuuuauaauagucauucuaacagggguaagugauaucucauuguaguuuugauuuuaauuuuccugaugguuagugauguugagcauuuuucauauaccuguuggccauuuguaggucucuuuuggagaaaugucuauucaggucuuuuguucauuuuuaauaggauuauuuggacuuuugcuauugaguuguuugaguuccuuauauauucuagauaucaaucccuugucagauguauaaucugcaaauauuuucucccauucuauagguugucucuucacucuguugauuguuuccuuugcugugcagaagcuuucuaguuugauguaauccaauuucuuuauuuuugcuuuuguuacucaugauuuugaggucuugucuaacaaauucuugcccaaauugaugucaugaaaugcuuacacuauguuuucuucuaauaauuucagaguuucaggucuuaaauuuaauuccuuaaucuauuguucuuuucuuuucuuucugucuuucuuuuuuuuuuuuuuuuuuuuuuuuuugagacagagucucacucuguugcccaggcuggagugcaauagcacgaucuaggcucacugcagccuccaccucugggguucaagugauucuccugccucagccucccaaguugcugggacuacaggugugccaccacaccuggcuaauuuuguauuuuuaguaaagacgggguuucaccauguuggccaggccggucucaaacuccugaccccaagugaucugccugccuuggccucccaaagugcugggauuacaggcaugagccacugugccuggccuauuugacuuucauacguggugagagauagggggucuagguucauucuuuugcauauggauauccaguuuucccagcaccauuuauugaaaagacuguucuuuacccaucauguauucuugccaacuucguagaaaaucaguuggcuuuaaauguuuggguguauuucugggcucucuauuuuguucuauuggucuauaugucuguuuuuaugucaacacaaugcuguuuugguuacuauaacuuuguaguauaauuugaaaucagguagugugaugccuccagguuuauucuuuuugcucaagacuucuuuggcucuuugggauuuuuugugguuccacacaaaucuuaggauuguuuuucuauuucugugaagaaugacauuggaauuuugauaggaauugcauugaaucuguagauugcuuuggcuuuaauaauauuaauucuucaauccaugaacaugaaauaucuuuccauuuauuugugucuuauucaauuucuuucaucaauauuuuauaguuuucauuauagagaucuuucacuuccuugguuaauuuauuucuggacauuuuuuguagcuauuguaaacgugauugcuuucuugauugcuuuuucagauuguucacuguuggcauauagacaugcuaucaauuauuguauguugauuuuguagacuacaaguuuacuacauucauuuacuagcucuaacaguuuuuugguguaguuuuggcaguuuucuauauauaagaucaugucuucugcaaacagggacaauuuguuuuguuuguuuuuguuuuuguuucgagacaguguuucacucuguugcccaggcugcagugcaguggugcgaucuuggcucaccacaagcuccgccucugggguucuagugauucuccugcuucagccucucgaguagcugggacuacaggagcgcaccaccaugucuggcuagcauguguguguguguguguguguguguguauuuuuaguagagaugggguuucaccauauugccaggcuggucucgaacucuggacaucaagugaucugcccgccuuggccucccaaaguucugggauuacaggcauaagccauugagccuggccaaacagggacaauuugacuuccuucuuuccaauuuggaugucuugccuaauugcucuggcuaggacuuccaguacuguguugaauagaaguggugaggguggauaugcuugucuuauuccaguucuuaaaggaaaagcuuucaacuuuuccccacucaguuucaucuuguuuguagguuuaucauauagguaugcuccuucuauacuuuguugagaguuuuuaucaugaagggauauugaauuuugucaaaugccuuuacugugucuauuaaaaugauaauauaauuuuuguccuucauucuuaauuugcauauguuaaaccauccuuacaucacugggauaaaucccaccugaucaugguaaaugaucuuuuaaugugcuguugaauucuauuucuaguauuuuguugaggauauuggccuguaguuguuuguuguuauugugcuuuugucugguuuugggaucaggauaaugaucauuauccuccuaaaauaauuuuggaagaguuucuuccuuuucaauuuuuugaauaguuugugaagaauugguauuaguucuuuagauguuugguagaauucagcagugaagccauuggguacugaacuuuucuuugaugggagacuuuguauuuuugcuucaaucuuguugcucauuguugauuuguucaaaauuuccauuuuuucuugauucaaccuugguagguuguauguguccaggaauuuauccauuucuucuaggcuuuucaauuuguuggcuuauaguuguucauaguaguuucuuauaauucuuuguauuucuguguuaucaguuguaaugucuccuuuuucaugucugauuuauuucuguuuuucuucuuuauuaucacuuagucuggcuaaaaguuuauugacuuuuuuuuaucuuuucaaagaacuaacuaacucauuauacugaucuuuuguauuuuuuaguuucuauuuugauuauuugugcucucaucuguauucauucauuucuucuaauaauuugggguuuuguuuguucuuguuuuucuaguuccaugagaugcaucauuagguuguuuauuugagauuuuuuuuugauguaggcauuuauugcuauaaacuuuucuuuaaggacuacuuuugcuguaucccauaaguuuuggcauguuauguuuccauuuucauuuguuucaagaaauuuuuuaacuucuccuuuaauuucuucauugacccauuguuuguuuaggggcauguucuuuaauuuccauguauuuguacaguuguuccuccuguuguugauuuauaguuuuauuccauuauuggcaggaaaaaaauacuucauuuuaaaaaaguuaguuaagacuugcuuuguggccuaauguauaaucuccuggagaauguuccaugugcaguugagaagaaugugaacuguguagcuguuggauggaauguuccguaaaugucuguuugcucuauuuggucuacagugcaguucaaguccaguguuucuuuguugauauuuugucuggaugaucuguccauuggugaaagugggguguuaaaguuuucuacuauuauuucauugcugucuucauuucccccuuggucuauuaauguuugcuuuauauuagguuggugcaaaaguaauuguaguuuuugcccuuacuuuuaaugagacuagaaaauacaaagaucaaacauuaauauauuuaggugcuccaauguuggguguauauauauuuaugcuuguuacauucuccuguuguauuaacuucuuuacuauuauauaauggccuuguuugucaauuuuuuuuugacagauucucgcugugugcccaggcuggagugcagcggugcaaugucggcucacugcaagcuccgccucccggguucaugccauucuccugccucagccucccgaguagcugggacuacaggcgccugccaccaugcuugguuaauuuuuguauuuuuaguagagauggaguuucgccauuuggccaggcuggucucgaacuucugacuucaggugauccacccgccucagccucccaaagugcugaaauuacaggcaugagccaccacgucuggcuguuugucucuuuuuauaguuuuugacuugaagucuauuuuaucagauauaaguauagcuauuccugcuuucuuuuuguuuacaugugcauggaauaucuguuucuaucccuucgcuuucagucuauguguguccuuacagguaaagucuuucucuuaggcaguauguaguuagaucuuuuuuuaaaaaaaaauucauucagccacccuaugucuuuuuuuaaauuuuuuuauuuuuauuuuuauuauacuuuaaguuuuaggguacaugugcacauugugcagguuaguuacauauguauacaugugccaugcuggugcacugcacccacuaacucgucaucuagcauuagguauaucuccuaaugcuaucccucccccuuccccccaccccacaacaguucccagagugugauauuccccuuccuguguccaugugaucucauuguucaauucccaccuaugagugagaauaugcgguccaaauguccaacaaugauagacuggauuaagaaaauguggcacauauacaccauggaauacuaugcagccauaaaaaaugaugaguucauguccuuuguagggacauggaggaaauuggaaaucaucauucucaguaaacuaucgcaagaacaaaaaaccaaacacucuaugucuuuuaguuggagaauuuaacccauuuguauucaagguaauuuuugauagguaagaacuugguagugccauauuuuuacuuguuuucuaguuguuguguagauccuuuguuccuuucuuccucucuuaaucucuucccuugugguuaagugauucuucuaucaguauguuuuaaucccuugcuuuuuauuuuuaguguaucuauuauaaaaauuuuugcuuuguaauuaccaugaggcuuacacagaauaccuuauaguuauaacaaguuaguuugaacugauaacaacuuaauuuugauugcaagaaaauuuuuuaaaaaaucgacucccaaauuuuguguuuuugaugucaucauuuacaucuuuuuauauugcuuauucuuuaacagguuaugguaauuauuuuuaucuguuuuguuuuuuaaucuuccuacuaaggauauaagugauuuauguucuacaauuaccauguuagagaauucugaauuugucgggauacuuacuuuuaccuguggguuuuauaccuucagauguuuucauguuacacauuaggaccuuuuucuuucaguuugaaaaacucccuuuagcauuuccuguaaagcagaucagguugcaaugaauuuccucaguuuuuuuuugucugaaaauauuuuucucucucuuucauuuaugaaggauaauuuugcuguguacaguauccuuggcuggcagguguuuuuuuuuuuuuuucucucucucucauucucuccuggcuuguaaaguuucugcugagaaauucacaguuagucugauagcggcuccuuuacaggugacuauaugcuuuucucuugcuauuuuuaaauuuuuuucuuugacuuuugauaguuugacuauaaugugcccuggagaagaccuuuuugcauuguauuuauuuggguauuuuugagccuucuuuaucuagaugucuaaaucucuugguagacuuggaaauuuuucaucuaauauuucauuaaauaggcuuucuaaccucuucauuuucucuuugccuucugggacacugaagauucaaauauuuggucacuuuauagugccuaauaugucaugaaaucuuugcucauuuuuuaaaauucuuuuuucuuuauuuuugucugauuggguuauuucaaaagaucuguauuucaguucugauacucuucugcuugguccggucuauuguugaaccuuucaaaucuauuuuguauuucauucaaugaauucuuugguuccagaauuuuuguuugguucuuuuuugauaucuaucucuuggguaaauuucucuuucauagccucaauuguuuuucuguguucuuuguauuuuuuucagaauucucuuguaucucacugaguuuauuuaguaucaaaauuuggaauuauuuuuccaggauuucauaaauuuuuaaagagauguuggccaguuuacuuaaaaaccaauggucacauauacuguuuugcuuguaaacuaugauuuuuuuauuuuguggauacauaguagguguauauauuuauggaacacaugagauguuuugauacaggcaugugaugugaaacaaacacaucauggagaaugagguauguauacccucaagcacuuauccuuugaguuauuaacaauccaauuacacucuuuauuuuagaauguacaauuaaguuauuauuaacuauagucaccauguugugcuaucaaauagcaggucuuauucauucuuucuauuuuuuuguacccaucuuaaauuuuuuuuauuuggaucucuugcuacagaauuauugugcuccuuuggagugucauaguuccuugauuuuucauguuuccuguguccuuacauugauaucugcacaucugguguaauaaucacuuuuuccaauuuuuaaaauuugcuuuuguaggaaagaacuuuuuccugaagauguaucugugguguugcuuggguagagcacuucgguuuugauucucggugaauguaguagccucuguauaagauucuaaacagcaucagugauauuugugauuuucucaguggcuuagggugugguuauuaguggaggcuguggugaaguuuuucugagaagugggaugccagguaggccugucuucaggccccaaugguggcagcagugggcugagugugcuugucuuugguguaccaugguggcauaugauugcacugguuuuagguccaggcagguugauuugugggccuccaagugguuuacuugggugccagaagugguauugauggaucacauggguggguggguucucaaguuccugggcagcaaaguggcaugguugauggcaaucauagcaaugaaacaaccugaaucucaaguggucugugcuggcguugguuguggcugcuauggaucgcauggccagucuccagacccucaaguggugcaugcagugagugcuaacuguggcaguaguggcagguugagugggccugaccucagaccccaggaggugcucaggugccaccagugguggacagggcuaagugaucccuaggccccuggaugauaugcuuggguacugggggcagguagagcugggcuacgugaaccugcccucaggcuccuugguggugugugaggugcugguugugcuaugcagggguggggugauaccgaggucacuagcaaaaugcucagguuggggugcagcaguagcugugcuauagcccugcucuuggugaaggugggguugcuuucucagggaguagcuguaggcagguagcuugggagcacaagguucacuaguguuuuggccccacagcagccugcagcagcagugguuguagguaguggaauuuguucuuggaauaugugaaaaugcaugggcacuccucugcuggguggggcaggaucacugcucagggcuccugccuaagucacggccaucauagcagggcaggaugugugggcuguguucucaaaauggugcugugcugcagcugcuugggagaauugcagaauccagcgugagcucucuguugcaaugccuucacacggucuuuaggcaacucccuaugcuagucucugugcugucaaggaauaaggcgcucuccuguggcuaggauugcaagaguccuuggugaaaaugaggaacacuaagggucucuuaccuuuuccccacauuaggaagcuguuccagacucccagccaaucccaggcaaacaggccuuauuucucucuccucccuugcuuucaaugcuuccugucacugcucuguugaauuccaguguucucucuuagaugaccuauucaaaguauaauuaucuacuugcuacuuugguuccucuccauggaagggaugaacacuagaugcaucuagucaaccauccugaagccccuccugauuguauuuuuggauaaccugucuuugagcuugcugauccuuucuucugccugaucaauucuguugcugaugucuuguauugcaugugucauuuuuuauuauacuuuucaguuccaggauuucugacuuuuuuuauuccuucaauuucucuguuaaauuucuuugauaaacuucugaauuguuucucuguguuuuauaaaaguuuguugaguuuucuuaaaauagcuauuuugaauucuuugucuaccagaucauucaccugcaugucuuuaggauuagucacuggcacgauuuuuuguucauuuguugaggcugucuuucuuaggcuauucuuauucuuugcagaugugcaucccugucuacacauugaagaauuagguauuuauucucauguucacagucuggguuuguuugugacugcucuauuucagugagcucguuuagaaauugaguggggcugagugugguggcucauacuuguaaccuagcacuuuaggaggcugaggcuggaggauugcuuuaggucaggaguucgagacccagccugagcaacauagcaauaccccaaucuuccccaccccacacacaaaacccgaaaauuuagccaggcauaguggcacacaccuguagucccacucuggaggcugaggugggaagaccgugugagcccagccaggaguucaagacugcaguaaucuaugaucgcaccacugcacuccaaccuaggcaacagagaccauaucaaaaagaaagugaaaggacuggcuguuguauuuccuuuuagcacgagagggcgcccugagcccagguuagacgcaagucucaugcuggcucugcuacuaauuaguggagauccacagagggcacucaggccauacgggagaguuuuccgguguaaaaaccguggguccauggugacuuuccgccugugguacugcaguggcuugcggguggggucucagucauaaagaaccaauccccuuuaugugcaacuaugguuuuacucgucuuugcaguccaaaagggcuucacagucuugcucauggguucagguuuucuuaacucuucugaagguaauuucacgcaucgaguuguuaccuugauguuucugugaggagauuauugcugaagaguccuauuccaccacuuugcuccacucagcaugcacuacuuaaucacaagcaggagaugaaggcccggaaagaagacaauagaagcccaaaccccucuccucaaccuuuaucuaguagaccacaguguccuuauaauucagcagucagcaccuuuucuuauaaacgccagauggaagagaugcauauauaaggaaggguaugugggaaggggcauggggccagccacucuccaggaaccuccaugcguucagcuacucagaagcuccugaugggcaauucuaauaugaauauuuaucucuuuuaauucuuaucauuuuucuaucauuucuugauguuaaaaucugcuuuaaaacacacaguugacucuugaacaauacagguuugaacugcaugaguccacuuauaugcaguuuuuuuucaauaaauauagugagauuuuuuuggaaauuuaugacaauuugaaaaaacugucagauggaccacauaggguaaaaauaucaaaaaaauuaagaaaaagguauguuaugaaugcaaaaaauauauggagauggccggaugcaguggcucacacuuauaaucccagcacuuugggaggccaaggcgggcagaucacgaggucaggaguucaagaccggccuggcaaacauggugaaaccccaucucuacuaaaacuacaaaaauuaggugggcgugguggcacaugccuguaaucccagcuacuugggaggcuggggcaggagaaucgcuugaacccaagagggggaaguugcagugagcucagauugugccacugcacuccagccugggugacagaacaagacuccgucucaaaaaauauauauauauacuuugggaggccaaggcggguggaucacgaggucaggagaucgagaccauccuggcuaacacaaugaaaccccgucucuacuaaaaauacaaaaaauuagccagucgagguggcgggcgccuguagucccagcuacucgggaggcugaggcaggagaauggcgugaaccccggggggcagagccugcagugagcugagauugcgccacugcacuccagccugggcgacagcaagacuccgucucaaaaaaaaaaaaaaaaaaaauauauauauauauguauacacacuuauauauacauauacauguugauacuagacuauuuuaucauuuauuaccauaaaauauacaaaaaucuauuauaaaaaguugaaauuuauaaaaacuuacauacuuacaaccauacauggcaccauucccaguugggacaaauguaaacaaacguaaagauccaguauuaaaucgcaacugcauaaaauuaacgguaguagccaucuccuauuguuauugugcugagcucgagugcugcaggcauccacugaaaacucugcaugaugcuaaucaucucugcauaagcauuucaucucuccauaaacuuugaaggauacuugggacccguauaaagugccacuagugaugcuggaaguacucccaagaagcagagaaaaguauaaauaacauuuuccuuucucuagcuuacuuuauugaaaauauacagcauauaauacauacacaaaauauuuguuguuuauguuauugauaaggcuucugaucaacaauaggucauuaguacuugaauuuggagggagucaaaaguuauacauggauuuuugacugugcaggggguuaguaccccaacccccacauuguucaagggucaacuauauucucaaccacauuuuguuugaccuuaugaaagauuuuaucuauucuuaguacuuucuauugaguuucuauuuugaccauuguguuuauaauuuuuaugagcacguuuuguuaugauuguuuuucauagaauccuauuguuaccuuauuuuuaaguuucuuuuuauugauguaaaauauacauauguaauuugccaucauuaccauuuuuaaguguacaguucagugguauauauacauaauggaauacuauuuggccauaaaaaagaauauuuucauuugcaucaacauaggugacacugcagggcaauaccacauguucucacucacaugugggagcuaaaagaguggaucuugugaaaauagagaguagaaucgugguuaccauagucugggguggggaggguggaggugaugaaggugccaguugggacaaauguaaacaaacguaaagauccaguauuaaaucguaacugcauaaaauuaacgguaguagccaucuccuauuguuauugugcugagcucaagugcugggauuacagguguuccaguaaguggucagagcccugccugucccaagugggugaggucccaaagggauuaucauagcaguguuggaaggccagcuagugauucaugccaaggugaccuguaggauaaaccugcuacagcauggugcugcugcacggccauucugaauuugcaugucuuuggccaaauuauagagcagaauuuccagggcuggggaugguaguccuuccucccucauuugucucugccuguacucugggauauuucugccuucagacagucaugauguuuucuguggguuaaggcaaggacaaaucuccccccagggaacccaagaagguggagaagcugguugaacaccucaaugucacuuuuuccaguguagaaaccaugaguugaggggagauuuuccauacacuuggugcugggcagaauaggaggaaggagagucauggauguggaagucugauucucaaaguuuuuucacuucucuguggcuccgggaacugucucauccucacaugugagcucuggguuguuguugguguagauauuggugcuguauguuugguuuugguuuucugugagagggaguaaagccagccugccucuaugccccuauuuuaaaacuggaaggcaucuuauuguuacuuuauugaugcaguaucuucuugaaucuuuaugaaaauagaaguaagagcuuccgaugaguucuguucugagccauagcuuuuuuuauucugggauuauuauuuucuuuguucaucuuugcauaucccuuccauauuuuagguucuuuuuaaaugucuguucauccuugguugcccacucacauuuaagaaaaggaaagaaaaaucugacugugggcuguauguacauggguaagccuucauuuucaggugaccaaaagaggaauugccuacuauacauuaagauccccagaggccagagaucuucaaguauucagugggcuauauccucugagaugccgagcuguuugugaacugaaguacagaacucuggugcugaauuuggaagacccugaggauuguugagcagguguguacauaccuggcagagaccuguuuacauaaccauugacugugugcauuuuaggccaggcccgagcagaugcagcaucccuauccugcaucaaggaguucuuuguuucugagugccaacuuuucccugaugagagagaaggcaaagauagagucagcuaagcaugugucucaugaaugaccgccuccccuuucuccuucccugcucccagugugcucacaccuuaagcauuuuugucagcaaaguaggcacacagcacuuauccucucaaagucagugugagggagggagaagauaauuauguaaaggcagacaucucuugcucaaacugauuuucucucccuccauuuguccaugacaauaagugggaauggauaauaauagaagacagaauauugguuagcuugaggcaucaggauucaauucuuuuuauuagcugaauuauuuaaaagaaagcuuaugaaaaucauccuaggggccgggcgcgguggcucacaccuguaaucguagcacucugggaggcugaggcagguggaucacuucaggucaggcguuugagaguagccuggccaacauggugaaacccuauccccacuaaaaauacacaaauuaggcgggcaugguggcaugugccuguaaucucagcuacucaggaggcugaggcaggagaaucacuugaaccugggagguggacguugcagugagccaagauugugccacugcacuccaaccugggcaacagagugagacucgaucucaaaaaaaaaagaaaagaaaaaagaaaauuguccuaggaaaaaggcugucugucagucccugucuccguuauaauugcuucaucccagcuuauauuuaugaaaccccaggaaccugaaagcucccuaacacugucucugaaauugauaagggcugaagcacuggaaauacuauugaacagugacucccuggaguuaccccuuugugugaaggacugguagcuagugcuaaaacuuuaugaggcagccauucauuuguucauucauucaaacacauauuuauugagcacuacuaauuguagacacugaugauagagaggaagauacagccucugcuuucaagaugcuuacacucuagcuggaaucgucagagaagcugauaauuauaauaaagaguaaagagugauauaauaaagaugagaguaggguguuacagggagcagagaggagaagaaauuucacuuugcuugaagggaaaaagauaugagaucaaagaagauaaauauuaaauaaaguagaaaauacugauauaguaugauaaggaauaagcucaagaugcuguggaaauauaagcaggcaucuaauccagacuagaggucauccugggagaaggaauuaaggaaggggauaacugaaguaagucagacuuaaagaaaaaggagaagcuuacuuaguguaaagagggagacagauuuuuccaggcagaggaaacugcauaugcagaggucucaugcaagaaaaagcauuacauauuugggugacauggaagauaaggcaggaaauggaacacaacaaggcuggaaaugucaccagagaauagauaaugcauuuugcacuuuaccuugaaauugaauuauuuuauuuguuuuguuguuugagauagggucuggcuuuaucacccaggcuggagugcaguggcgcaaucacagcucacugcaaccuucaccuccugggcucaagugauccucccaccucagccucccaaguagcuggaguacagguacccgccaccaugaccggcugauuuuuuaauucuuuuguagagaugugguuucgcccuguugcccaggcuggucucaaacuccugggcucaagcaaucugcccaccucagccuccuaaagugcugggauuacaggcaugagccaccgaaacuggcaaacugaaguauuguagaggcuagagugacaagaucagauacucacuucaguaagcuuccuuugagaguuaugagacagaucaugagggccucaauuaagaagauggcaauguaaauugauaagggggcaagaagaauauuauguuacuaugauuacauagugauuacauuaggaggaggaggaagaggcggagguacuaacacuauugagggccuacucuaugccacacagugcucuagguuacuuaagugaaaucacucagcacucacaacaaucuuaugaaaaauguacuauuauuuccauuuaggaaaccgagacacagagagguuaaauaacuugccaaagguugugcacuuaauaauagaugaagauaagagaaaguauuuagaaaguagagcccaaaguauuuguugacagucuuaaugagggggaugaggccaguccguuauccagcuccucuaucuucuuaccucauagcugccaguggaacugagguuacguuuuguuuucuuggaauucauuuuuaaccccaucuccuucauuccugaacaguaauguaauuuaugaucuuucuauaaucaccuccucuuaauaguagcagaggauuucuuucaggaauccaaaauucagauuaagacucacuaaccuucaucaaauacagcaaaaaguaguauaaauuugugcaaggucugugucuuuuccuuggccagacucccugaaaaagaagugagaacauuuaucuucuauuuaaaaaaucucauuguaggaaauugucacuaggaggagacaguucuucaucaguuacuugacaguaagaacaaauguagucuucugucucuugauaacuuggcuuugaugucaggucuccuauagcaguguuucuaaaacuaucuggagcaaagaauuuuuuuauuucaacuuugaugaagaccacuacuuguguaaaauaugauaaaaaugaauuacuaaagaaaaaaauuaaaaacacuuacaaaauacaagcccucacacacugugugauaauagugaaauuauagauaauuucuguuacucuuguaacuuuuuauacuucugcaauuguaaauuaaaaguuuugaguaaaauagcaauuguccauauuaaacaucuauacucaugauuuuuuuucaauagcccacagugcuucuaauuauacucacauuuuaaauaaauaccguguauaucgauagcugaaguuuuuaauggaacaaacuagcuuguuucaugcuuuaacuguugagcuuguuggcuaucuuucuuagaauuauauauuuuuuaaauuugacuggaaacuuuuguuuacaggcuuauuuugaguagaaagauuuuuguuuaugacauuuugccguucuuucucucucucgcacccuuaaugcuuagaaauaaaaauuagcuuggacuaagaaagcaacaguacgugugcugcuacucaucaggcugggauaagagacauagauaaagcuaacugcagaguuaacaacaccauuucucccaaggacacauugccacuguauaaacucacugaaugccaacuauuugcuuugauuaucucuugcuuucuuacucaauugaguuguuuguucucugaauucacagccugccagaaauguuugaacuaauagcaacaagaaugaaacaucucauucuuuccuaggucaucuaaauuacuuugacacaaagaagcagcucaauuuaaagcucaagcuucagguaaggggugccuugacuuaaccuuucaugucuauguuaacuuuuuagaacacuucacagucuagaccucaugguuauuucuuuacacacaacucuacuuugcuucauuuaaauaucaccuaaccuccacccuuccccaaaauucuuuacuaacucuauacaguauuucccuuuguuuagggagguguccacagucucuuguugccaugagccaauaaaucugacuuuguugaacuauagugaucuuugcugucccuugugaucauugguugauuaagcaaaggauguguucacuauucucuaucuagcaaaucauacccuagaauggaauuuuggagauacuggccaauggaaaccuuggggauauugcagauucccccacugaaccaagaaaacuuaguucaguuccuauucuaggacuggguuugcuuuccccucuucuaggacucugaguuuccacaaagccauggcccuaaacaaagagugagcagcagcugugcucagcucucuuucaagugaagaagagcccaacucuaugauaugggcucucagucccucugguggggagcacuauuuauccuugucauccugacuccuuggcuaccgcagcuggcuuccugacccagaucucaguuggccuguaauuuccaccccuuuuacuacucacaguuccuguucugcuucugguccacaaauauuuaucuucuuuuucagcugaccaugccuauucgauuuucucuauuuaugguuuaccuaucuuuguuguugguuuucagcgagguugggguugagguggaggauggaaaaauggcuaaguaggaagacccugugccaucuuuaccagaaguacuggauuaaaaacuuuagagacacauuuaaaauacguauaaagcugucuuaaaacauucuaauuacuuuuauauaaauuuucaauuauagugaaauugacuuuuucuuuugguguauaggucuauaacuuuuaacaaagauauaagcucaugaaaccccaucaucgucaagauacagauccauuucaauauccaaaaagaacucccuccugcuaucccucuauaguguacaucuaauuucacaagaaacugccagagacuguuucucuaccaagcagcaaaacugccauucuguuuuccagaauggcuauaccauugugcauugugaaacuuucuguugcucugaauucuugacaggauucuuggcaauuuuauauuauuauuuuagcuauucuaauagauacaucacuguugauugaauuugcauuucccuaaugguuaaugauguugaacaucuuuucauauguuuguccauauaacucuugcuuuauaaaagacaccauuaaaagaaugaaaaaacaaacuauagagugggagaaaauauuugccaaucacauaacuggcaagggauuuauauccaaaaugaauuucauauucagacuuaaguuccauccccaagcuaucucauuauauaugugcaaauauuccaguaucugaaaucugaaacguucuugguuccaagcauuucagguaagggauacucaaucaguauuuugcaugcagauauucaccuguuucagcacuguuuauugaagacacuauucuuuccccuauugaaugguuuuggcacuccuggcaaaaaucaauguugugauuacagauuuguacuacuucaacuuucuucauauucauguuugcaucauauauccuuuuccaucuuuaugcugguaaccuaccuauaucauuuuuuugaaaugaguuucuuguaaacaacauauaauugguucaagcuuuuauauccaguaugcuaaucucuguuuuuaauugguguguuuuagccauuugcacuuaauguaaguauugauauguuuagauuuaagccuaucauuuuauuaugauuuuacugcuucuucucucugauuuucaucucuccuuacuugccuucuuuugaguuauuugaauauuuuugauauaccauuguaauuaguuuauugugacuuuuuacugugucucuugguauaauuuuuuauugguugcucuagggauuacaaaauacauacuuaaccuuucacuaucaucuacuuagagucaacauuuuaccauuugaauuggaaugaaguugaauggaccauaaaguuuuccuuacccuccucuuguuaugcuaugauucuuuuauguauuguaucuaccauacauuaaaaaaccuaucucacaauguucuaucuuugcuuucagccaucagacauguuuuaaggaauucugugggcguuaguuucagaugaaaguaugauuucucauauacugaguucaguuucauagucauaauuaaugagaaagugccaaaaccacaguguguuauuuaugggacguaaaggcuaauggaacauguugaagacugugaaacugagauuuccccucaagcaccagacuggccacugcguuggacucaauggcacugcaagggguuuaaaacagaucugacacugaaacuacauaccuggauguguagguugggggugaauccaggaguuaaugcacaacuuuauggguuuacuuuccugggaucuuuucucucugucaucuauaaacuuuccaguucugugagcucccuuuuuugguuuucuaaccagaagcuuccaauuuccacaacuacaucauagcuaaggucaagcaauggaaggggaaagacagagagaaaguaaugugcuuuucccccaaugucuuagaucuguagcuguacugaaugaagaauaauguuccccucccuaaguuuuuacuccggcagguuucuguugccagccacugucauugccacaggcaaccugggacugaagcuugagagaaugguggaaaagaggacaaaaacccuaggggauuuccccucccacgcucucugagcauuuagaguuaccuuucucacuccuugaaaccccagaggguuuguccuggagcucucuuugcaacauaguacucacuucgaagucuccaguuauguuuuaauucagguuaaggaauacuagaguggggaaaaagguauacucccccacaaguuugguaauacuuucaauucuagugucuuuucucuauauacuuguucuauuugcuuuuuagaaauuuuuaaauaucugggcuuugcauuuugucaagguuuuauaguuaaguucaaugggaaauaaaggguggaguguguuuauccauuucaccuggaacuagaaccucuguagacucuuuaguucaacucugugucaaagaaucauuuggguuuuuaacuuauuucuuuauaugucauauguaaacacuaauguuuugaugaucucauuguuccauuagccuuuacaucccauaaauaauacacugugguuuuggcacuuucucauuaauuaugacuaugaaacugaacucaguauaugagaaaucauacuuucaucugaaacuauuauaaacuacaaaccuuucucaucuucuccacuccccgcucccauccuuuuuuugaaucacauucaucaucaccauucagaaagaguauggugauuccuguuaauaaauucuuugccuauuccccaucaaaagguggagucucccuuuauagacuggucuuagugaugcauucuaacuaauagaauguagguuaugugagugauuuccaagguuacauuagaaaucgugaaacagcuucuaaugggcuaucucaggaccauauaagaagucuggcuacccuguaaaacccaugugagagagaucauguggagaguaccaucaagccaaggucaaagacaugugaauaaagucaccuuugggaugauuucagcucuagccacuguuugacuacagccucaugagacacacuuagauaggccaccaagucaaaacacugacaaauuccaugagacucacagaaaccaugagagauaauaagagacuguuguuguuuuaagccacuaaauuguggaguuaugcaguaaaagauaaauggaacaaggaaaagguacagugaagcugauuucaccauaaaaaauaggauaaaaacaaauuaugcaaaauuuacuucccuaauuuaugcuaagguauaaauuaaaaacagguuugauuagaauuauuuuagaauauauuaauucaauccaaauuaauuaauuuucaguaacauauaaauaaaugcugacuuuucuuagauuuuuauauacuuuugguuuacagaugacaaacuaaccaccugaaccagucuauaugccauugaucacacacuuggauguguuuaccuccaugaaguuuucaaggaaccuagcucaaaguuugcaaaaggcagaggacaguagaaaucacuacugauaaagcccacagauuugaagaggaaaauagcaaugcuuugaggagagagauuuaauucuggaacucagcuccuccugaucccagcuuagaguuuauugugguuauauagaaugcauaucugcuucucucagaaacuggauuauucuccuuuccaugagcaugaugcuagaguaaaaaagccucuuucaggugaaggaacacaaaugcuaacuguuauagauagauucaguuguuuguacuucucugcuuauuucaucucaauccuacgcuuucauacacuuaccuucucuacauacuaguagggcuccaaugaggccugaauucaagucuuuuaccagguccacaugagaaagauaugaguagguaaggcacagugggucagaggccauuggaccauucucuuucaggaccugccagacauauguauggcuuccaccagggaagacuuuaucaucuucuuucucccuuugacuggucugaucaucauauucagcuccuauagcaggaagaaauaaaauuguccuuucuauauccacuguacacucaaagaaacaugucaaguuuauugucaccaauagguucuacauaagaaacggacuuucugcaucuuuguuguuguuguuguuguuguuuugagacggagucucacucuguugcccaggcuggaucucggcucacagcaacguccgccucccagguucaagugauuuuccugccucagacuccccagcagcugggauuacaggcacgugccaccaugcccggcuaauuuuguauuuuuaguagagaugggguuucaucauguuggucaggauggucuuaaacuccugaccuugugauccacccgccucagccucccaaagugcugggauuacaggcgcgaaccaccacacccggccuacuuucugcaucuuaauuugaaaaacuaacaagcagcagccacaaauggggagaagcuucauauacuccagaggaucuugagaucacuaacccuagcaugagcaguaaaaacuagguucugguugauaucuccacauucuguuaaauaauaaauugcuuccauuauugcaucuuuuugccuaauucaauucaacaacaaauacacuuugucacagacucuuugguaggcacuagugagggucacggaacaguaagaaagagagauuuaagaaaauuucuuaaacuuuguucuuuccuagugguacaacacuauguuuggugggggacauagacauauaaagauauaauuauaauaccauguggaaauauucaccuauuuauucacaaauauuuauugaguucuuauucuuuaccagacucagcuacaagcugaaaauauaaagaucaagauagaagucucuaugcccuuggagcgagcaacacaguggauaaaaaaaguaaacaagcuuccuacucuucaguaaugcuugaugaaggagguggaauuugagaugaaucuugaaagacagauauauuuguguucuuuuucauguguuuaauauaaagaauuuaauauuuuugugaguggauguuagaaaauuauucuuagaauugcacugcuacuuucacuuuuuucuuucaacacacuuuuuaugaugaugcauuuuaauguacauuacaaauuucaugauaguccacuccuauauacuuuagaagucaucuuuaaaaaaaaauugcccacauaaacaaaaugacacuagcacaccugauccaguuaauaucaccuaauaucaaugcaauauucaaauuuucuuaauugccucaaaggcauccuuuguagcuaguugguccaaaucagaauccaaccuaagacugcagauugcaucugguuguuuaggcccauagucucuuuuaguauggaguagucccuuuuuuucugacacucauuuggugaaagaaauuuggcuuguaguccuguagaauaucccaugcuauugaauaugccuaaguucugauuagauucaaauuaaauaaguuuuuuggcuaaaauauaucaaagaugaugcugagucccucauauugugccauaucaggggcagauaauaucuggccaucccauccuuagugacacuaaaacugaccuguggauuagccugauaccuccauucuaaaguuaacauuuccacuuacaaucagaaaaaaaucacugggauauuauuuuggcgccauacaaaugucaaauuccacaucaggaauucaccuaaugauuguaacaucagcuuggauguguuugaagccaauccuagacaggauaucauuucauuuaugaguauuacaauauguaucucuauuauauaaguguuguuuuuaaugugaucauuauuuuuucaaugaucaauuacuuugaacuuugacaaugagagccuuuuccugccagccccauagaggaguacagacuguauguaaaaugcuuaauuuuguaaaauaaauuaagcaaagaugacaaaauguuaagauuuggcaaagugaggugaugggcacauguuuguuuguuauauuauuuucuguauuuaucuuuguuugaaauauuucauuaggaaaaaaauacccuuuuucccaaggcucacguuguggugggggcaggggcgggagcacauguuggagguucaaugagaggcuaacaaugugugaaacauuauagcugucuuggggagagggagaguaaauggauuaggggaaauguagcaguagaauggcuaggcaaugcugaaggcccaccugaggugagauaccauucagugugauugcgugauuuuuauuucagcuauguccaucccuuugguuguugguagaauagguggagaacagauuuaaccaagguaagugacccagcccagaaagauuugagucuguuccucuccaggaauggguugaaccuaguuuuccuuggacagaagaacuuggccaaaucugagaugagccacugcaucaggagcagcaacuucaacauaugcuaaacauuucacuguucaauagaaauauaaugcaaaccacauauguaauuuuaaauuuucugguagucacauuaagaaaaguaaaaagaaacaggugaaauuauuuuaauaauguauuucguuuaaccuaguauauccaaauauaagcauuucaacuuguacuuauaaacaaugaaugagauauuuuuagucuuuuuuguacuuaaccuuugaaaucugguguauauuuuacaguaugucucaaguaggacucaccacauuucaagugccugauagcucauggcuaccauuugaacugugcaguauagacucuaugguugguguccccucauuggauaagauguggccauuugggggucccaaaagguguuaccuuuucugauggguuuaacuugagcuggauuuuaaaauauuaucuccccauaauugugauuuuaaagcucuuaucucucccugaugucagcagaaaaaaaaagauaaaauugcauuggccacucguuucuccaccaauuuuuggaaaauuuccccaauguugaacuacgaauacauguaacucuuuaagauauagccaagccgagacccuccagauuugccauggcuuccugucucugauuauacagcuacauguuuaggguaggaucagugguauagaaggagcagauaaagguagauuguccugccuuugcaccaugccugcaaagagcuaggcaacuaagaaaaggacaagaccaacacccccuuaagacuccuauaagauccauggcccacaugauauacaugaaguaguagaaucuugauuuuauuauauuugggcuccauccccuaaguauaggauuaccugguaauaauagguccuuuuucucauaaauuucaaaaugcuagugcaaguacucucauuggccuagcuuggguaaggugcccaucucuggaccaaucaacuguggccaaggaggugggauacccgugucaacugcucacuccuagaucaacugcuauggcuagggaggcaugggcuuuaagaaaauggcagguucuguuugaaguauauucagaaaagcaauuccuaggggguauacaggugagaaauguuuaauuuuaggaagaaaaaaugacugguguccacuacacccucauucuuguauugaguaucuacuauaggguaggcaauauguuauaugcuaaggacacagcaauaaauaagauggauuucccuaucuugagauauuuauaaucuaguaaauguuaagaaauacacauaauguucaguuaggaccuuaaaagaguuguaacgccaccauuacaaagcacacacaucucacuguucuauucauagaaugacaggacaauaggaggguauuuuacucacccucagaagcuuuccaguaggauacaccaacagcaugaagacugacaggaugggaagccauguucuuaaguguaaugaccacuguaucauaaaccucagccuggaugguaggaccuagcagaccuguaagaaugagauguccgccaaagguuacuuggggauaguacuccagaaaaccuguuauuccaaaaguuagagucaaggucacaguggagaagcaugccccuguaauuacugacaaaaaguaguauuugcuugcugccaacaucagccuaaccuuaugguugcucugaggcaagauuucuggcaaucauucaauucauucauucauucaacuagaguuccuacuauauucuaggaacugucuuaugcacuggaggugcaguagcaaacaagacagauaauggagaucauauucucaagacauuaagcacauaaagaaauaaauaagaaaauuucaaguuguuauaaauauaaaagauaguggucugcuagaaagugaugaggcaggagguagaggauacuuucaguguaguagucaggaagggccucucugaggaggugacauuugaguagagaucugacuaaugaaaaagaagcaagauuuucaaagaucuaguggaagagcauugaaaacagauaaaacaaaugcaaacguccagaggcagaaauaaguuugguauagucaaguaaaguguggcugaagcacagugaaucagcagaggaguaacagaaaauauggucaaaaaggaaacauaacauguaggaccuugcaggccacaggaauuuggaugaauuuggauuuuacaagaaguaaaauaagaagacuuggaacuuguuuuggaggaacagucaacaggacuugcucauaaauaugauguggagauagaaaaaaagagaggagucaaagaaaacuccuaugauuuuggcuugugcaacuggguuguuagucaggccaugacagaaaaucaggaggaaaauuaagagcucuguuuuaugaauacacuaaguauaaaaugccuauaaacagucuguugaaugaacuggauugagugggauaaaaacauaaaauagccuuauuuuucuuagaccacugcuuuuaauuacuuuaugugagaucucccuuuucuugcacuuugguugaucccaaaucuuuuccaguaaccuucagguauuaaccaacaguaucacucuuagguucuaacaaguccaguccagucuaauaccaaauuuuugaugucuucugcaauugcaaguucccuuccuucuccagcuacauucugacagccccagaaaucugcaauauguaaagguaauuuguuuuggcagcuucgcugcuuucccaccuuccucuccuaaucuuccuccccaacucaccuuugugucucuggaccugccaagguaggagcaaguggaaaggaggggggaggguaaaaacaaauaggcacaaugacaaagucuuucuuggaaggagcagugauaauguggcauuaguacucccuaguugugacacauaccaaaauucugccuuucuuucuuagggaacuuaugaguuauuuggagaccucucccugccaacaaggagacaccccacugcuccugaucuuggcaugggauauaccuucuccagcuggucacuuguaucucuccucucagauucugcuucuggcaguacaacccauacaggcuuuuucuauugggguuaucuaauccuggcaggaagaccucucaggcagagucuuuguaagacaagucccauucagugaccuuccuggccuuacaccuaacaaugguagugcaguuagcucccacuauugcccacucccccugcuauuccaucaggagaaguccuuuuggccucugaccuugaaaauuuauccagauaaaaaccaggcaguggucagugucucccaaguuccauagguaccuuguccagucuucuaagugguucuccugaagccuccuucauuauaccuugacaugagggacaggccucccacuccccaugggguaagcaacacauaaaacaccgaagaggcucuccaaauaauaaauauucaaaucuaaagucuuccauaaguuccuagccuuuuuuuauacaagguuggaggugagucagggccuaaggguugcagaaccaauuuuggacuacuaccugaacaaguucuaaaucgauaggcugauaucucucuuuagaauaaggggauacuucccaccuauaauucucagcaacaauucuaagacagaaaauguccugucauaacauguuguuacauacuuuauuugacaucuaaguggagguaagcaguuggcauagaccaagcagaggaagacggcccagcaaaaagacagaaaaugcagucaguguauuucccuauagguagcaguuagggaaacauucucuuuggcagcugcacuuuuuaacugcaaccucaagauuggggaaucugugauagaaaauaagauacccaauuucauaaauagcauucaacauuguuuucauuacccauccaggguggccuuggcuuagcgauguugaaaaggugauccgugaauucuacaaacagagucuuuuuguacacgacugagguguugaauggaaaagauuuuggcacucuaggaggaaaucugcgugaagaaaggaaaaagucguucauuuugguggacacuucaaaaagcagcuggaaguaaugcuuccauacuacucuuuucuacuauuagcaaggaggcaaauuugaaguuguauauaaaucccuaacauccauuaaaccgaaacacuguuuucacaacucaacugauacauuaggugccauaugauaagaaucauaaaaucaauaaccauacacugcaucagccaaaaauccuuugccaaagcaauagcuacugcauccuucaauuucaucucuaaaacagacuauaacuuucaucuaaguaccuuguguucaaauuuugucaguauguaccuaaaauuauacuucccuccuuagggauaccaggaauaucacagagaaaauuaccuuucagcagacuauguauauugaaaccuacuagugccagaagcuguaauucagaaucaguccuacauuaauguucauucuugucuccacucagauacucccaauuacucauuuauucaugaaccagcuacugaaucagaaauuauauaauuacuuauauaaauguucccaaaauguuauuauuugccuccauugucaaagcccuuuuaagcaaaggcugguucccaacuuuuccucucucccugcaugacaguuuagcaugucugggggccuccucacgccaaauaaucaaaaggaccaaugugaaucuuggugaauaagggacacuggccccaagugaauugguagaaauuacaaagugguugaaggugacuaucuccacucacuaguuucaugugcugaugaguuuugcacaccauggagcaguucugcagcuuucucuaugccauaaagagccucucuuccugacuuuuaugcuucuggacaucuaacuuuuaucucccaucagauuuuaccaguugguaucauuucaacaagccaaaggcacaacacaugggcauuuggguaauuaaggcuuaguuggagaaagcaaggcuccugcccuggaaaaaagcuuucauguguagaucuaaaauugagcauuugcccuccacagauauacaucgauucacuuaugaaccguauacuacaugccacuuugccauaacaaaacacaucagacauaaacauggaaaaggagagauuuuuaaagacauacacuuagaugugaagcaguuguucgagucgcaugucuuauugacucucagggacuuuugaaaagugguagaugugaaagauggagaacagcacaaauaaaugcuugguauggcggaccacugaagaaagaaccccaaauaucauccagugagacacucccuccauugucauaaaugauggcaauaaugauaaagugagggaaaggagaggcagcuucugauuguaaguauucauaugcuuggaguaaaagccacaccaugccucagauuaccaggauguggaaugaauaagaaggggucugggcauuuaucacuuguuuauuucuuucucagucuuguggugaaauaacaaaagucucauuguuccuuucaggagcagccacacuggagaaucauucauucuuguaagaaauuuugcuuuuccuuuagucagaaugcugagauagagaaggaaaaugcaaucuaaaaauggugaaaauggcuaaauugguaaaccagugacccauggggauuuucuucaauuuuaauaauugugguaaaauacacauaaaauuuacuaucguaaaucuuuuuuuuuuuuuuuuuuuuuugacagggucucacucuguugcucaggcuggagugcaguggcgagauccaccucccggguucgagugauccucccgccucagccgccagaguaggugggacuacaggcgugugccaccaugcccgguuaauguuuuuguagagacaggguuucaccauguugcccaggcuggugucacacuccugggcucaagcaauccacccuccuuggcuucccaaagugcugggauuauaggcaugaggcaccaugcccagcccaagcauguuuaaauauacaguucaguagcauuaaauauucuggccaggugugguggcacacaccuguaaucccaguacuuugggaggccagggcaggaugaucacuugagcccagggguucaacaccagccugggcaacacagcaguaccuggccucuacaaauaauaauaauuagccaggcgugguggugugcaccuguggucuuagcugcuuuggugccuggggugggaggaucacuugagcccagacaguuaaggcugcagugagcuaugaucacaaaacugcacuccagccugggcaacagagugagaucccaucuccaaaaagaaaacguguaauaugcucccaucuaccuccagaauuaauuuuauguuguaaacugaaacuguauaaacauuaaacaauaacucucaccuccuccagucucuggcauccaccauucuacuuucuguaucauuuugacuacucuaaguacccaauauaaguggaaucauacagcauuugucuuuucaugacuggcuuauuucacuuagcguaauauacucaagguucaucuaugucguagcaugugucagaauuuccuucuuucguaaugcuuuguguguauauaccacauuuagauuauccauucaucugucaauagacacuugcaguacuuccacauuuuagcuauugugaauaaugcugcuuauaaacauggauaugaugguuaauuuuauaugucaacuugacugggcuaagagaugcccagauacauggcaaaacaguauuucuagguaugucugugaugauguuuccagaagagaauagcaugugaauugguaaagaagaucacucucaccaaugugggugggcauuauccauuccacugagggccugaauagaacaaaaagacagaggaagggcaaauucacucucccuguuugaacugggacaucugucuucuccugcccuuggacauaagcauucuugguucugccuucugacucagacccuguacuuuuaccauuggcauauauuuacacacacacacacacacacacacacacacacacggaucuguuucauuggagaacccuaauacaauugauguauaaauaucucuuuaagaccccauuucaguucuuuugcauauauagccagaagucgaguugcuggaucauaugguaauucuguuuaauuuuuagagaaacugcccuauuguacauuugcaauagugcacaaggguuccaauuucuccacauccucaccaacauucauuauuuucuguuuuaguuuugauaguagccauccuaaugggugugaggcaguaucucuuuguaguuuugauuuauauuucucuaaugauuagugauguugagcaucuuuucuuucuuuccaucucaccacaucacuaugggccuauuuacuguaguuccucauagccaguacaucauguccaccuuuuaacaagaaauuacaaggcacacuaaagggcaaaacccacaaaauuugaagagacugaacaagcaagcaucagaaucagagucaaauauggcaggaaugucauaauuaucagaccaggaauuuuuuaaacuaugauuaauaugcuaauggcuuuaauguaaaaaguagacaacaugcaaugacagauguauaucauaaggaaaaauauggaaauucuaagacagaauaaaaaagaaaugcuagagaucaaaacacuguaacagagaugaagaaugucuuugaugggcucauugguugaugagacauggcugaggaaagaaucucugagcuugaggacaugacaauagaaacuuccaaucaaaacugaaaagcaaagagaaaaaaagacugaaaaaaaaaaaaacaccaacaacaacggcagaggcuaugcaugggcccagaauguccaaaaacuguggaacaacaacuacaaaaguuguaacauacacauaauggaaaugccagaagaagaaugcagaaaugaauaggagcaaauuuuuaaagcaauaaugacugagaauuucccccaaauuaaugucagacaccagacaccauaccacagauucaggaagcucagagaauaccaaagaagauggaugcagcugggcgcgguggcucacgccuguaaucccagcacuuugggaggccgaggcgggcagaucacgaggucaggagaucgagaccauccuggcuaacauggugaaaccccaucuuuacuaaaaaauacaaaaaaaauuagccagcugugguggcgggugccuguagucccagcuauucaggaggcugaggcaggagaauggcgugaacccaagagguggagcuugcagugagccgaguucgcgccacugcacuccagccugggugacagggcgagauucugucucaaaaaaaaaaaaaaaaaaaaaaagauagaugcaaacgagcaaacaaauaaaaaaacccuacaccuaggcauauuauauucaaacuccagaaaaucaaagacaaaaaauguuguaagaaaccagauggggaaaaacacuuuauccauagaggagcaaagauaaaaauuacauccaacuucgccucagaaaccaugcaaacaagaagagagugcacugacauauuuaaaguguugagagaaagaaaaaacagucaaccuaaaauucugaacucugugaaaguauccuucaaaaaugaaggagaaauaaaaacuuucucagacaauaaaaauuaaggaauuuauugacaguagaccugccuuucaauaaauauccaaagaaguuguucagagagaaggaaauugaaucuacaaaggauacgcauuacagaaugaauaaaugaaaagaacaucagccacagaaacagcacuaaacaaccaaguagacugaaugacuuagccacuuugaugcuuaccagucucugcuguuggugccccaauucuuacaaaauggauguaugaaaggaggagccauggcagaggcuaugcaugggcccaacaucauggacucaucaauacagaucuagcuacugauguuguuaauguucaacuugccaguaacagagaccaaagcuaaggcucugauaugucaccauuucucaagaaaaucauucaguugcuuggugagccucaguaaacaccaccauucaaggccucacagaauauuugaucuuacauaacacugcaucagaccaagagaccuacuuuaaagcaagaagauacaugaccauggaauccacuacccagaagcuacccacuugauagagugguaggacagcuuguugaaggcacagcugaggcacuagcuuagacauaauaccuaaggacgaggcaccauccugcaggaugcaguauauacucuagaucaauggccaucguuuaguggggugugucccgaaguaaaauauaugguuuuggaaaacaaggaguguaaguaggagcagccucacacuaccauuacucccagugacccaauuagggaaacuaugccucuuaucccaacucugggcucugagaguuuagaaguacugguucuuaaaaggggaauauguccgccaguggacacaccaagagucucauuaaacuugaaacuaugguugccaucauauuacuucagaucacuauuaagagaccaagagguaaggaaaagagucacuauccuggcaagcguaaccgauccugaucaucaggaggaagggcugacauuacacaauggagacagaggagaauauauuuggcagccaggucaucugccuggguaucucuuaguauucccuuguucaauguugaugauaaauggacaaguacagucauggcuuacaaagggcaugaugaccagauaccuuaucugguaacccacuuggagcagcagaaguaugaauugagagggugguggggggagggaucuagaauggguaguagaaggggaagaugaugaguaccaguugcagacucaagaaaagcuaaagcagcaggaguugugcuguguuccaaaccuuucucuuuuguuuccccaggaaagggagcccaucagaauccugaaggaaccauuccagaacuuaugaagcaaaugaaucugagcagcagaaaggguggaccacaguggaggcugguguccagauucaccgcuucaggacuaaagcacuuauuuccuaagcugcugggugugcugacagcugacaacucuaaucugaauuccucucugagaaccaauuuuggcugaagucagucaccacauccaaacucaugccuuauuccugguaaaggugggacuauauagguccagacaacuugccucaauagagaacaucucugcagagccauccuagcuugagcucccugugggacugaccuuuauucagacuguaucaccucaacuucuuuuacccaauccugcuuccuucacucccccauggguguugauccagaggaucccccuccuauaaacuuucugcaugcaagaaaaaaaagagagaaaaaaggagaaaaaagcagacaauaauuuuuauucaugugcuuaaaaaguuguaaaaucacccaaggaagcacauaaguugucaguaugugaacaauguuggaaacauuuuauuuugucugauuuccuuugggagaauucauugccagcuauaaaucuguggaaacgcugccacacaaucuuagcacacaagauuggcagaaaaucgcuuagaaacacugaaaacaugugacaaagugcuuuccgugaaaaggguggaugcgaagcaguaaggacccccuucaugaagcacgcggucacccuccagccaccagaaccagaggaacgcugugguaacugagggaaaacgcaucuaggcacacgucacgguggcaccuuccagcagguccccgggguugugccccuggagcucugacaaagaguguggcccggaaaugugauguuuggacugcaaguuuuggugagaaauaacaaugcaucagguugcagacaaagcagacccugcucugugcguuuaugggagccgcgcccaacaggaaccacagggaaugaucgaaaggagagggacggacacaaacagacacaccagagagagguucucaggaggaggcucuguggccuccagaccacgucaaagccaaggcagaaaggaugaacugaggaaaggaggaaaauuuccccuuaaggaagguaaaauccagaagggaucccuaaaauggugagcaguuuaaaccuagcaguuuugcauuaauucacauaaaguauaaugaaaacuguuggacacacaaggagagacuggccaaucuauagucacagaggaagaccuucacaccccuucacaggaucucgcagcagauuggcugaaaagucuccuugaaacugcagaccucucucaaggagacccacugaguugggcaaagguggggccgacuuaauucuugccucccugcucucccacguagcccugcauuucacuccauuccaggguuucugggacacccgagaaagcacguaguccagggagcacgucugccaacugaaggccuugacaaaugacuuucuguacuggcugagggccagggcccagcguacugauaaggaagcucuuccagaaaaaaguugggacaaaggcauauuagugaguggacacaaacuagaaaaaucuccaaguaauacguuaaugccaacagaaagcauccaucuugaaggaagcacaaaccaacaacacauauaaaaaugacucuggcaauucacaucagcuagccucugcauaggccaucgcaguacuggcaagacaugagcuaaguggcuacagcagcagggagagaauuaaugcauggacccaaaagcguggcuucccacugacuaaggcugaucuagcuacuguugccaccaaaguccaaccugccagcaacaaaaaucaaugcugagcucccaauaugccauauugggcccaaccccugggccccugaccaguacuggucuguggccuguuaggaauggggucacauagcaggaagugagcagcaggcagggagcaaagcuucaucuguauuuacagcggcuccccaucacuugcauuaccgccugggcucugccuccugugagaucagcugcugcauuagauucucauaggagugcgaaugcuacugugaacugcauaugcaagggaucuagguuuugugcuccuuaugagaaccuaacuaaugccgcaugaucugaggcggacaguuucaugccguaaccauucccaacaaccccaaagucucuggaaaaauuaucuuccacgaaaccagucccuggugccaaaaagguuggggauugcugcaauaugguauuguccaucacagagacaaaccagcuucucgguggccagacacacugaacuccuuccauccuagaaaggacaggacuucauugugauaccuaaucuuggcguaacuuagccuuuccucccuucagggccuuagccagcaccacuaucugaaaucuuacagaggauuugauucacugauguggaauuccauauagcaccguguagaccuggggaaucauuguacagcaaaagagaugagggaguggguccacaaccaggcacagguagaacuccagcuuggaggcaggucucugugaggauggagggccagccuccaaggugcuguauauguaugaauucaaagaugauucuguguccccacuaagaagauuacaugggguuugggaaucaaagaguggcagcaaaagaacucugauuagcacccccgccaaugagccacguggggagucucugccgccccucccugcagcucugggacccgcagcagaaaggccccugcagcagaaaggcaagaguauacggcgggugccaccuggccccgccaggcuaacccagggcaaugcagagcaguggcagggagagggggugagggggaagaauggcaggggcugggggugccaucacgcccagggcgcgggcaggagcgugcagcugagcccugaacccacgacgaccuggagcugagcagcaagagggugaggggcgcccggauggcagucuaggaaagaacuccccagucccagccauugggugugggaagucagccuucaccuccgcugaggugugcgccgggauugccccagaggaauguugccugugggggccacgcaccuuccuucccaagacagaccacgccccucuaccagggcaugccccgcccauuuccaggacaggccccacccccucucugggcagaccacgccucuucccagcgccgacucugcccugucccaggauggacagcacuucaugagugcucagugcagggacacagaggccuggacauguugguccaaccuggaagguucauuccagcuccagagcucccuguaagauccagcaaggcuguccuggagccuacccggcagcgcgcuucucccucugccuaucccugauuccucagguguugaucccaagaacacuccaaauaaaauuccugcauguuaaucuucaucucagagucuacaucuagggaacacaaccaguaacauuaauuuuuuuuuuuuuuuuuuugagacggagucucgcucugucgcccaggccggacugcggacugcaguggcgcaaucucggcucacugcaagaacauuaauuuauauuuaaacauacucuaaugucaucuaccucuaaaaauuuccauggcacuagucuuaacauaagccuauguaguuuucagucauuuaacauuauuaugcccuuccacauucaccaacucaucccuaguuugcuaccuuucuccuuuuuccauaucauauccuugguuccacuacgucuauccuacccccucucugugcaguuuccauugauuucuaagguauuucaacauaaguuaccacagugcuuucacuuuaaauguuucugauuaaaggccagacccaauggcucacaucuguaaucccagcacuuugggaggccgaggcgggaggaucaccugaggucaggaguucgacaccagccgggccaacaugaagaaacccugucuacuaaaaauacaaaaauuagcugggcgugguggggcaugccuguaaugccagcuacucaggaggcugaggcaggagaaucgcuugaacacgggaggcagagguugcagugagccgagaucaugccacugcacuccagccugggggauagaguuagacucugucucaaaaaauaaauaaauaaauaaauaaauaaauguuucugacuaaaaugaagauauaagacacauauaaaauauguuauagagcaauagauuggaagaucagagagggaacaggaucaagagcacacagaaacacuuuuucccucucugagggaagagugaaaacacauaauugauggagaaacaagauugugagacagaaaaacaaaaaggccuaggcccuaggucaaguauaugugauucaggacaggacucuauucaaagggaauaacuagauguuccuaagagcauuaacacccuccaagugugugauucaguucugagaugaaccuauuacaggacaauauccagcuccccagccugagaccuuugccauuugagugaauauuuuccacgcuggcagaaacaugugauuuauuugccugucucacuuucaggcaaaucugcauaguaaaugacaaaauguuccaggguuccuggguuuuacuccuuccuaacuuuugugggguuuuguuuguguauuuccuuugggauucaauauagaaauccugccaaauauauuuggcaaccauuguccuugacaugaacuguucuuucacauuuuaucuaaaacuaaucggaaaaccuauuauauucccugaccugugguuagaagaaacugagcagcugcgggaacagauaauauaaaacugaauuuucccagcuguuuauuucaaaccuuggcagaggcugucaggauguguccagagucagcuuauccuguuaaucagcaucaaaauaaucuaaaguauaaaaggguuucauuaaaauaaaaauucuaucaacuuuuuucugguaaauacaugugacugccuauacaauaacagaaagcuagauaauaaauuaaugauguauuccauucaauucaauuuuauacucaaacuauuauucucugugccucaggcugcaugcuagauggacacuaauauacacaguguauuaaguaaaauuaucucaauauuaauuguuaacagggcuaacuuuaauggauaaaugguuguuuaguuagaugccaggcuacugacaaccugggccucuacuuucaaggucacuaacauugcucaucugcaggcuauauaggcuguagaacgaacuuggauccccuccucacaccauauaccaaaauuaacuccaaguggaucaaugaccucaauguaagaacuaaaacuauaaaagucucaaaagaaaauauagguuuaaaucuuagugaucuuugauuugacauugauuucuuagauaugacaacaaaaauacaagcaaccaaagggguaaaauaaauaaauauuggauuucaucaaaaugaaaaacuuugugcaucacaggauacuauuaggaaagugaaaauacuacccacagaaugggaaaaaauauuuucaugucauagcucugauaaggguauaauauuaagaauaaauaaagaacuuauacaacucaguacuaaaaaacaaauaauccaauuaaaaacacgcaaagcauuuaaauagacauuucuccaaaggagauacacaaauggucaauaaacacaugaaaagacucucaacaacguaagucaucagggaaaugcaaauccaaacuacaaugagauaucacuuuauccacacuaggaugaguauaauuaaaaagacagacaguaacaaguguugauaagaauauggaaaaauuggaacacucauacuuugguagugaaaauguaaaauggugcagcugcuuugaaaaagucuggcaguuccucuaaaaguuaaacauagaauuaccaugugaccuagcaauuauauuccuaaguauauuccgaagagaaauaaaagcauauguacacaaagacuuguacaugaauguucuauagcagcauuauucauaauagccaaaaggggaaacaauccaaaaguccaucaacagaugaauggauaaacaaaauguggucuauccauacaauggaguauuauucagccauaaaaaggaguuaaauucugauacauacuacaacauggaagauuuuuuuaaauuaaaaaaugaaaauaguuucauucuuacuauaucuuuauuuucuuauuuuaacuccucuaucauucugcaaaaauggaagaaucuugaaaacaugcuaagcaaaagaugcuagacacaaaaggccacauauuuuaucccuucauuuacaugaaauauccagaauaggcaaaaccacagugacggaaaguagguuaaugguugccaggggcuggggaaaggaagaaaauuagaagugacuguuuaaugauuacaggguuucuuuuugaggugaugaaaauauucuggaauuaaauaaagaugauaguuguacacuuuacggauucacuaaaaaccacugaauuguacacuuucaaauggugaauuuuaugauauguaaaguauaugucaauaaaaauguggagauuuaggaaaggaaaagaaucuccacacugaaaauaagugauuuuuacaguauguaaaucauaccuccaaggagugaaaaaaugguaaggaaauauucugaacuuuauacuauuaaauucaacagcucagauggaauuucuuuucuuuuuuugagacagagccuugcuuuguugcucaggcuggagugcaguagcaugauccauaguuaauugcagccuugaacucuugggcucaagugauccuccugccucagccuuccaaguagcugggacuacaggcauauguuaccacacuuggcuaaugaaaaaaaauucuguagaagucaagucuuguuauguugcccaggcugaucucaaacuccuggccuagagcaauccugcugccuccucccaaaguguugggguuacaggugugagccaccaugcccagucucaaauggaauuucuuaaaagaaauuauuaaaauuuauccuauaagaaauagaaaauucaaauagcccuuuaccuauuaaaaauagaauucacaauuaagacccuuaaaaaaaaaaccaaaccaaaacaaaaaacacugggauaagaugauuucccuggugaauaaacauuuaaaaaagaaaugauaccaauucuacacaaacucuuucauuaaauagaagagugaacacgucucaacucauuuuauaagaauagucagccgggcgcgguggcucacgcuuguaaucccagcacuuugggaggccgaggugggcggaucaugaggucaggagaucgagacuauccuggcuaacacggugaaaccccgucucuacuaucaguauaaaaaauuagccaggcgugguggcgggcgccugucgucccagcuacucgggaggcugaggcaggagaauggcgugaacccgggaggcggagcuugcagugagccgagaucgcaccacugcacuccagccugggugacagagcgagacuccgucucaaaaaaaaaaaaaaaaaaaaaaagaauagucuuacucuuugauaugguuuggcuguguccccaccuaaaucucaucuugaauuguagcucccacaauccccaugugcugugagagggaccaggugggagguaauugaaucauggcagugggguuuucccaugcuguucacauuauagugaauaagucucaugagggcugaugguuuuauaaagggcaguucuccuguacaaugcucucuugucugccaccaugccauauaagaugugucuuugcuccuccuuugccuuccaccaugauugugaggccuccccagccauguggaacugugaguccauuaaaucucuuuccuuuauaaauuacccagucucggguauguccucauagcagcauuagaacggacuaauaccacucuuauaucaaaaccagacaaugacauuauaagaaaaucacagccaaauauccaucaugaacacagacgcaaaaacuaaaaaaccaccaucaccaccaaaacccuuaacaaaacaguuuuaguuggccagggcugccauaacaaaauacuagagauugggugacuuaaacaacagaaacuuauuuucucacaguuccggaggcuggaaauccaauaucagggugccagcacggucaguuucuaguggagcccucuucccagcugguagauggcugccuucucgcuguauguucacauggcuuuuccucagugcaugaguguagagagagaaccuucucucuucuuaugaggccaccaguccuaucagauuaggacuccauccuuauggccucauuuaaccuuguuuaccuccuaaaagcccuaucuccaaauauaaucaucuugagaguuaggacuucaacauaugaauuugggguggggggagguggagacaauucaguccauagcgaaaauauuaccaauguaauaugucacaaccagguggauuuuuucccugggaauacauagcuaguuccucauuaaaaaaucaaucaagguaauucaccauaacagaauaaacaagauaaaccauaugaccauuugaauagaugcagaaaaagcauuugacaaaaucuaauaucaaaucuugauaaaaacucucacaccaagaauagaaggaaacuuccucaauuugacaaagggcaucuaugaaaaaauuuacaaguaauuguacuuaaugguaaaauaaugaauauuuucccucugaaaucaggaagaagacaaggauucugcuaucaucaguucuaucuaacauuguacuggaggcccuugccaguacaguaaggcaugaaaaaaaaaauaaaaagcauccaguuuggaaaggaagaagcaaacugucuuuauuugcagacaacauuauuguauauguagaaauucuaaaagaagugcaaaacgcuacuagagcuaaaaugcaaauuaacaagauuagagugaacaaggucaauauacaaaaaucaauugaauuucuauauuuuaguaacaaaugauuggaaaacgaaaacaaauaaaaaugauacaauuaacaauagcaucgaaucccucaaaauacuuggggauacaauuaauauaauucuugcaagaacuacucuguaggcuacaaaauauccuagagggaaauuaaagaaaauuuaaagaaacaaagccauaccauguuguuguauugaaagauucaguauuguuuaaaugucaauucuccccaaauugaucuacagauucaauucaauuccagucaaaaucccaguuggcuauuugguggaguuggcuaguugacuauaaaauuaauacagaaauauaaaagccuaaauauaucaaaagcaauuucaauaaaaaaguaaguuggagguuuuagacugccugauauuaagacuuacuauaaaguuacaacaaucaaaacaaucugguacuggcauaagcacagauauacacaucuauggaacuagagaauccauaaacagauuugccuauauacagucauuuaauuuucuacaaaggcaccaagggaauucaauagagaaagaaaagucacaccauacagaaaauuuaacucaaaauguauuauaaaccuaaauacuaaugcuaaaaugauaaaaguucuagaagaaaacagaagaaaggcuuugugaacuugaggugggcaaagauuuccuaggacaggggaaaaaaaagcaugaaucauagaagaagaaaagcuaaauuggacuuaacuacaacuauaaauuuccacuauuugaaagacaccauuuggaaaaugaaaaugcaagccauagauuggaaaaaaacauucaaaacagguaccucugaauagucuuguacccagaauauauaaaaaauuaucaaaacucaacaauaacaagacaaacaacccaauuaaaaacuggcaaaccauuauccuaagugaauuaacacaggaacugaaaaccaaauaccauauguucucacuuagaagugggagcuaaaugaugagaacacauggacauagaauaauagacacuggagacgacuagaggaaagagggaggaggaaggguagcaaggagugaaaaaccaccuauuggguacuauguucacuacuucagugacaggaucauucauucguaacccaaacuucagcaccaugcaacauacucauguaacaaaccugcacauguaccuccucagucuaaaauaaaaguugaaacuacguuuaaaaacaaaggaccaaugauuugaauagacacuuccaagaagauauaggaauggcuaauuagcacaugcaaagaugcucaacaucuuuagucaucagagacacgcaaauuaaaaguauaaccaggugcaguggcucaagccguaaucccaacauuuugggaggccgaggcggguggaucacuugaggccaggaguuugagaccagccuggccaacauggcaaaaccccgucucuaccaaaaauacaaaaauuagcugggcacgguggcgugugaccauaguccuagcuacucaggaggcugaggcaugagaauugcuugagccuaggaggcagauguugagcugagauugcgccacugcacuccagccugugugaugggaugagauuccaucucaaaaaaaaaaaaaaguauagugagauaccacugugcagucauuaaguacuggcaacaucaaauguuguccaggauauauugcaacuggaacucucaugcauugcuggugggaguauagaaugguacguucaagaaaucugucuggcaguuucucuuaaacaugcacuuaccauaugauccagcaauuccacuccuagauauuuaacuaagauaaaugaaaauagauguucacacaaaacauguggagcacuguucauagcagguuuauuuguauuugcuccuaacuggaaauaauccaaaauuaugauauaaucccauaauggagcaguaaucagcaauaaaaaggauagaaauacuuuauacaacaaccugcaugaauuuccaaaucaugaugcugaagaaaaaaagccauagaagaauacauaccguaugauuccacugauguaaaauucuagaacaugugaaaacaaaucuguaacuuccagauagcaguuuauuggcugaggccaggucagugggagagacucauuaaaaaguugcaggaggguugauguaaaugcauguugauuaggguggugguuaugcaaguguaugcauuugucaaaacucaucaaacugcauauuuaaaauugaugagcuucauuguauguaaacuauaccuguggcagguaaaaauuuggcccacaucaccuuugcuccuuggugucauguccaaaaauauauuauguggcaaauuaaacuuugcagauggaauuaaggggcugauuagcugaccuugagauggggagaguauucugaauuacccaggucggcccaauguaaucacaugaguccuuaaaaguaaaagagagaggcaaaaaaggccagagauaugcacggaaaauugaagucagagcaauuccaagcaugagagaguguugaugcaccauugcugguagagggcacuacauggaaagugagagaaggaacugaauuugcuaacauuccaaaugagccuguaagcagauucuccccaagagcuuucacuaaggagugcagcccuauuaaaaccuugguguuggccuuguaugacccugcacagaguauccagcugaguccaccuggacuucuaacucacagaaacugugagacaguaaaugggucugucauaagcugauacauuugauguaguuuguuacacagcaauaggaaauuaacaggauauucaauguugacccaaauacuacaaacuaacuugauaaacaaauuuaaaaagcaauuaaaaucauacgucuagauuaucaaagaugaaaucaaagaagauauuacaaacuauucugaaaaaaaugaaaagaaaacccuucaugcuauaccauuuuacaauguauacuuacaucaaaacauuaucuuguacaccuuaaauauauacaacuuuuauuugucaauuauaccacaauaaagcugggguggggugggauagaauuaccuggggacuaaauaguuugcugaggauggggccuaggaauguaaauuuuaauaagcuucccgagugauucuuaugcacacugaaguuugagaacuagugccuucauggacuucagcuuuggggugagcuuuaagaaagucaggguccaguuaaugaauaugagagauacugcuuuuuuuuauuuuuuuauuuuuugaaauggagucucacucugucaccuaggcugagcacaaucuuagcucacugccaccuccgccuccuagguucaagcaauucuccugccucagccuccucaguagcugggauuacaggugagcaccaccaugcccagcuaauuuuuuuuuuuuuuuugguagacacggaguuuugccauguuggcuaggcuggugucaaacuccugaccucaggugaucugccugccucggccucccaaagugcugggauuacaggcaugaaccaccauaccuggccgauugcuuauuuauaucuccaagcuucacugaucagaaaauacuuuuccugaaaaguuauccuacagaaaucagaucauguugagaggauaagucucuggaauguuaauaaagguauauggagcuagcauaguugaacuguucacuuuuugcauaagaaaucucacuguucauguuuucccaucagacaaaauaaaacagacugacgaguuuuauauauuaaugugugaacagugcauagcuacaugccaauaaagcagcacaguuaaugaaucaauagcuucuuuuucugcucagugaaaauaaaaaugcuuuauaccaacuagaaaaaaaaaaaauccaaaagcccauucuuugaaaagagcaccaccagcaacaaaauagacaagucauuggcaagcuuauucaaggaaaaaaagauaaauagcaaagauagaggaauuuaggaauaagaaagggcacauaacuacagauaauguggaguaaaagaaucaugagugagugcuacaugcaacacuguggcaacaaaauugaaaaaauaaauaaaguuacuuccuagaaagguauauaauuauuggaaguugaaacuugaauugacugauuaucauagaagagccuggaggggugauuaaagauauugcaaaugccacuaggaccaaauggauucauaagugagucucaccuaacuuuuagacaauggauaauucaaauguuacuuaagcuauucuaagcaauagaaaaagauggaguacucaucaauucauuugauaaagccaacaaaacuuuguuuauuauuauuaguagguugaguagugaaaaucuacuaagaauagucuaaagaaauaguacauagaacccacuaaugaucaaauuccaugaauaguagauuuuacuccaagaauguaaggguauuuagugucaggacaucuaugaacauaauuuguucaucagcauaucaaagaagacaauucagaugauaccagcugcugaaaacuuauuuaugauaaacauuuuguggcaaaugagaauagaauaaacaccauuuacaaaaaccaaaacagcaaauguuacucuaaauagcaaaauacaaaaauuauuucaaguaaaaucauagaguagaaggaauguucacuuucauuguuauuauuuaacauuugcucuuguuuucuaauaaauucaauaagauaagaaaaugaaauaacuggcuauaaauauuggaaaugagcuaaaaucugucucauuuaacuuaugauaugauucaauacucacagagacuuuaggguaaaauuacuagaauuaauaggcaaauuugguaagguagcuagauuuaagaugaauauacaauggcugggugcgguggcucaaaccuguaauccuagcucuuugggaggcugagguggggggaaugcuugagcucaggaguugaaaaccagccuggguaacauggcaaaaacccaucucuaaaaaauauacaaaaauuuuccgggcaugguggccugcuccuguagucccagcuacuuggggggcugauauacaggagaauugcuugaauccaggagguugaggcugcaguaaggugagaucaccccacugcacuccagccugggugacaaaaugagacccaggcucaaaagaaaaagcugaaaauacacaaaccaauagcuuaucucuauuugguacuaagcacucauaaauggaaauaggagaaaacuaucuuauuaacaauagcaucacacuuauaaaauacacagagauaaauguaauaagaaaaauauuuaaauuuauuacauuaauaaaauuaaggucugaguuuaaugaaauugcaguuagaaucacaacagggcuuggaucuuuuuaauuugaaaaauaucuuaacaguuuuauguggaagaauaaagugucuaagaauagcuaagaaagguacaaaaagaauagugaggauugcuuucacccaccagauaucagaagauaucauaggcucacuguaaucaaaucacuaugguacuggcauagcaagauaauaguagauuagugaaacagccuaaugaauccagaaauauaugcuaauauauaugagaacuuuauaugaugaauguguugauucaaaucaguggcaaaaggugccaucacaauaggcuauugaucuggauggaaauaaaacuagacaaaucccucucucaugccauaugacaaaaguaauuagcagauaauugaagcaaugcauauaaaaagcgaaacaguaaacaucuugcaagaaaaucugggagauuacacguacaaucuugaggugugggaaacauuuuuaaccaaccuugccgacucugaagauaugaaagaaaagauaucucugauuauaaaaauuaaaaacuguuuugguaaaaguuauaagaaagucaacagacaaacaauagaucuuggggaaaacugcaauauacaugacaaagaguuaauauuuguaauaauaaaaggguucucauaauuuuuuuaaaugaaagaguccaaagaauaaugggcaaaucauaugacuaauuaaaucccccaaauaaauccaauagccaacaagcauuuaaaaagaugcucaacuuauuagaaauaaaaauaacacaaugaaaguaaugaugcaauaucacucuacaccuguaaaauuggcaaauuuuaaaaacaggauaaaacuuaucgcuaugugaaugcagagagaaggccauuuucauacuucgaugguagaaauguuugaaaaguucugaccucuuuggaaauuaaaacuuagaaggaaacauucccuucguuccauuaauauuccucuugcaaguuuguucaacagaaguaaaagcaccaguauguaaugauauaggauauaguagccaaaaacuggaauaaagugaacauauugacuaaauugugauacagccauaccauagaaucuuauauagccaauaaaaauaaugaauuaaagcuauaccaauugacuuagaguucuaguacguguuaaugagugagaaauguguguauaaugucccaauuuuauaaaacaaauaauguccaagaaaaccuuuguguguguguauguguaugugaauauauauuaucauacugggguuaccuagcugaggugggggagaaggggacugauguggaaagaggguggggagccaaacagaaagaaccaaaaagaauauaaaguauguacaacaugaccacauuuaauguuuacacagccacaaucuauguauuauauuuaaaucuuuauaauacacauuuaaagaagacaaaaaaauaaaauaaaugauuucagcauucaacucaagaagcaaaaaucuaacaacaaaaugaaccaaaggaaauuagaaggaaggaauaaaucaaugaaaguagaagcagaaacugaugcaacagaaagaaaaaagagauugauaaaucaaaccaaaagaaaauucuugacaagaccaauaaaaucaagaaaacuccuggaaauauuauuuuuaaaagagaggaagagaacauauacaacauaaggaaugaaaaagaaaauauaacuacagacacagaacaguuuaacaaaaucacaggagacucuuacauaacuugauaccaauacauuaucaaaucuagggacaguagauugcuuucuaugaaaguauagaccaaaauauaccaauauuuacugaagaagagguagaaaaaucugaaucaacugaugaccauagacaauauugauaaaguuauuuaauacucugccuaaaugcaccagaacccccaaaacacgaaaagcuucugaacucaaggcucauauuauccuuacacccaaaguaggaaaagauauuauaaaaacacacauugcauguacacacaagagaaccagacaugaaacuugugugugauauugauuggauuucauugccuugauucucucuauggaagcuugggcaggcagagggaaguuuugucuuugucccuucacccucccucuacuccagucucuagauucuggaggagcagcauaugacgaagagaagcaauggacaaaacagaacaaaauaucaacaaauaggucagaccuaugaaaagaauuggcaguuagcauuucugcuaauaacacagaugugugcacaccuuacccagaaauguuucuuuggggcccagguagcaucacaaccauccuaacccgaugucugcaccuuccuccaagcagacuuacauccccacaauccuggccccgaucagacccuacaggacaugccuuuaccuugcguccacaggcagcucaccgagaucacuuugcauauagucccaugacaguuccacugcacccagguaguaucuucugguggcacuaaagcagaaucgcaaaaggcacagaaagaagcagguggagagcucuauuugcaugacuuauugcuacaaauguucaacuggagaagcaaaagguuaauucuucucuaaaauaucuuuagcucccaggaggggaaaaaaguaaaauuucugauuuaaugaaaagucccaauuucuuugcagagcauuuuaaggaacuuuacccacuggaugugcucagcacuaagc

SEQ ID NO: 192835 - RNA, 23398 nt, Homo sapiens
aaucacggaaucccggcggccggcggcccgggaggcagucgcgcgcucgcauccccaagauggcggccguuaaggacaguuguggcaaaggagaaauggccacagggaaugggcggcggcuccaccuggggauuccugaggccguguuugugguaagaggcacgcuguucccuggcaucuuggcuugaggccuuggacugccccuuucuucccggcucccacccaggccucgacuguuggaaggagcugagccaaguguucagggagggggcgcucggucugcucucaccccucgcaccuggacagauugagcucugcugggggcccgcccggaagaaacguagcucgagaaggccguagaagagaacggggugcggggccgggacgaggggcgaggggcgaggggcggcggguggcagggcagggcggccugagggaccuccgggcugccgccgguuuucgucccccugcugguuggaaaaggggagguggugaggagcucucgacucagcauggaugcuggagacacaguacaaugaauaggcagaacagccagugcuaagaugugaaaaccgggaauaucacuuugucuguugaaggaaugcaguggucucgggaauguugccucgggaaauggaagaagagaccgaugggaaaauaggaugauagguugggaguguaaaguccuucugugucuugcuaaggaauugagguuuuccaguaggcaacgggcugucaucagaaggccuuucguuuuaacuacaucauucuaacaacuuaguggagaaugaauuguugagagaggaggcugaacccuccugauggcgcuaggucccagguucgcuaguguccuagaggggaucggguugcuccacaggccguucuggagggcgcugccugugcuggguggcuuuuuaaaaauuuuauuuuauuuauuuaauuuagaaauaguaguugaaaacuauuugacuaaugagagaaaacaucugacuggcccuccaggccaggucaucugucuguccccacuuagcuacuauaaaaucuucauggaaguuucucaaucuuuugguuuguaccuuaccuuaccucugccuuuuuuuuacuaacuacgucuuauauccuucuaaagacucauuuauuuauaccacacuugauauuguauauucgcauuugcugauugaauuucguaauugguuauuauuuuguguuuuuaugagcugugucauuuauuucucuacauugaucuauuaucuaaccauaacaaggaauaaaauuuguugagugccaggcacuuucuuaaugauuuuacaaaauucgaggugguagcuacuacuguuaugcccguuuuuuagaugauaaaacugagguacggggcacuugaguaacuugccccaggccacacaggauguaagugagguauccaggguuugaacuuggacaauccguggagguccagacuggcagcuuaccccucaugcucugcuacugggaggaggugagguaguucucaugaaucgcccuacuucuccuggucauagcauagugccucacacauaguauaagcucaaacuaagugucuaauugaauuuccauagggccuuaaauguuacauucauggugcucagcuagagauggcgucagaaaucuaacucgggaggagacacuuuaucugagggcuuuauaaugucuugaaaugcuuuuucccuacaaugucgugguuauuuuuuucuagaccuuaaaauuucuaccaacauaauguaauaagcaacccaaauuuuauauaacuguuuauguuuccaaacuauuaauaauugaagugacaugguauuguagaaagauuauuggccucuaaauagaccagggucugaauccuggcucugcuucccaguugcugcuuaaccuuaagcauauuauuuuaccacuuugagcuugaguuucuuuaacugaaauagggaugacaauacuuagagaguuguuaugggaaacagagaacaugcuugcaguauugcaguguaguaggugucgaauagguauuaauauucaugaugauaggaagcaauauaccauagugguuagaagucagacccaguccauuccccaaccccgcugaggcaguaauuuguuuucuuucucugcuugaauuguuguuucacccuuguccauuucaugaccucuucaucuuuccacaucuaguucagauaucaucucccuguaguuuucucugaccucuaccccaaaacaaaaucccuggcacuuugugucccuguggcacauuaugcuauacauaggugucacguacucuuauaagcguuucacauaugcuaacucauuuaaucccuggugacgaaaagguacuuguacagaugaugaggaaauugaggcaaagagagguuaaauaacuucccuaaggucaacucaucuaaugaguggcgaagcugggauucaaaccaggcaccuccugucucuuaaccacagccuaugccgcuauaguuaauucuugcuaaacuccagcaccugauaacauguaucaugugccagaaacuuacacuucuuucucuucccugcagugacccuucuaggaagauggcaucucucuuuaacauacagaacucagccauuaucucucagccucaccuuuucaauuuccuuuacugucuaguuugauggcuucuuaguucacucccuugcuguguuucucuuccuuuuucuuccuuguuucagcuaagauauucucugguagcuaguaaauauggauaagaauaaugaugugaagaucuuagaagcuauaagauaauugaaguuacuuauaauaaagaacuagaguucuguaaaguacuagacgacucuuguagcaucucuuuuaaguuucauauauuuucaucuuguuucugauccuuaucuaauuaacuagccuuucuucaaggaucagcaugugguauaaaaaauauuuuaacaucaguuuuacugcuuuucuuuugaucaguuauuacuguuacaaaagauuauucuguuugccuuuuagguuuacuuuguuucaguuauuugauacugaaggaagcauuuguggauugccuugggaacccaguaaccauauuuaguaugauuucuaugguaaaacuuguugaauuaaaaauaaguaauaaaauugauaaucuugacaugcaaccuguaaaaucauuuugugaauaggaugcaugaauaggcaauguauuugauuguuaguuucauauuuacuacuagggaugcaugggaaaugcauaaaguggugggcaaggucauucuucuuuuccuauuuuugaauaaaaaaugaagaggaaagugaaagaauaaauuagcuauauaauauauauguaccaucugaaauugucucuaacuuuuuauaacuacagguugagcauccuaaaucugaaaaucugaaauccagaaugcucuaaaauccaaaacuuuuugaacaccaauauagugcucaaaggaaaugcucauuggagcauuuuggacuuuggauuuuuggauugaggaugcucaacugguauaauguaaauauuccaaaaucuaaaaaaaaaaaaaaaaucuaaaauccaaaacaauucuggucccaagcauuuuagauaagggugcuuaaccuguacuuuuaguuaaaaacaaaccuuuggagaaaaacaaagcuuuuuuuucuucuauguuuuaaaaacaaagcagucaaaaaaucugaguggcaugaauucuaaaauuuguaaaguauuauuuuugauauuaaaggaagauguagauuccuucaugaaacagccugggaaugagacugcagauacaguauuaaagaagcuggaugaacaguaccagaaguauaaguuuauggaacucaaccuugcucaaaagaaaagaagguaaguguaaaaauuucuaaguuuugaaaaucuuauaugacuugaacuuuuaaaaaauugagauauaauuuacauauaauaaaauauucagaugucaaguguucaguccuccaagguggcuguaccauaugaaauucccaccagcaacguacaagaguuccaguuguuccguauccuugccaacacuugguauugccagucuaaaugugguuuugaaaacauaauagaaugguuguuaaagacuguauuccaaagcuuucaaaaucauaacgucuuauaugucuaguucauccuucuaauuuugccagugagauuagagacccacagagucugggcauaagacuuaauuaguuaugaaaucccaagauuucauaacuaauaggcauaggaaaaaagcuauccuuacucucaacucuuuauuucccuacauuauuuuauauagcuuauaaagucaauucacuguaauaaauauuuauagaucucuguuuugugcaugugccagcauucuucuguaagauaaauauuuauggaaugccagcuagaugccacauacuguuuugggugaaauaacauccaguaucugcuuucaacaaggacacaggacugggcaugguggcucaaaccuguaauuccagcacuuugggaggcugaggugggaggaucacuucaguccaggaguucaagacuagccugggcaacauagggagacccccgucucuacaaauaauuaaaaaauaauuaggcugggcccggcggcucgcaccuguaaucccagcacuuugggaggcugaggugggcagauugccugagcucaggaguuugaaaccacccugggcaacauggugaaaccccgucucuacuaaaauacaaauaaauuagccagacgugguggcaugcgcuuguaaucccagcuacucgggaggcugaguugggagaauugcuugagcccgggaggcgaagguuguagugagccgagauugugccacugcacuccagccugggcaacagagugagacuccaucucaaaaauaauaauaguaauaauuagcuggguaugguggcaugcaucuguggucacagcuccucuagaggcugaggugggaggaucgccugaacccaggacguugaggcugcagugagaugugaucaugccccugcacuccagccucggcaaaagugcgagacccagucuaaaaagcaaacaaaccacacaaaaaacuagggacacaguuugguggaaauuauagguauauaaauaaaauuagcacacaaaguagaacaguagagguacagggggaugguaacucauuacuuuguaccaaagcaccucauuaaccuggaggggccaaggagguucagaggaagcuucuaagaggaacagauagcuguguagaauuucaaagauuaguugugaguuuggaggcagacuaaagugaggaagggguagucugggccuaaggcaccauuuaugcaaagguacagaaguuuguagguauauuuucucauuugauuuuggugacaguuguacaaaguugaauauguacugaguauuagaugagaugaaaagucauugacauggaaagauggagaguguuaauggacagaagcaagauagaaaacauuaagaacagugugcucucguuuuggaaaaaaauguauguaugcacaggaauaucuggagaaauccacacuaaaggcauauuaacagugguaaucucuggguaguuagaauauggcauuuuucuuguuuuugcuuagcuguuuucuuaauuuuuuacaauguacauguacugcuuuugugauaguaaaaguuuauuugaaaaagaaaaauaaagccauuggauuugagaucaccuacagggagguuacagauagagaagaaaaugugccuuggggcggggugcagugguucaugccuguaaucccagcacuuugggaggccaaggugggcggaucgcuugagcccaggaguucaagaccagugugggcaacguggcaaaacccuauaucuacaaaaauuagcuagguguuguggugcaugccuguaguuccagcuacuagggaagcugaggugagaguauugcuuaagccagggagguugaggcugcagucagcugugagugugccacugcacuccagccugggcaacagagugaugauaccccgucucaagaaagaaaaaaaggaaaagaaaaugggccuugggaccaaguccugggagagggggaaauuugcguaucaaacuuaaauugcucuucuaacuaguaaauuaaugauagacaaaaacaaaaaaaagaaaaaaguuauauugcuaacucuacaacugugguauguagcaggauacucacucuagcuuaacauauggucuaggccuaaauguggggagaagggguaaaaauucaaagcacuuaggaaacaucagugaacguugguguucuggaugagaacaguguuugucuaguguuuuaaaagagaaugguagaguuggagauagugaguuaggaaaauuuucuugaguuuuaccuauuuuaauaguggguuggucauuuuuuugagacaggcuuucucucuguugcccaggccagagugcgguggugugaucacagcucacugcagccuugaccuccuggguucaagcaauucuuccaucucagccucccaaguaguuggagggcuacuuuucucuuuuuauuuuucuggaauuucucucacuccuaugaugucagcuaugcaacaaaacuauuuuugugucaugaucuaguuguuuugcagcagauggcucuauguaguuuacaugcuagccuuuuuguuuuuuuuuuuuuucaauuugcuauuauuuuauuuaggauuuuugaauuucuguucauaagugaguucagccuauuucuuucuuuuuuuuuuuaauuuuuuuaguauugaucauucuuggguguuucucggagagggggauuuggcagggucauaggacaauaguggagggaaggucagcagguaaacaugugaacaaaggucucugguuuuccuaggcagagggcccugccgccuuccgcaguguuugugucccuggguacuugagauuagggaguggugaugacucuuaacgagcaugcugccuucaagcauguguuuaacaaagcacaucuugcaccgcccuuaauccauuuaacccugaguggacacagcacauguuucagagagcaugggguuggggguaagguuauagauuaacagcaucccaaggcagaagaauuuuuccuaguacagaacaaaauggagucucccauguccaccucuuuccacacagacacagcaacaaucugaucucuccuuccuuuccccacauuucccccuucucuauucgacaaaaccuccaucgucaucauggcccguucucaacgagcuguuggguacaccucccagacgggguggcggccgggcagaggggcuccucacuucccagacggggcggccgggcagaggcacccccccaccucccggacggggcggcuggccgggcgggggcugccccccaccugccggacggggcggcugccaggcggaggggcuccucacuucucagauggggcggcugccgggcggaggggcuccucaccucucagacgggguggcuggucagagacgcuccucaccucccagacgggguggcggcggggcagaggugcucuucacaucucagacgggguggcugggcagaggcgcuccccacaucucagaggaugggcggccgggcagagacgcuccucacuuccuagacgggaugacggccuggaagaggcgcuccucacuucccagagugggcggccgggcagaggggcuccucacaucccagacgaugggcggccaggcagagacgcuccucacuucccagaugggguggcggccgggcagaggcugcaaucucggcacuuugggaggccaaggcaggcggcugggagguggagguuguagcgagccgagaucacgccacugcacuccagccugggcaccauugagcacugagugagcgagacuccgucugcaaucccggcaccucgggaggccgaggcuggcagaucacucgcggucaggagcuggagaccagcccggccaacacagcgaaacccugucuccaccaaaaaaauacgaaaaccagucaggcgugguggcgcgugccugcaaucccaggcacucggcaggcugaggcaggagaaucagucagggagguugcagugagucgagauggcggcaguacaguccagccucggcucggcaucagagggagaccaugcaaagagggcgagggcgagggugagggugaggcuagccuuuuucuuuguauguguuguaaaucuugcagccugucauuuaacuuuacccuucaagcuguguaaaaguuccuuaguauuucauguguuaaucucuuuuucgacacuugaaucugagaucuuuuaucuuucuuuaauuggaaauuuugugauuaucacuuuuucuaucgucuguuaauuuuuuuuccucuuucuuucugggauuccuguuuacagauguugacacuucuaauucugccuuccauuuauuuauauuauuucccuuuuuucugucuuugucauuuaucuuuuggcaauuagauggauagccaugaguucuuuguuucagcuguuaagauuuuuauagcugguaguucugguugguuccucuucauauuaccaauauccuuucuuuucucuuugugguaucuuuaaguauuuaauguauaguuuuaucuuuugguauuuguuaauuuuguuucauaugguagagguuguugaauuuauugucuuuauuuauuauaaugaucaaauuauaaugucuuuucccugucagcuuagauucccucagggauaucagcuacuuuggccaguaauguacguggagguggggguaauuuaagucacuccugguggguagcaguggcgcuaccucggcucacugcaaccuccaccuccuggauucaagggauccucccgccucaacuucccaaguagcugggauuacaagcaugcaccaccacgcccagcuaauuuuuuuguauuuuuuuuuaguagagacugaguuucaccaugcuggccaggccggucucgaacuccuggccucaggugauccacccgcuucggccucccaaagugcugggauuacaggcgugaaucacugugcccagccaagcuacuuucucuucaggugaagcaggguagggaggaguguauugcuugggcaugugcugugucauugguggucugguuccuaaguuagcuagggcugcaucugauugauucauuaauaugcuuuauagcauauuacauauaauauuuauauauacagaaugcaucuuaaaagucauuuacaugacaaaaaaucuugaucugaacauacuccuuauguuguguguguaucacauauuuuacaaauguauaacaucuuucuguuuaccuauaugaacauaucaugcaaaaauaagcaaacuugagcaaucuauggcauccagauugaauuguagugaaaaaaugaaugcuagguguuucuagauuauucacuggacuguauuaucaaaugaugacacuauguuuuuuucuuaagcagcaggcucauuuaacacauuucuugccaggucaguagcacaggguguaguaaauuugcccugccaaccugcugcacacauggagugacuucuuuuaugugacgcaauaaguucauuuucauuguuguguuuauauuuuguuuacauuuuggucucuaauaauauuuaguaaauuuaccucgaaagaaccagagcuucguuuuuauauccuuagucuguuuugcuagaaauuacauuugacagagacccuagaacuguuuugcauauaucuccaugcaaaacacaugcaucuaauuaccauaaagagcuaaaccccagugacaaaaacgguaucauuguuuucucucuuuaauugacugaauguuuuuagcauacuguuuuucucuuauguucuugucagugagguugauugcauuugggagucacuuacuagcauuuugcuaguagcuaucauauaacuuauccauuaagucggaucaguuguaucauguccaucauuguuuuuuuaaauuucuuguguuuaaaucagugauccauuuauaauuuuaagaacgaucguuaccucauuugaaaagaagagcauuuaucaacauaaaaguuaaggaagaaauacccaaagcuuaaaagaaucacuaaauuauacuguaucauaaugugguguguuuggcauucagaugauucuguacauuuuucacagugugacaagugcacauacugagaaggugucacugugcuuugccuggcauuuagcugacugugauguacauguguguauacccaaugcacacaccaggaguagcuaugugcaucacuggauaggggauuggugucuucuauuuuagaauguaacuuuugaauccauguuauuuuuaaaauuaguuuuaaaauuaaucuauuuaaaauuucauucuaaucaaaugcagaaccuaugaaucaccucuguggaauauagucugcucuagaaauguuaaauagccaugggguauuugacauaauagaacagagcuuugucuucauggaaugggcauuccauaaacauucacuaguauaucuuaaauauuuuuauuaaguauuuauacuuuaaauauuuuaugaauauuuuacuaaauauauuuucuuuuggugaauauuucuuuaaauauuuuauuuuuauaaauauuuauaucuuauuuuaucucauaucuaaaaauaucuuaaguauuuuauaucuauaaauaguccucaagaacacauuaguagaaaaugcaaaguuaguaagaccguguccuguuguuuauuuuugccugcaaaauacuaaguuacucuuuuucuuguucacaggcuaaaaggucagauuccugaaauuaaacagacuuuggaaauucuaaaauacaugcagaagaaaaaaguaagugcauuuuuguuuguaaauaugagcaagcuaggauaugucagcagaaacucgucuucuuugacucuuuggucacugauauuugaucugugcuguggaauccagucugccuucuuaagcacauacacuaauguuaugaugugcuucuguagcaaauguggcuuuguggccuucccccaaaagucaaguuuaauucuagggcccacacuuggauuacuuugcuuaucuuuagugcuugugaaacuuaaaugcaauuugaaauuguuuuagguguacaaagaaaaugucuuauucugugcuagcagcaucuaggguuuuuucuuuguuguugucuuucucccuaagaauaaggaguuaguccaagauuuauagagcuggaacgaaucuuagagaucaucuguuacagguucucauuucauaguugaggaaaugguuauggagagguuauacucgaccauugucuauguaguuaguuacuggcagaacuaaauuugagagucuucuaagucuuaauccaguauucauuaaauaaaagcagguuguaaagauuaaaucucauaagcauauuguauuuaaaagauuguguguaugcuuaugauuuugcuugacugguagaauaacuauuucuaguacauuuuaauauguggugaacuuuguaagacuucagcaacugauugauugggcaugaagcaccaaugaaauaauagaagaauggcuaauucuuacaauaaugccuucucuguaugucaggcacucgggggugugugugugucuguguauacucagugcuuaccacugacuucauagguguagggacuguuguaauccucauuuuacagaugaagaaccugagauauagaaguuaagugagaugccagauuuguacagcuagugaguagcugagccagaguccauacccagccaccugggucuagcauucauuucuuuuaccacuacacuuagccugcaugaugguacuguuuuaaauguccuagguucaacugugcaaucucuccuuuauaaccuugguaucaaacuggccuguuuaugguacugucauuuuuuuuuuuuguuuugaaggaguccaccaacucaauggagaccagauucuugcuggcagauaaccuguauugcaaagcuucaguuccuccuaccgauaaaaugugucugugguuggggguaaguaaauguuauagccacagcugauauauuuguaaaccaguguguuuucuguagcaaacacacugguuuugcuaguauuugcuaguauuuuaguaguauugcucgagauauguaaaguguucaucuccuuuugauuguggaagggacaaagggacagaguccaagugguucauauuagaaauugacuagaaucagaagugcgaugaagaucgcaguaaaaacauacugaagucucucccaaucaagauaaaacugaucaaacaaacccugcuucucuuccaguuagugcuuuaucucucuuaaauauaauggaggaagagcaauagaaguaaaauagaagguacugcugaacuuuagauaaacgcuucuucccauaagaguuuaauaauucuagaaagaucccucucaauuuaaggggaaaaagaguauugcaaaaaguuugagguuagaguuuauuuuuuaaaaccauguauuucaguuuuagaugauuucauugagcuuaucugugauuuaccuauuuugcucuucucaguccucugacuauccagcuaccugucuguggaucuuguuaccucaggcaaguucucauacaaaguagcaagccaaguguacuucuaccagcuguccuacggggaggauuuccccuagcugcuguccuguaggaucacucuggagaggcacucuagauuagcccaaggagguuugcucaaaguuuguacaacauuuauauuucacucuacaaucugcauuucaguauuuaucuuuuauaauuuaucacuaaggcuuuuuaaaaaauaacuuugaagcauagcaacuacaccugaguguccaaggauucaaugauuuucuguauucaguuuuuuuguagaaauugcaugaccuuuugauucacaaauucaaguguuacuuuauuucaggaaagauaauuucuguuguguacuugaaugugacuuuugccccauuucuuuuauuaucuuuugggaauaauaaauaugcauauguucgaucuccuuuaucuguuuucaguaccuaucauguucucuguuuucaguuauucgauguguuucauucugugugauuuccucuggcugcuuccccaugacuuuguguuuucccugguaguuauucuguuuuguugcuuuuacucugucuuucguaacuguucuucuguuucucuuucucuucauuuucuuugcugagcucuucuugcucuuuucauguuuuucuucuuucauuccucuugaauguuuaaauccucauuucaccacucauagacuggcacuucccacaaucuucuccaucucaguaaauggcagaaucuuuugccugguugcucagaacaaaaaucuuugagucuucuuugacucuucuuuauuuuauaucucucaaccaguccuucagcaaaccccacugguuccuucuucugaauagauugagaagccaacuaucucucacuuccuuacugcuguuaccaugguccaggccaccuuugucucuugccaggacugugggaauacugucuauuaguuuuuagggaugccauaauaaaauuaccacaaacuggguggcuuuaacaacugaaauggacugucucaugguucuggaggccagaaguccgugaugagccccagaaucagggucgauuccuucugagagcugugagggaaaaucuguucuagccuccucucuuagcuuugguguucgcggacagucuuuggcauguugauguguagaagcaucacugugaucuccgccuucaucuucacaugugugcaugcauguguccaaauuucuccuuuugaaagaccuuaucuccaaauaaagucacauucugagcuacuggggguuaguaguccaacuuauuuuuuguuggggagacagaauucaauccauaauaccuuacuuccacguaaggucacauucgcuaguauaagggguuaaaacuuaaauguaucuuuuuuggggacacuguuuaacccauaauaauacccuaauucacugucuugcuucugcccuugcuggaauuccuaaagucuuuccagcacaguggucagauuaauccuuugaaaucucaaucaggucauuccauuauucugcccaaaaucuuugaaugguuucuuaucacauuccgaggaaaaguccaaguucuuugaguggcugacaaguuccuauacauccugguacucucuguuacuucucucuuuuuuuuuuuuucugagacagagucucacucuguugcccaggcuggaguacaguguugugaucucagcucacugcaaccucugucucccgggcucaagcgauucuugugccucagcuuccugaauagcugggaucacaggcacgugcuaccaugcccagcuaaauuuuuugguagagacgggguuuugccauuuuggccagguugaucucgaacuccuggccucgggugaucugcccaccuuggccucccaaagugcugggauuacagguaugagccaccguguccagucucucuguucuucucuuacuuccucgcuuggccacacuuggacuucuugccagacuuagagcaugcugggaauggcccugccucagaaccuuuauucuagcucuuucuucugcuuaagcugccagaguagugcuuuuaaaacaugucagaugauuccgcuuuucugcucaagaccccagugguuucccugucaccaaggguggaauacagagguguccuuuccacaggacagcccuacucccucucagcacucauuuaugcucauucuuuugcucacucugcuguagccaugguggcccccuaacuguuccuggaaccugccaguguggccccacauuucuacuucuguguucuucacacucaauccuuugaguucucaguuccgauuguuagcucccccagggaccugcuaugacuugucugucagcauuucuugguuucacuuguacuguuuaucuuguauuguuuuccuucaaaguacuuagcacucccugauauguuauugauugguguauuuaccaguucccugacacauaauaagugcucaguaaaaauuuuucuugggugaaugacauuuuuguuaguuuuucaucagaguucauacaugcuaaugguucaaagagcaaauagaaagcagcaggcuacugcuccauccccagaugcacccacuuuuaaucaugucuguauaucuguauguaccuaaauauuuggaauuuuguuaauuguuuuuacaaaaaugggauauauauuguauauuguucagcacagaugucuuuauuugugaguagacacagaguuugccuccuugguuuuauuggcuuacuauucugugguagggcuaugugauaauauucccaagucaagggguguuuggauuguuuuaaaauuucuuguacagugagcggugcuguaguaaauauuuuugcacguauagacuuguauacaaaggcauauuuuuguaugcugcuuugaaauggaauuguugugucuaagaguaugcacauuuaacauguugauggauacuaucaaauugcucuccagaaaagacuaccaauuuucauuuucuccaaccguauauaaaaauacccuuuuauuaacagucucacccacauuuuuagauuuuugcuaguuuuauaggugaaaauaguaucaucuuauagguuuuuguaugacaaaaugcucauuuguauuuccucuucuguuucccuuccugauuauguuguugcuccauuuuucuguuggauucuuuuucuuuuuuuuuuugauagacauuuaggucuucuuuauauauuauguauuucggaugcacagucuucucuuaauauugcagauacuuuuucucaucugucacuugucuuuugugguagcucuuagaaguuuuaaauuuuaauguaaucgacuuuaucagauauuuauaauuuuaucuuaacaguguacuccuuucaccaaaucugcaaacauuuuuuuccuaauauuuauauacuuaaauuuuuuagaaaacuuuuuuguuaaggauaacauggaaagauaagcaacuccucaggauaaugggugagugacuuccaaaaagagggccucccaauggccaguaaacauaugaaaaguugucccacuucauuaguaaacagggaaaugcaaauuaaaagcacaaugugaucucacuguguacccaccggaaugguagggugauacuaagugaugguaggacauggaauagugagaacacugauuuacuguuggugaagguguaaauggacacagccacuggggaaacuggcaguaucuguuaaagcagaacauaugcauugccuaugccauagcaguuccaugccugucucuaucucuuucugccucuugcuguauauaagaaauguauaaauauuaacuaaaagaaagguauaagaauguucauaucaacucuguaguaaccaaaaccuggaaacaacccaaauguucaucauagucgaauggaugaguaaaucaugauguguucagacuguggaauacuauacaguacagaggaggaaugaacugcugcuacacgccagcacugcaagggugauuuucacaaacaagguugagugaaagaaacugcauagcaaauuaccacaaacucagaggcuuaaaacaauauccauuaucuccuagcuguauaggucagaaauccagaugggcuuggcuggguccucugugcagggucccacaaagccagaauuaaauugucaacagggcuguauuccuuacuagcaucucugggggagaauuagauuucagccuuauucacguuauuggcaaaauccgguucucugugguugaggucccuguuuccuugcugccugucguccaggagucagucucagcuucuagaggccaccugcaauccuuggcucaugguccuuucuguuuucaaagcagugauaugacuagucuuucuuacacuuuagaucuuucaaacuucucauucugcugccagccagaaaaaguucucugcucuuaagggcucauauaacuagauuaggccuaccuaggcagucuguauauuaaggucagcucugacaaaugauguaaauaucucaucagagucacagauuccagagauuagaaugagacagcuguuaugggagccauaauucuugccuacuauagaagucagucacaaaagagcacauauacugugucauucuguuuauguaaaguuguaauacaggcaaaacuaugcuguaagucagguuaaugguuaccuuugcggugggggugcuggugguaacugaaaauguucacaaggaagcuuugggguguuggugauaaccuguccuugaucuggaugcugguuccaugaguguguuaaguuugugaaaauacaucaagcuauauauuuaugauaugaauacuuuucuauauguauauaauauuaaauauaaacaaaaaaaucagaaaacugcauaaagcaaaguguaagugaacgaaucuguugucaggguucaaccggagaaauagaaccaguaggauauagcuaaccugcauaaacuugugugcaaagguucagguuaauauguguguaccucaugguuucauacuguuaccuccaauucaaauucaggacaacagaguuuucacuuuaguuguuccucuguuuuuuuuuuuuuuuuuuuuuuuuuuuugagacagagucuuguucugucgcccgggcuggagcgcagugacgugaucuugggucacugcaacuuccgccuccuggguucaagugauucuccuccuucagccuccugaguagcugggauuacaggcacgugccaccacgcccagcuaauuuuuguauuuuuaguagagacgggguuucgccauguuggcuaggcuggccuugaacuccugaccucaagugauccacucaucucagccugccaagugcugggauuacaggugugagccaccgcgccuggccccccuguuucuucuauaucaagaauccugguuuucagaaauaccaagggugauagaauuaagcuagacaacauuacuauucacacgcaaagcauucuuagaauaacaccacccaacacuguuaccacugacauuuuugcauauguucuuccuguccuuacacauucuuuauaagguuguucccacauuguuggagcacagagccauuauauacuguuugcucucucucuuucucucucucaucuuucauuuauccuaguucuucguguaaauauugaaugcacaucauagucuuuauguugauguccccccagucaucauccagucauuuugauuguauguuacucauucgucugauaaguagauugccuuaagauuuaugggaaugauauucccugaguuaucucauguugcugacaacuugucuguggccuuuguacuugaaauucaguuuugcuggauauaauaucuuaaacucacauuuuauuuccuugagcaucuuauacagugccccauuuucuuuuguuguaaagcaucacugucaaaaagugugagggcaaacugauuucuuucuucuaugagugauguguucuuuuugccuggaugcucaaaggacuuuugggucaguuucccccagguauacaaaguacccuuucauuucauuuugcgugucauuucacccaguguguguguguguauguguguguguguguguguguguguguguaguaugugcaugugucacauuucaggaacauuuuguugaaaugaaggauuuagaaauuuuuuugguccccugcuuugguuuuuuuuucuuuguggauucuuguuauauuuauguucagucuuugcuuauguugaauauuuuuguccuaucugaauuuuaauacaguuuucuaauuauggauuggauuauuuggucaauaaguauuuauuuggcauuuacuuugugccaaauacuuucauguugucuuguuuaauccuuacaacaauccuuugaguaauuuuaaaauugcauuugugagaugaggaaagugguuuaggaaaugccagugguaagucaggugauagggagaguucaaagcuguaaaagguguggcuucccaauuccaggguacaugcaucccugaauguuggcaguaacacuagaucuucagaaugacagacacauuaccuugucuuaaucccuaacaucugucagaaguaguaggaagggacagguaaaagcuagcugucuuuuuuaccuggucaaauauagaugauaauaaaugucuuugaaaaauuuuaaauuaauaucauaucucaagcucagaauuuauuuaaauugauacaaacaacacuauuuaguuucacgauggagguaguagaaagauaggauuuuguaucuaaacauacugguuucuuauccugauucucccauuuacccacuagcuaugccagcuaaggaaaccugagccuucauuucuuuaacugugaagaagacaacuuuggccucagcaggguugaggauuaaaugauacaauguauguaaauauauucuuuaaccaaggggucagcaaacuuucuguaaaaggucaaaugguaaauauuuuugguuuuguagaucacauggucucugucucaaccacucaguuuugccauugugguaugaaagccugaguagagaauagcugggcuccagugaaacuuaacuuacaacaaaaggcagcaagcuggauuugaccugagggcuguaguuugcccacacuuuacucuaaccuauaaagcucuguguaaauauugaguaauugucaugacuuucucucuucaggcuaauguaaugcuugaauaugauauugaugaagcucaggcauuguuggaaaagaauuuaucgacugccacaaagaaucuugauucccuggaggaagaccuugacuuucuucgagaucaauuuacuaccacagaagucaguauccuuucuuaaaacaaaaagcaagggaaaaaaggagaaagauuuuuuuaaaaaaacauucuuucaugggcagagggagagcauuaggaaaaauagcugaugcaugcugggcuuaauaccuaggugauggguugauaggugcagcaaaccaccauggcacacguuuaccuuuguaacaaaccugcacauccugcacauguacccuagaacuaaaaaaaaauuagaauacaaaaaaccucccacauucuuucuuacauugcuuuagugggaagaauuuccuuauuaggcuaauauaaagguuauagauuuuauaagauaauaaauaagauauucggaacuaguacuuaaauaaguuuguagauagauuagugauuuugaaaugugauguggaaacagcaaauucacauaggugaguaaguauuuuucuuccaaauauuuucccaagacaacuuuauaacugguuaaauaguuuaauuucacaagcauuuaagggucuccuauguuccugcaacugugcuaagacauauggggcaugaaaaucaauuuuagaaaagaguggcagugccuuucucugguagaacuguacauguaaaacagcugaaugauaauucauagcaaacuauaaguaaguuaacauaugcaacaccaaggcaauuuaaacuuugggaaagauagauguaggcuggacuuaguucaaagaaggcuuuguugagaagauaaaaguuaggcugcuuuuuuaaaggcggcguaggguuuaaagaucagcagagagaagaggugggagugggguauucuggucaagggggaaggcaagcucuuugccuuucuucucuggccugucuuuuccuccuacuuccugucacagucacucaagacaaaaucacgggagucaccuuucacacuucucucuuccucacuaccaauaauaaaucaaucgccagauucacaucaaauuucccucauaaaucucucugcccauuacuguucucguucuggggcuccaaaaccugcacucagaaccuuuuuagguuccucucauuccaucuguccuucccacuaucucuaguaugaauuuacuaggucacucauuuuuauuccucugguuacaauauuucaacgguuccuuguuacuuacaagauauacauauaggcacucuugugaagugcccccagcuugucucaccucaugccacugaccucuucuugccuuuccccagugcauuccagguuccagauaaccccagucaguuauuguacacacuccccaauugugccacacccuuugcauuucuacacuuuguuccuccuaacuggaaugacuuucccauauuuacaggaugugcucuuuuuuuacccuuuuacccuaaauaucucaguccaagcaucagagcuuuccugaacauuuucugauccucagaguguuucuugugugcuugcuuaacacauacugcuuaguuuuaccuugccaaaccgugagcucuucagauguaggagcugcacuuucucuucuuuuccagugugcagcauguggcaguuguuuaugguuggcugagggaaggcaggccuguuggggccuagugcaguggucaucaucaucugacggguaguguggaaacuucauccagcuaugagaugacgagggccuaggacggguggcuuguggaaaggaaaagauauuaaacgugugagaaaaaaacaggauccagugacuuagauggguacaggagccaaaagugaggaaauccucuaagaugaguccuacaagcuuaguuaaaugccauuuguuauugcuaguacugcaaaagguaggaaaggaaggugugcagacaagugagggagcuaggguggacagucucuguuacauugacauucuacuggagucuaagcuccacgaggaaaagaacuucaccugucuuauucaggucagggcuuuguacagugccuagucaaaaauacaguagaugcuuaauaaacuuguuaagccaaagggaggguaagagauaaaauuauugauaauuguaauaauauaaauauuacauggcaggauauggguugagugaucuuucagauuucuuggaugagggacugucuuuaaaacuaucgagagugucuaguacauauuuguuaaauauaucauaguugacuagcugacaguugacuaauaccauaguaaacaauggguuaacaauuaauuugaguccuuaguuuugauagaguuuaauuauaguauuuuccuaacaauugacauuauagcaggaugucuuacaauacuauuuguuaccaguauuuguauauguuucauuucugugucuuugauucauugugugaguggagugaauacuuagucauugcaugcauuaucuuuagaauugcauuugcauuuucuuugacaauucuugcagauauggccaggguuuauaauugggauguaaaaagaagaaacaaggaugacucuaccaagaacaaagcauaaugcuggcaauuaaaaaugugguuuaguuuuccaaacauguuaucuuaaauaccccuuuauccuuacagguugacauaacuuugaauguuuuaacagcaagaauuuuaagaaaagauaaacaccauuuuauuuauuuauaaaaacaaaauuaguuucaaauauuuuugacauugugauuuuuuuuuccacauuucucagcaaagcuaaugguauuuuaaucauuauuuuugccugucauaagaaaacucuuagcugaaauggccgaaaacugugagacaugcuauggaagcugaaugccggacgcuagcacaguuuacuuuuucccuuucuaaucggcugauguuacucucacuugaugugguuaaaccauuuuagagguagagaagacagacaguuugaauauuuguaaacuuguuuuucuuugguauauuuaggacuuagugguccucuguugcuauugucuucuauaaguggaguuucaugacuuacugcuuaacgaauaacuaacuacuaugauauucuggacauuuuaggaaaugguaauuugccuugcuacacauuaagagggcuauuaagacuacauuuuuucuaaccucagauaagugcagugucuuugcaaugccaacauaagggagaucuuggccaacgugaaauaaaauuacucauucaaaacucugccuaaggugauuuuguaguucuuaacaguucuccagagcaucuugaacaggaauauuaagauaaaugugaaucugcaauggcugaaaagaguugugagcuuuuuuauucaugauaaaaccuuauaggaauaguauaaaaaaucccuguggaaagcuacuaguacauugaccagcgcugggugauacagauucugauaaaaacauaaauguauuaguucaucuccauguaguaaaaaguauacuuauacaauguuuuguacuuguauuucaugaaauuaaaacagugaugcuaaaacua

SEQ ID NO: 192836 - RNA, 6327 nt, Homo sapiens
ccaggcgucgcgucuacgcgggggauuacaguaacccgguugucagugaugagucagagugcguggugcugaugcugcugccauuucaucaccuuugcgagcgcagcauccaucccuccgcucucccggcgccugggccuacccagcuucgggcucccaggccagcgaugcgcucgcggcugagcuagauccugccgagccgcgcucucugaggcgucggcggggcgcccccucccgccguccccgguccgggccaaggagaccugcagagccgcggccauggaggccaucuggcuguaccaguuccggcucauugucaucggggauuccacagugggcaaguccugccugauccgccgcuucaccgagggucgcuuugcccagguuucugaccccaccguggggguggauuuuuucucccgcuugguggagaucgagccaggaaaacgcaucaagcuccagaucugggauaccgcgggucaagagagguucaggugggagcgcaguccgggcccgcaagcagugggagggucuucgggguuugcaccgccucuggggagagaggacuuccugguucuaggugcgguccaggagggcaacaccaagggucuugaggauucugccgaagcccaccuucggcuaacccggaguuuagugcaaggaaagaagcgcccuggcagggaaggccggucaauaacacauauugcuugcaccacaacuccaccaaccugcccuuugguggcuaauaaacuagcuggaauugaucucuguaucuguaauucaucaaucucagucccuauguuacauacuuucaaaaacguucccaggucauccuaacauaacugacagagauuuaaauacauaaauacauguguauuauguuuuauuuccacaucugugugugugcacauauauaugcuaacauauguucuaacaugaaauagauacgauugauuccuucuugcaaccagcacacauucagugaucaucuacuaugugccagacucugggcuuguuccugggaaaacagugugaggagacucacacaaggggaugccauguaaucuaaacagacaaagccccuucauucuuggaacuucugugcuaacauaguugagggaaauagauaaucagcaauuacgaaagugugucuugcucauauuuguaugcccacucccuacuguaacacuuggcacaaaaugaacaugcuuaauuucaaucaaugaauucauugaauaaucaaugaauauguuuacuuucacucagaacccuuugcuuuucuauuguagcauguauuauuuguaauuauauguaugaacacagaggaggaaagguuaacuggagaagaugagaccggaugaguaugacugccuaagcaaagacaggaaacgcccagggauaggaaacagcaugaauaaagacagaagugagagggagcagaguguacacagaaaacuuugcagagaacaauuugaacuaaaguagagcagcaggaaccagaucaagaaaacucaauagcccaaguuuaugaucauuuacucauuuaucuauugaaaacuaacuaagcauagaagauacugguuggguaauugaagagggguaaggagaagaaauaauuacaaacuuaaguuaccuccagcuccccacuuccacaaacaccacuguggaaaauauccuuguacagguucacuuugaacuugcgauugcauuucuccuaagcaaagaaagguaucuuuuauguguuuguuggaauuucuuucuauaugaacagccuguucauauccacugcuuauuuauuuauugggcaauauggacuuguaagaguacuuuauagauuaagaauauuaacccuuuccugucauguauguuguaagauauauuccuaguuuaucaucugucuuuucacauuauuuaagauuuuuuaauguagggaagaauuuaagguuuauguagccuuauguccaugcuuagaaggccuuugucacuuucuuugcuaaguacucacaaacaauuaauguaauaauauauuccagaguuuugacagugaucuacagcuugcuuguugauuucuugaaucaaccuucucacaaaucaaaaccuuuguuuguucaugucuaaauuuucugguaaaucuaccauucuccaugaaucuucaaaccuaagagacgagaaaugcuuucaguccccagggcugauuugccugauuuuggagacuuaaagucauuuguaaguuuuacuuuuaccaucaucuagcuuggacuguaggucccuggacaaugcuuguucugcuaacauugagccauuuucucuaagcuauugaguccuucguugucuaucuucuuuaucugaggagacagaaaaccuaaaaauagacauagguaaaaaaaaucacaguagucuaaagcaagugacugcagagacaaauagguccauacccuguaauaagcuuuaauacacuguaagcaaagugccauaauguauauuuauaaugagguuccucaagucaagaaguuaaaacaugugaaguuucuucugauggcuccugaguugaguuggccucucugaaaugugucaggaaacagggcugagaggcacuuugccugaacccuucgccaucucucuuuuucccauucccacaggccuugaaaauaaaaaauaaaauuguguuucuccucacagaagagauugaggaucccuguuagcuaauaauaauaauaauaauaauaauaaacaauaauaauaauggaaagagaaaaaaacaugguaaugauaaauggaaaaaauggaguagcaagauaccuacuuuaaauauuuuguuaacuaucauaaauucauuucuauguuuuaaaaauccuguuucaacugcuagcauuuguaaugaacucuccacgucacagaacacuuuaauauccauuguuucauuuugccucaugguaacacugugacuuggguauccuauuuugcagaaaaggaagucucugucaguuauucagauuuggggggugggagaguuaguuguaguuuuaccugaaggcaagaaauagaacucaguuaugucccagggucacucuccagugcugaauccauggaaaaugccuaaaaguucaugaacauucguuucuagaagaugcccaucucaaaguuuggcccaauuggaaacucacauauuaguaguaguauggaaugccauuuguauuccuuuguuuuuuuaaaaaaaaagaaaaucauuuuuauuaaaggacugugucacuaaccaggaacacuugaauauacugaguucauugacaugcagaaguuugggcacagccuuuacucuuuacuucuuucuuguguuuuagauccaucacucgcgccuacuacaggaacucaguagguggucuucucuuauuugacauuaccaaccgcagguccuuccagaauguccaugagugguuagaagagaccaaaguacacguucagcccuaccaaauuguauuuguucuggugggucacaagugugaccuggauacacagaggcaagugacucgccacgaggccgagaaacuggcugcugcauacggcaugaaguacauugaaacgucagcccgagaugccauuaauguggagaaagccuucacagaccugacaagagacauauaugagcugguuaaaaggggggagauuacaauccaggagggcugggaaggggugaagaguggauuuguaccaaaugugguucacucuucagaagagguugucaaaucagagaggagauguuugugcuagucaguucuuuuauuuccaaaacaugcucuccuacuugaacugaaaaguaagagaaauaaauagaaucuuuguguaacugaugagaacucaaccuccauuuggauaccaagugagccucccucucagggggacucugacagacucgugugcggguggaugggggugccugagugcugugaccaagggacugaauugcugacaugggccaggccaggcacuguuuuguggcccaugcuaggcaguggcugcuccaugagcccuuuguggaccacauguuaaaggccugggguuuaggaagcuaagucccaggaaaacauaccuacagacaggacaacuguuccuugguauuugagcucacuuauaggccaugaacauaaagaaauacauaaaggggaaaaaaguuucacaauggggacaauuagcauaacuaaacaaagauuaugagcucuacuuauuccgugagaauacccugcaccaaagguguuugcuggguuugguuaaaagguaccaauuagcuuuuaacagcuuucuguaaaaugaggaacacagaccaaaaggucugguguucaaguaaaaaugaugugacuauggaaaggaaggcaaucgacacaguuauuagcacauuucagaaaaugaacacccuugugauagaauuaccagcuguaugaaacaaauugucccaugcaaauuacccuauaacuaggaaagagacacuauaacccaaaugccauacccccuuuuuccuuugaccaugccugggguuucaaugccuuggcaccugcaaucuggaaguaaacagucugcuugcuucuucaggcacgugacagugacaacacagugacugccucugaaaagagcccugaggcaaacacucucuccugcugaacaggaggcacuguaacccuuacaaacagcuuacaguuacuugggcuacuuauuugaucaucauaacaggccuacgagguuuuugccccauuuuacagaauaguaaacuaagagccaugaaaaucacuuggccagggucaaggacucgugacuccuagcucuuuucacugcaucauacugcugucagaugaauaaaugauuaugaauuuguuuacuugggaagagauaugacuauaaauaaauguucucuacauguuaggauauguuuuccuuauugauuacaacucagcuauaauccugagggaacaugggaaggaaucaaagguaaagcccauucaggcauuauugacaagagggcuuuaaacaagugaauaauugcacaacuaaaaagacauuagaacugugugggcuauaaguguucuuaucacugagacacaguggauuuuuauugaaaggaaccacguacagcaaugcggagugggauagggauaaaauacccaccccaaaaugaccuuggccaccugucugccauauacguacacugaguuccugucuacccaagagagucagcccuuaauucucaggugaacaaacagcuaacugcaucagcaaauuggaauggcuggcuugaaguuuccauuauuuucuugaagagaggugaugcuuuaaauuacuuuuuggauuguagccaguucagcuaggcaaaagccauacuuuucacaauuaaaaaaaaaaacuauucugacuagagucagguuucucauauccaucgugauaggaaggccuaagaauggcaaaucgcuuugagauauaauauugaacuucaguaugaaugugaccgaaucugaaacuuugggaauuugcuuuagccagaauaaagaaaccaaaucaugaaaauuauggaagacuauucugccaccugugccccaaguuggaugagcaaaccacuuuggaucaguucacagcauuaacuacaagugaacugaucaucuucucuauauucauuucacaagagcuggcuuaggugggguaauuaaauugccaccuucgugguuguaaaagacaaacaaaacauggcaaauuucauuaacacaaaauuucaucaacugcuauacugaauuauguuuagaagauucugaaagcaagauuauccaguggguaaaugagagucgacuggauucugucaguucaaaaaaggaaagaaacaaaacuucccuacaauuuucuucacuaaaauuuauuauauguacaguauucccacuccuggcauuuucuggcagguuuaaaaauauucagcauaaauccagcagagguggcugagcuuaauugcuuaaauaaguucuagaaaauuuaaaaaucauuuuaguagaauucaguaccauugucacugcaauaaguggguuuuagaaaauaagugugaaaagaaucagguguuaauauaauacuaaggauaaagcuuuagaagcuauuuuacuacauagguaaagaaaagauaaacuaacuuguaacaaagaccacaacugcauguuggauuagauugucucauauuucagaauaaaauguacuguauacuuuuccucacuuuguugugcacuguaaugaaaugugaaaaaugcuuuauuuagcuguaugugaaugaaaauaugcuuguauuuaguaaaaugauugauuauguga

SEQ ID NO: 192837 - RNA, 85240 nt, Homo sapiens
gugcagcaaccgacuccgcccagcgaggcggagccuagggaagccgcgggcggcccgccgcuguccuggagcugcugcugcugcugcggcggcugcaccggcggcgccgaggccgagaucgaggccggggugcgcgcuucgcaaacgugcccuauccgugcggcuuggcugcgccagcccuugcggccacccgggcgucuaggcgggucugugcgccgcccgggcgaggaugcggcuguuccgguggcugcugaagcagccggugcccaagcagaucgagcgcuacucgcgcuuuucgccgucgccgcucuccaucaaacaauuccuggacuucggugaguacggggccaaggguccccaugggcccggggccgccgccauucgggcugccaccccggaucuccgcagcuucgggguaaagucugugggaaccgcaggcggggcuagggaauauccggggggcucuccuggggcucggauuucggggcgcggaggggcagggccuggcccccucgcacccagccugggacuuacccggagacacagaaacggcgucucauugcaggacccucaucgcaggcgagacuccccaaaccugcggucguuagcuucaaaucugcuugacacaaaccucacagcccuuaaaacuucagaacgagauguggguggcuuuuuaauguuuuuauuuuuagaauuuuuuuuuuuugguuggguaagaacuguuuagaaauaccuugagguugaauaaauuaugcaauggcauuuuguuccuuuucugcucuaagguguugcuguguggcuggaguggcaggacucgaacuguugucuucaucagguuauguuaaaucaguuagaggccuggccugcagacgccuuagaugcuugggaagagcggacgucugggauccuagcaucagagcagggucuaauacaacucuggcuuuagugccagcaccuuucguuucucuucuccauuggugucccacccacauucucccuguccggugggcuggugggcggcuuucacggauugaggugggaccaaagaagauucggguucccagccugccucaggccuagcugagaugggaauagauuccaccaccuucuguuaacugaaucauguuuccccagaaaacgaaggagcugguugugaaacaccuaaaaguaaaacgcaugcauugagguaucagaauggaacucagcaucccuggaggaaaaucaaauccagcagcaaagauguucuaagcucuccaggggaaaucguagggugucuguucauuuaaugaauuuuauguaaaugucaagggugucagugauagugucaguugggcauaaaaacuaaagugcagaguagguagaacauuugaggaagaccugauaugcaaaaagugauguccauacuuuuuuuuuuuuaaaagcuaggauaggaagagaggaauagguuaaaguugagaccaaauuaaaauuuuagaagccaauuugccagagaaugaugaugaaagucaaaguucaaugacacguugauuucugcaucuucaaacuucacucccaaaagcuauugguaguuuuacuuacuaucucgagaauuguagagguuugaggcaguuucugacuuuagaguuuagaaaauguugcuauugcuauaaauauaggcaaguuuuccaucuuuaugguuuagggaagauucugaagguaucagccuuucauuaguguaaacugaaacaggauaauucacaauaaaaggaacaaaaggaauccagaaacucccaguucuuuccacccucaaaguuuaagugauagcuccaauagccagccaaaauuuugguuaguugauuuccauagcagcuagugucuacccguguuaauagguauuuugguaaggauguuaugugaguaggaaaaccacaguggaggauaguguuaucauggaaaaccugugaggccaguaucuggaaacaaauguucuaauucuggcucugccacuagcucagaauguggccuugacuaagugaccaaaccucacuugggguucauuuuccucauuaauaaaaugaguagauuguaucaggcgaucuuuaaaagcacagcucaccacuauacgauugugauuucaaaggaagaggcaugaacuuucuaaaagaaaacuaccaaaucuuuugauagauauuuccuauaaaagucuucugaccuauuuugggagggguggagggauucacuaaggucaugagagaagcauaauaauuuaagguuuuccuuauaaggaagcgcacagaagugcuagauauaguuguaguggaauuugcuagaagugacaaggcuaguuuguaacacccagagaugaaucaggugcuaaucagccuaucuuuaaugacaggacaacuaaaagacgggaguuguugcaaaaaggccaucucuacuucuacuuuucucuuaguucugucucuugauagcaguucuauuuuggcaauugaugugggaguuggagaauucagaaugggugugggauauuuuuaaggugaggagagaggaggagugaagaggcuucaugccccuguaugauuagagaaaacugcaggagagggccaacucaggcacuuaaagcaccagguagugggcaguggauaagugaaugaagccaacgaguugaggaccgugauaaauuccugguauauagcuagcuccaaaggggcagcugauuggcaccaauucaguauauuucaagagaacuuuggcauaaacaaaauagauggauggaucaaguuggcccacaggcugcuaguuuaugaacuugaugccuuucuccauggguacuuuacaaaugggacguacauuuugacuagaguaacuagacagggaccagagaaaggagauacacaggauauacacaauuuguuacaaccuugauaaauaggcuuucuuauguggauguacugcacaucaguaaauaaggagauuauuugcuauguucaaaaguggaggcuaaaacuuguuguuacuucagaagcugugcuuuuauuuuaaagcagggguuccugagccucagcacucuugccauuucaggccagguaauuuugguaggagcugucuugugcacugugggaaguugagcuacaucccuggccucuacccacuagaugccaugagcaccucccacuccaagucgugacaaccaaacaugucuccagucauugccaaauguccccugggggagcaaaauguccccuggacuucuguugaaucacuguuuggaaguguuuacuugagugguuuucaggccagggccucauacucugaauuuuuguuguaaauggucugggggugcuggggguggagagcagagcacugguauuuuuaggagaucccccugucauucuaaagcauauccaggguuaagcaccauuaaucagaugaucuucugucugaucugcuggcccccuuucaucuaugugcaguauuuuucucuaugcuuuuuaaaauaaugaaaguuucuugaacuccaucuugacuugaaauauagccugccacacaguuagcaaauauagcaagaauaacaaguguucuaaauggauuuuuaauuuauuauggcaauaguacauuccaaaggguggcauuuuuuaaaaugagauuuuucuuuugggccuaagauuacagucacaugguuccaaauucagaggguucaaaaggacacagaaaagccugcuucccacuugugcccacuggccuccccuuuuuucgcauaaauggcaguuuauagcuuugucuguuccuuguuuuuugagcuuaauaccuuagagacagauuuuuguauaucuguaccugcagaacuuuguuuuucuuuuuuauggcuucugagaauuugguuauaugaauguaccagaauuuauuagcaacuuucccuauugauggcuacaauuaauagguuguuucuagacuuugcuguggcaaccugcccuccagugaauuauuauaugcauugucauuucaugcauguccgcguguaucuguaggacagauuccuaaacgugagauugcuacaucagcagguaugugcauuuguaauuuuggcgaacauugucaaauugcuuuccauaaagguuguuuguuuucccccucgcuagaaguuucugagaguaccuguuuuccuaugccuucaccacauuguugucaaacuuuugauagguaaaaaaaaaaugauauaucuagauagaauuuuuuucuccuugaguaaagaugucuuuauuuuaguuuuuuauuguggaaauuaaaaaaaaaaacuuaggugggugccuguaauuccagugcuuugagaggccaagacagaggauggcuugagaccaggaguuugaggccagcccugggcaacauagugagauccugucucuaaaaaaaauaauaauaauaaauaaauaagauuagccaggaguggugguaucgcacaccuggggucuuagcuacucaggaggcugagacaggaggauggcuugagcccagauugaagcugcagugagcuguguuucugccacugcacuccagccugggggauguacauguauagguaaauacauauauaaauuuuauuguguauaauuaagguauacaacaugauguuaugggauacauauaguuaaaagguuacuacagugaaauuaacauaucuaucaucucacauaguuacccuuuuuuauuuuuguggcaaggucagcuaaaaucuacucauuuagcaugaaucccauauacaguacaauuuuauuaucuauuauauauucuucauguugugcauuagaucucuagaccuuaaacauuuacagaaguagagagaauagaaugaugaacuccuggguuuguuuuauugauauccauuugcuauuugucuguagauguuguauguguggucuguuagauuuucugaucaaagucaugcuuguuucaaaaagauaaauuuuuguuuucaaaaagauaaauuuuuuucuuuuccuaugcuaagacuaauuuaucuuuugaauuaucugguucuuaaagauuugguagaacuucauaugaaaguguuuaagccuguauguuuuggggaguuuugcucucugauagcuuucucuauucuguguuauugaucucuguagauuuucugucucuucuagaguccauuuugauauauuuuucuugaaaauuauccuacuuggcuaggcgcgguggcucaugccuguaaucccagcacuuugggaggccaaggcagguggaucacaugggguugggaguuugagaccagccuggccaacauggugaaaccucgucucuacuaaaaauacaaacauuagcugggcauaguggugggugccuguaaucccagcuacuggggaggcugagguaggagaauugcuugaacccaggaggcggagguugcagugagccaagaucaugcccuuguacuccagccugggugacaagagugaaacggcaucucaaaaaaaaaaaaaaaaaaaaaaagaagaaaagaaaaaaagaaaauuauccuacucauugagguuuuuaagucaguuuggauagcugagauaguugucacugaacagucuuaauuuucccugugacauuuguccccccccuucuucuugaguagguuaguugaugauuuauuggguuggauuuauuaguuuuaugacuuuuguuaucuaguuuauugucugauuugacuuuaauaauuccuucuggucucagguuuauuuuguucuuuuaaaaauuaggugcuuucuguucucacucauaagugggaguugaacaaugagaacacauggacacggcaaggggaacaucacacaccagggccugucgggaggugggggggcuaggggagagauagcauuaggagaaauaccuaauguagaugacaaguugaugggugcagcaaaccaccauggcacguguauaccuauguaacaaaccugcacguucugcacauguaccccagaacuuaaaguauaauaaaaaaaauuaaaugcuuucuucuuugucuuguuuauuucaauguuuaagguuaguuauuccucugagcacugcuuuagcagcugauguguguauuuggucuuuuuucucuuagcucuucugugucuucagguuuuuauuuuccuaugaaugaagaguuguuuggaggaguuaaaaauuuccagugaaggugcauucugcauuuuaauuuuauuuaugucuaguuuuguugcacugugauuacagaauguugucugaauuauucucuaauuuauugauguuaacuuugaagcucauuauaugguuguuuucugugaauguuccuugggcagcgaaaagaagguuauacucucuucucagguugcagagugugauaugucagcucugcaauauuauguuauuuagguuuuguguaacuuuacuuuuuuuauccaccugauuugucauggaucaaacacaagagaaguuaaagucuccuaauaaugauucucuuucuccguauagcuccuauuguuuuugcuuuaugacuaucaguguuauguuugaugcuuauuaacucacauccucauugugagauauacccauuagcauuagagugcugcccuuuuacuaguugaaggcuuuuuggccuggauucguccuuauuugacauugagaucuaguucccuauuuucuuguuuacauuuccugggauagcauugccauccuuuuauuuucaguuuuucugaauuacuucgcucuaaauaugucucuaaauguaguguaaaguuggguuuugcuuugugaaucagucuuuuucaugugguaaguuuaaccuauuuauacuuacugguaugauagaucugucaucuguaaugauaagcauuuguaauuuucuguugcuuucuguuuuuaauaccucaguuuuccuauguuauauauuugcuuuguuuugccauauuuauuuuaauaaauaacuaggcuugaauuuuugguucuagugguuaucuuuauaguuauuacuuuauuucuauagaccuuugucccauaugggucaccacuugucagccaggagaccuuugagcacuugaaauguggcuaguguggccgaaaaacugaauugacuuaauuuaaauuuaaaauggauacuugaugcaguuaauuuuuacaucuguguagaauaacuuggauauggaauccacuuuaucaccuguaaauuuuaggaaaucucuuuauaggucaauuauuucugauagaaauuuagccucugaauugagaugugcuuucaguauaaaauacacacuggauuucaaagacuuaauauaaaaauaguaaaauaucaguacaucuuauauugauugcauguugaaaugguaauauuuuagauauguuggguuaaauggaauauuaucaaaaacuuuauuucuuuuuuauguuaauguggcuacuaggaaauuuuaaauuauauauauggcuuacauauuucuuucuuucuuuuuuuuuuuuuuuuuuuuuuuuuugugagacggaguuuuugcucauguugcccaggcuggagugcaauggugcgaucugggcucaccgcaaccuccgccucccagguucaagugauucuccugccucagccucccaaguagcugggauuacaggcaugcgccuacaugcccagcuaauuuuguauuuuuaguagagaugggguuucuccauguuggucaggcuggucuugaacucucgaccucaggugaucugcccaccucagccucccaaagugcuaggauuacaggcaugagccacagccccuggccuggcucacauauuuauauuggacaguguggcuucagauaauauauguuaauuccuuauugggagcaaugaaaacaucacauuuuaauguucagaauaaacauuuauuggcugggugcaguggcucacgccuguaaucccagcacuuugggaggccgagguggguggaucacgaggucaagagauugagaccauccuggccaacguggugaaaccccgucucuacuaaaaauacaaaaauuagccaggcaugguggugggcgccuauagucccagguacucgggaggcugaggcaggagaauuacuugaaccugggagguggagguugcagugggccaagauugcgccacugcacuccagccuggcuagagugagacuccgucucaaaaaacaaaacaaacaaacaaacaaaaacaaaaaaaccaaccacacauuuguugaauuuauuuauuuauuuauuuacuuauuugagacagagucucacucugucaccuaggccagagugcaacggcuuggucuuggcucacugcaaccucugccucccggguucaggugauucuccugccucagccucccgaguagcugggauuacaggugucugccaccacgccuggcuuauuuuuguauuuuuaguagagacgggguuuugcccuauugcccaggcuggucucgaacuccugaccuuaggugaucuacccgccucugccucccaaagugcugggauuacaggcaugagucaccgugccuggccugaauuuauuuccugaaauauaacuuucacaugucuuguuccauauuuuuuucuauaaaccucucuggauuuuuggaucaauguauuguuuuugacuggcaguuaauguuaugguggcuccuuguuauauuugcacaaauuugaguucucuuucccuuaagcaguugugauaaauuaaaaauucucuuaauuauauaagaaaaggagaacuuggacuauuauggcauaaagauagaaccuucugaauguugaaugaguugguaggaaaugauucacauuuucuuuuggacuugcuuuucaucuuucagucucgcccugucggcuucugguucccauauuaaccacuuuucuccccucccugcagacugacgucccauuuguuugauuuuccaguuacuuuugcacagccacacuugcauuaaagagauuuugcuccugccuccuuuucuuagauuuuauccucaauugucucuuuccaaagggcaggcgcucaccucuuuuuuguaaccucuuacagcuuccucagcucagcuugcucugcacagagcaggugcuccauaaauggcaauuacugauggcaugccugacuccauaucgagguuauuaaacauuaugccacuuucauuuagucaguuauauaaguuuauuuuauuuauuuauuuauuuauuuauuuauuuauuuauuuauuuauuuugagacggagucucacucugucgcccaggcuagagugcaguggcaccaucucggcucacugcaaccuccgccucccagguucaagcaguucucgugccucagccucccgaguaccugggacuacaggcaugcgccaccacgcccggcuaauuuuuguauuuuuagcagagacgggguuucaccgucuuggccaggcuggucucgaacuccugacuucaggugauccacccgccucugccucccaaaguguugggauuacagacgugagccacugugcccagccaaguuuaaacuuccauaguguccccauguguaaauauagcaucucucaaaaccaccagaaagcagauugcugauagcccugccgucuuuucacaaaacuaaauauuuugauuucugucauaaucacaccggcucugugaaccucagagccuuuagcucuuagaagguagcggccaguuuccgcauucuuacuauucuuaaaguuuaagggcccagccaucuucuuuuccuuuagaacauauuuuaagauacuuuggagauacuuugguuccaaaugacucccuuucgcaaagucuuggcuuuuuaagucauuuugcuccuugaagccugaucaccacuggggacaacagugauugcguucuuggagaaaauggaaagguuuuuaaaaaaauuauguuaggaaaagggaaaaacaaucucauucugcuuccgaguguguuuauuuuguaccuuuacauauguaaaugacagauuuuuuuuuuuuuucccuguaagcaguaguuuuucugcuacaaggugucaccaagaauuagaccaaccuguuuggagaaagggaucaacuauucagaauuaaaggggaagagaaaaauuuaguugaggguaaagauaucuaacuuggcuuauugcaucuugaccaguuuuuaaauuuaaagaaagaauugguccaggcacuguggcuaaugccuguaaucccagcauuuugagaggcugaggcaggaggaucgcuugaguccaggaguuugagaccagcucgggcaacacagugagaccccugucucuacaaaaaaauaaaaaaauuauccaggcauaguggugcaccccuguggucccggcuacaugggaagcugagaugggaggaucgcuugagccugggaaguugaggcugcagugagcugggaucgcgucacugcacuccagccuggacaauagagcaagaccaugucucaaaaaaagaaggagggagggaaguagaaagggaaggaaagaagggaggaaagguagaagacggaaggaggaaaggaaggaaagaagggaggaagugagggcuuuuugggccuuuaagaucugauaaggcugcauuuuaacauggcgugguuuaucuggcucuggggcagcucucaggcaccaaagucauggcuuuggccucacugucuuuguagcacuuauguuuugugugcuuuugaaaguggagacagcugcaguuacugaucuauugaugguugggugguuuccucccauuaagcuuuuggaaaauugaucagacuguuggcaagguuugggaaaccuugguuuuguuacuggauggaaucugaaaauaucacugcuuuuucuuuuccuguauauguauaggcauuccauuauuuuacuuccaugguaaucugauuuuagaguugggcaaauccuuuuauuuuaggaauacccuggucuaagaaugucaaccuauagccugagggcuggccaccuguuuuuuuuuuucuaauuaauagacuguuuuuuaaaaagaguacaguucguccuccauaucuguggguuccacauccauggauucaaucaaccucagauagaaaauauucagaaaaaaaauuccacaaauuuccaaaaagcaaaauuugaauuugccucaccuugaacacuauguugaauccauguaaaugaaaugauguguaggccuuguaacuagucuagagauaauuuaaaguauauggaaggaugugcauaggucauaugcaaauacucuaggccauuuuauguaagagacucgaguauccauggauuuugauauccaaggguguccaggaaccaaucccccacagauacugagaggcaguuuuagguuuacagcaaaauugagcggaaguacagagugcccacagaaccccuccccacccccaaacacagucucugccgccaucaguauccugcaccagugugggacauuuguuauaauugaugaaccagcauugacccaucauuaucaccuaaaguccauaguuuacauuagggcucauucuuuguguugcacacugcggguuuugacaacuccuguuuuuguaaauaaaguuuuacuggaacacagccaugcucauucaucacauauuguuuguggcuuuuguccauccacaacagcagaaauugaguauugacagagacuauauggcccacaaagccaaaaauguuuacuaucuggucccguacagaaaguuucuuguucccuguucuaagacaaaucaguucccucuuuaaagaacugagcagugauuggucuuaauuuccauuuaagugguaaagcucuguuucuccuguaugcuaguaacaauaaacuuugacuaucuggagugugacuuuugggguagugaaggcuuuuccagguaaucgggugguuuaccuauaggauaucugccucagaguggaauuaccauaugaaagcuguugacaguuuauagguuuaauuuauccagggcugucagcaaaguuuaucuguaucaguuucuccguagcccugccaaaaugagguuuuaugauuuuaaucgcaucauagguaacauaggaaugaaaagugcuuuuuccucugcuuggguuuuuugucugcuuuuuguucuguguaaagugccauuggccauuuuguaaccagaaucugaaguuuuuaucauuugcauaaauuccuguguauauuuggcauaguaagcucuugugcuguguaaauaucguuuccuuuggcaaaguaauuaucaaaguauaaaacugaagacauuuggaaagaauugcuauauuaccuguaauauggguaauucaucuguuuuuuugugauagcccuuccugcuuuugcccauauauuuacauguguuaacacuguauguugguuuccuuuuuaucuagugcacagucugaguuuucauaugcucaguguuaccuauaucauuuacggugcuuuuaucauggucagauuugucaccuauagcagaguuuguaaguaguuauuaaaucucucuggaaucuauugccauuuucugaugagccuuuguagcuaacucauuuuuacccuguucugcugucaaguugcccaacaauuauuaagaccucaaguuuuucucuugaaacuuggcuguuucucuuuuaucuuggccguuucucuuugaucauaugcuaagcucucagaguaguuuguauuuguggauucuagucaacauggcaacuuuucugauuuuaacuaaauaucacauuuuaacuuuguaauuuauguugaaauuuggugagggcaguuccuuauuuauuacuuuacauuuuaaauaauucuugcuuuucuuguguacuaauucuucuugauaaauuagucauugugcaccuugaauagcauaucaucaaaagugugcuaagggaacuguggauggguuacgugguguuuuaggguuuacaucuuugccauguacuuggcauugaaacuggcauugaggccgggcaugguggcucaugccuguaaucucagcacuuugggaggacaaggugggugaaucacuugaggucaggaguucgagaccagccuggccaacauggugaaaccccauaucuacuaaaaaaaaauacaauacaauacaaaaaaucagcugggagugguggcucauaucuguagucccagcuacucaggaggcugaggcaggagaaucguuugaaccugggagguggagguugcagugagccgagaucgugccacugcacuccagccugggugauagaaugagacucugucacaaacaaacaaacaaaggaaaaacuagcacugaaguaucuucaguuagccuauuucgcuuuuauggcaggaaggcuaguuuacgcuauacuugccuucgugggagagcuggguuugauugugacccaugguggauguccuucauaucccucaaggagaaccccauuccuggucauugccucaucuuaacucugagauuaaaccuuuugccauaaugaauggcagaaaaauuguaguaaacuauuacauuugcacaggucagcauuuauauucgcucuaauugaauacuuaggguucuaacucagugguauguuauuucccuaagggucaccuaaacaguugugauuuuauuuucauucuuggacuugaucuaugauucuccuuaaccauuugaguuguaccaguguugcuuucucucuuaccagggcauggaggucaguauauaauagucucacuguugggaagaaauuaucaucucucuaacauuuucccauaccaugaaguuaaauauuuugccauguguugcuggccagaaaacaguagggccuuuugaaauuuguaacuuacauauauuuucccacaauuguuacauuuucauagaccagagaacacucaggcuucuaucugaaccuuuucuuggaucuguccuaguaggguauaauguuuccuuaagcuugcuagcagauauuucuuaauaccagccuguggauuuuguauaacuuugguuaauuucuccuccugauucugcuguuaaauagaaagcaaagugguuauugcuguauuacuguuccugcauuggucaugugaugugcucaugugagcacuuuauuuguaauagacucuucugggaggaagcugcuugucucagggagucuccuguucucuagaaauugcccuucauggccaggguacugcuucuuuuguuagagcuccuuacauauucucuaccguguuaucucuggccuacauacuccuauuccuguuucuuugaccugagcuugacuucagugaagcuauuggagaaggaaauuaaaauggacucuuggcugggcacagugacucacaccuauaaucccaacacuuugggaggccgaggcaggcagaucaccugagaucagcaguuugagaccagucuggcaaacauggugaaaccccaucucuaauaaaauacaaaaaaaaauuagccaggcgguggcacgugccuguaaucccagcaacuuaggaggcugaggcaggagaaucgcuugaaccagggaggcagagguugcagugaaccgaggucgcgccacugcacuccagcuugggcgauggagugagacuccgucucaaaaaaaacaaacaaaaaaaaaaggacuuuauauggcaccugaaaaagauucaauagauucgacuagcacuuacugaguacuuaccaacuaaaacaggauaucaucuaauucucacaacagccaugcccauuuuaccaauuaggaaacugaaguucugagcggguaagaagaugacucacacguauaauagguaguagagccacaugucugcccgccugaucgucuuaccaccucuuuauagcagagaaaguaggugagggauugggcgcagugugugagcaaaacaaacuggaggaaaggaccaucgagugcauugucaccgccucccaagcauuaccacauccugaagcacagccguuuccuucucgaguuuguuuaguuuuuaucuuccccauuuaagaucaucugaaagugaaagggaaaaaaagagcugacacugaaaagucucuuacagaguacaaagauguuugugaucaguuucccaagaggcugaaauaaaacucaaaggugaaaauaaagacaacaguacauggguaaauaaaaaauuggggaugcuuaauagccauugucugggcuugaggaguucuuugauuuguuuacccucauugaauuuucuaugauuagaugcuaguccaugguucucaguccuggcugcucaugagaauugucuggggagcgccugaaaugagugacaccugcucccuacauaaaccaauuaaaucaauugcugcggguaggagucuaggugcuggugcuuuuggguuacccaggcgauuguguaauaauauucuuccagaguuaaaaccacaguguuagagcuggugaaauuuuugcccaagagcuaugaaccacuuuaggggauagagucugugagugagaugccaaagguuaacaccgaagucauucuggaguccaucagcauuaguugaaaguucuggauuuggaaugaaauggaaacuaagaagcauugggaaauugccaaggcauauucauugccuuugaggagcucauagauaaaugagaagcugggacaaauacauaaauuuacguaugcuagucagaaggaugaaucauauaauuuugugguaucuuuuugcugcugucccuaccucgcccuuaaagguuuuugaaauaagggugguuucugggaacagguaagguguuaacccaauuguccuuuauccaaaauguuguuggaggcuuucuggauggagaucacaaagagaagaacaaaauguaaaugugcauacucuuuuucuuuuucuuuuuuuuuuuuuugacaaagucuugcucugucgcccaggcuggaguggaguggcgcgaucuuggcucacugcaagcuccgccuuccggguucacgccauucuccugccucagccuccccaguagcugggacugcaggcgcccgccacugcacgcggcuaauuuuuuguauuuuuaguagagacaggguuucaccguggucucgaucuccugaccucgugaucugcccgccucggccucccaaagugcugggauuacaggcgugagccaccgcgccuggccccuuuuucuugacuuccaccuuuuuuccuuggcuguuuacuccuagcacugcucuccagaguuuucuuagaauuuauauuaguaggcaagguuaguguaugauaaauaacuguauagagagacaaacaaaaaucuuauccucuuagacuaauucagugggaacuugagcuuagagacugaugugguuuggcucugugucuccacccaaaucucauguugaguuaugauuuucaguguuggugguggggccuggugggaggugauuggaucaugggggcagauuucccccuugcuguucucaugauagcgagugaguucucaugagaucugguuguuuaaaaguguguagcacuucucccuuugcucucucucucuccugccaccaugugaagaugugcuugcuuccccuucgccucugccaugauuguaaguuuccugaggccucccuauccauguggacugugagucaauuaaaccucuuuccuucauaaguuacucagucucagguaguucuuucuagccacaugagaacaaacuaauacagagaucaucuguaaucuucccaauuuuacacaugagaaaguagaagccccaaguaaggaagagacuaugccagucaucagcuaguuuuugguauaacaucuuggccaccucuuccaaagggaaccagaaauuauucuuuuuaugaggccaagggaacuuacauuugugugccacucucugcuaaacacaauagugguuagcuguaauucucacagcguccacauuaaguguuuccauuucuuggaugaagagucuaaagcuuagauaguuuaagucucuuaccuaagcaaaguuaggggcaaagccaugguuaaaauucagguagagugagguuuguuuguuuguuuauuuuuuggagacagaguguuccucugucguccaggcuggagugcguggugugaucuuggcucacugcaaccuccaccuccagguucaagugauucuccugccuuagccucccaaguaucugggauaacaggcacccaucaccacgccuggcuaauuuuuuguauuuuuaguagaaaugggguuucaccauguuguccaagcuggucucgaacuccugaccucaaguaaucugcccgccuuggccucucaaagugcugggauuacaagcaagauugagcuuuuaaaccuacgcucuuuucaguuuaacauaguauaccauuguccccagugcaauucuuuauagcaaauauagucucuauuagcaaugcugagguuuugucuaaauuuauucuguuacacaaucaggaaaugguauaaucuaaugcuuaucuaguuuuauuauuucagaacuaucagauugauaccuacuccacuuacuuacaaugaaauaauucuacuucugaaaaccacuacuuguuagucugcauuaucaucucugggaauaugagaagcaguauauacagacuuguacuccagucuuaauuucugaugccuaccagcagugugagccugggcaaaucacuuaaucccacuacacuucaguguccuuaucuacaaaauagaaaugcuaguggcuaaucauaggaugguugcauugaugagauugagaacguauggcauagugcauaacacaugguaggugcuugguagauguugguuaugaauuuacuaugagaaguuagugacacagcauuuccuugaugaagucagcuuucugcuaagaauaaaagcuggguagggagcucuuaaccuugaauguuaauuaucuucaaguuuauuggcugaaggucucagcuguacaaaacugaucauuuuccaagaaacauagcacuuucagcucuuuugugcuuugagagugacuugcuuuggauucccuuugaucacugugauggcuaacuaaaugauuugccucaguuaaccucaaauaugaguacagugugaccauuagcuauuccugcuuccaugacaacagggcauccuguaacucaccaauuuaccguuaggacuagauucuaaacucccuucuggaauuagguugauauggaugcauggcggcuuuggcugcauagugcuuguuacucacaugcucuagcucgucacagcuuuauuugugacaucuguucugaacacaucaugucucuuccacucucuggccugacacaccauauugacuguuacugccacuguauugucuuccuaccugccuuuuggcucuucucaugauuuuaaggauugaauacccuuaaacaaauauauagaaugaaguuggccuguaagagggauuuaccguuaccugcaaauguuaucuugaaccucugaauuuuauuugcuauguuaaguuuguaacuaaacuuacuggguguuuuaauuuucaguugcgauccgagguuuuuuuguguguguguaugugacacaggcucucacucugucaccuaggcuggagugcaguggcgcaaucuuggcucucugcagccuugaccuccugggcucaagcgauccuugcaccucucagccuccgaguaccugggacuacaggugcacacugccacauccggcuaauuuguauauuuuuuguagagacgggguuucaccauauggcccaggcuggucucgaacuccugagcucaagugauccucccgccccggccuaccacugggauuacaggugugagccaccgcacccagccaggaaauuuuuuguuguuguugaggcaaagucucacugugucgcccaggcuggagugcaguggcacgaucucggcucacugcaaccuccaccucccagguucaagcgauuuucaugccucagccucccaaguagcugggacuacaggcacgugccaccauagcuggcuaauuuguuuguauuuuuaguagagaugggguuucgccauguugcccaggcugaucucgaacaucugagcucaagugauccucccaccuuggcuucccacugggauuacaggugugagccaccaugcccagccaggaaauauuuauugaauaccuacaauguaccagguauuguacuaauggacucuucaaucuuuugaggaaucaugauacaggacauagaacucauagaacucagugacugaggcaguggcagagggcauugcccaagcacagggcacaacuucugggcccacagagaaauccauucacagcuugcuuuggcuuuguuauacagagcagcaguuuucucacuagucugugcagauauauguuucaaaagagcaaacaaacaggauuucuaaagagaggggaucaagggacuacuaccuuaauuaagaacucuaucccaaucaccuucguacccccuuuuccuaucagaagaacaaaaaucauuacaugaaggguaccacgggugucagaccccauuaggaagcucugcauauaguagcauauuuuguaugagauuuuuguauuuuuuuaaagaauagaauaguucuaguuauaggaagauuuuuaugaguuacuuugccguauuugcuuuauuuuucccucuccauccaucccuauuccucucucucucucucucucucacauacacaugcuuuaugcuuuuuugcugaaccauuugagaauaaauugcagacaucaugccucuuuaccccuagauacuuaaguauguauguccucagcuuaaggguauucuccuaauaaccaugauacaguuauuacccuuggggaauuuaucauugauauaaaaauaaaauggaacaucuaaauuucccuuaauggggccaggcgcuauggcucacaccuguaaucccagcacuuugagaggcucaggcugguggaucaccugaggucagcaguucgagaccagccuggccaacauggugaaacccugugucuacuaaaaauacaaaaauuagccaggcgcgguggugcacaucuguaaucccagcuacucgggaggcugaaauaggagaaucucuugaaccugggaggcggagguugcagugagcugggaucgugccucugcacuccagccugggcgacagagcaagacuccaucucaaaaaaguaaaacaaaaaaauaaauaaauaaauuucuuguaauggcugccaguuccuauauuggacaguucucaggucuagaacacucucagaaggcacuguagcagaggagggugcugagcauagugcagcagagcccgggguggggggauaggggacuccuaccucagcaacgcagcagaccaguagcgggcaggaguggcaggaaggcuggcugggugccaacaggagaaugaacuaaaagucugcagacagaagggccacccucuguucugaccucuagaacauuaacagcaggcaguuaucccuaucggcaagguaaaggacaaaaggggguucuucucuaaagacacugauggaacuauuucaggagaaucagggaagcuggugugguauuagcgcccacugaaaagccccaguguaaucaggaauucagggagcucucuccgccaagagccccacagggcucccagucuuuagccugcuuccuucccaaaccugacugaacaaccaaagaucaccacacgucugagggaagccuacagcgagaaagagacuaacaaagacagaaaaauggacauuaacccccaaaagagacaaaaucugacuggccauaaaagagugcuuuaaaauauaauuuagcaauaaaucaucuacaaccccccauuaacaucccagagaagaucgcauuuuccaaagauggccaugaggauacuuuucuacagugugaccuuggcaccccucugucaggagcaggagucgaaauuuccuucuggagucugggcaggcccuggcuacuuagccuaauugauuguggcagacuaggccagcugugugacuucugagccugggucauaaaaggccaugcggcugcugucuuuucacugaagugguggaaggauccaacuagcccgaagcugccgugaugugagggagcccaggaagaggccaccccaagcugcucagaugggcaguccuaguugugcaguugucugucccaagcaucagacuuaggagugaaggggcccucggauguuuccagacccaagaucuagucacccugcagccuucggguuuucccagcugaagcccagauaagccaucccuucugcgugcugucuaaauuccugacucacagcaucugugaguaucauaauauggacuuuggacugaaagaagucguguaauaucuagauguuuuggggcacugaauuugauagggaauaaagugugcgugaaauccccaguauuuggcucuuugucucugaaguucugacucacucuuuuuguuuuuguuuuuuugaaauggggugucacucugucaccugggcuggagugcaguggcacaaucacagcucacugcagccucgaccuccuggcucaagcgauccuccugccucagucuccuaaguagcuggaacuauagucacgcaccaccaugcccagaugauuuuuuauuuuuuuguggagacugggucucccuauguugccugggcuggucuugaacucuuggacucaagcaguccucuugccucagccucccaaagugcugggauuacaggcauaauuggcucacuguuauuaauaaccaaaacauggucuggccuagaguggaggcagccccaaguuuggcagauuccaaaucugcagccuauuuugauccuucuuaaauucagaaauaaauguucuugaacaaaggaaaacucuuaagcucuuaaggcagugagaaacugcucaugaaacaaaacaaacauuuuaaaaguagaaacuaaguuuuuaaaaaagugauucuuugaaggacauucacaaccauuugguaggucuccauucacaugucagauuguuucuucugaaggacuauucaauuaaucauuguuuaacccuaguaaaucaaaaaauuaaugacuuauucuaaaauucaguguuuucaacagauugaaaucuuauaacuacaacuagagaaaagaaguugaagagcucaccugcacacauggacauaaacauggggacaacagacacuguaaacuacuagacggagggggaagugggcgcggguugaaaaacuaccuauuggguacugugcacacugccuaggugcaacauacacauggaacaaaccugcgcauguacccccuguaucugaaauaaaaguugaaaauuuuuuuuaaaaagcuuaaaauaauauguucucaguuauauuuuaccaauuuaaacauggcuaaugggaaaaguacauugccaacucagacauuuaguuggugauauuaaucgaaagcauuuaguugaugauauuaauaaaaauuaucagaaugagcuggaucauucuguugggguuuuuuggugccuugcggguaauuuuuccauguauugcucuuuaucucauuauugccacucccaaaccaccccccaacccccaccaacugcuaaagcugaacaauggacaaagaaagccuucaaguaauccagacagaggagacucuacauuuuaggaggcauggucucuguugauugaagacaguacaaaauauguccucagccucugcuuuaauuaaaagguacuuacuaucaaucacuugaaccuaggaggcggagguggcagugagccaagauugugccauugcacuccagccugggcaacaagagcaaaacuccaucucaaaaaaaaaaaaaaaaaaaaaaaaaagacacuuauuaucaggugacuugauuaauugaagaaauaauuauuuuuucugccgccuguaaauuagucgaaaagaggauuaaaacgaagccaggguuaucagccacuauguaaaccagguauaaagaaauaugucugugagcuccugcucucagguggcuagcuaaacgcucuuggcuaccuccuggucccaccauagggaaggcucccugcauuacauugaaagucauuuauauuucugugucuauucacccuaggucuuggugaaugugaagcuauauggaaccuuucuagacaaagcaaaucauaccuuuugcaaauauaguaauugucuccagcuucccaauaaaaggacaaaguauaaaaaacaaacagaggccaggcgcaguggcucacgccuguaauccuagaacuuugggaagcugaggcaggcggaucaucugaggucaggaguucgagaccaaccuggccaacauggugaaaccccgucucuacuaaaaauacaaaaauuagccgggugugguggugcaugccuguaaucccagcuacucaggaggcugaggcaggagaaucgcuugaacucaggagguggagguugccgccacuuggugagccaagauugcgccacugcacuccagccugggcaacagagagagacucugucucaaaaacaaacaaacaaaccagaaacaaaggagaaugaaaggaucgucaaacuuaggagaaaaacagaagaaaugcacaugaguguauuugagucuaaugaccuguuugcauccacuaagucagaguuuuccaagcccccucaccugcucccuuugucaucuuugaacugauaccagggaaaaacuuaauugguaaauuugaauaagaugaaguauauugagaaaugcagaauaaaaauagaaagucaaaauuaaggaauguagagaagccaaguaaguagggaaaaaaugaagucaaauaauuggaaagcagaacuggaaaauacacaauauaccagaagacuuaucaaaacagaacccucuggcgaggacauucauuuaaaaccaaaauguuuuucuugguaaguuuauuauuuaaaaaaaaaugguuguuagaaccuuuucauuuaaacugaguauccggcauuaauacauaggaaagauacuuucaauguacgugaagaaagcacagaaagguuauaaaaaucaggcauuucauacuuauuuuuaggcuaacuaauuaacuaaaaaagacuuauccuccuauuuaagcugauauauaauuaaggugucugaguacaaagaauuugucccuaaaccuaauguagaauguaagagacaaaaccugaaauuuuccaacuacucuuuuuaaaaaauacgaacuucuggacugagugugguggcucaugccugucaucccagcacuuugggaggcugaggcgggcaggucacuuaaggucaggaguuggagaccagcuaguccaacauggugaaaccucaucucuacuaaaaauacaaaaauuagcugggcguggugaugggcaccuguaaucccagcuacucaggaggcugaggcaggagaaucguuugaacccaggaggcguagguugcagugagccgagaucacaccacugcacuucagccugggcaacagagugggacucugucucaaaaaaaaaaaaaaaaaagaaaaaaaaagaaaucaacaacaaacaaagaaaaaaacaaacuucugaaagcauuaucuauuauuugaaaaaaucauugagaagcuaccauaggcgaggcacuauaauaugugcuaugggggauagagagacagauaaaaguuucuuuccacaugaguuuuauaacaggcugauaauccaaggaagcuugaagaaaaugcuuccugaaauuugguucucuuagaccaugccuaguaguugaguuuuaacuauugcagaaucaucagaugagcccagggaauggguucucagggcugaccaagcaguaacugacaguucgauuguguaucccauggccucagacuauucuguuugagcaucaucagcgucauuagugauugcuauuuaauuagccccucuucuaaguuuuaagaauaugugacuguuaaauauugugguuuauuaaguuuuuauuuauagagaugggggucuugccacauugcccaggcuggucucgaacuccuggccucacaugaucuucccaucucagccucccaaguagcuaggauuacgggcgugagccacugccucugguuuaaauguuaagcacauguuaacccucaccaaaucucugugaaguagauacugcucuuuuuuuauaggugguuacaaugaaguuuagaaguguaaagaaacuuaccccugcucaugaagcuugugaaugcucuagucaagauucaaacccugaccuuugucaucgaacuucagcaccugaccuuugucaucaacgccccgcaggaccauaagcuuuucucugaauccugaacucaaaaaacucugaaaauugaauuucuuuuucauauauuugcugccacaacucauuuuguggcaaaaccagaccugaacugacuugauuccauaguccuuauccuacuuacuggaaauguucacguauuucacugcagcuauguuguggcucucuaauacucuguauuguacaauguaugguauagacuccuuuuuaccuuccuaaaauugaaaaaccuuuaaauucugaaaccaucuagaucugcaacuucuagagaagagaugagaagcugacuauggccaccucacaccugccagccagcucucacugcucacaacaugcucguauccugugacuccuaacaggcugccaacuuggaaauuuaaacauguauacuuucauuacccucaaaaacucauaauugugaaaaaauuauuaguucauacugauacuaccaguuucaguuuaacaccagaauucuucuacuucuucccuauuccagaacuuccuuuuuccucuuaaagaaaaaaaaaaacuggcuagacaugguugguggcucacaccuguaaucccaacaguuugggaggccgaggugggcggaucaccugaggucaggaguucaagaccagccuggccaacauggugaaacccuaucucuuuguaaaaauacaaaaauuagccgggcaugguggcggaugccuuuaaucccagcuacuccagaggcugaggcagggagaauugcuugaacucgggagguggagguugggugacagagcgagacccugucucaaaaaaaaaaaaaaagaaaaaagaaaaaaaaauuaucugauacuuguuaaagaugguagggaaggcuuuauucaagagggaccacuacagugggaguuuugcaauaguggggagagaucagguugaacuccuaaugcaacaaggacaaguggaaauuuauagccaaggagcagagugugggucaauggguggaaaguuacuaagaggaaaaauccagguuggaggggauucuuguugaaggcaggccagcaugauaagauaucgaggguagggggaucagacaccaaggguaggggauuuucacuaaaaugacucagcaggauuuuugcugagacuggacuaagcaggucaagauagaacccaaagucgaggccuagucagaaagaggacucagagccgggcacgguggcucaugccuguaaucccagcacuuugggaggcugagacgggaggaucgcuugagcccaggaguucgagaccagccugggcaacauggcgaaacccccucuuuacuaaaaauacaaaaauuagccagcugucccaccuaccugggaggcugagguggcaggaucacuugagcccaggagguugaggugguaguaaaccgugauuguaccacugcacugcagccugggugacagagugagacccugucuccaaaagcaaacaaacccagaagaaccgguuucaaguuuggucaaaggagagagucuuugucaucccacagugagaacaucaauguuucuuuugugauuuaaagauaauuuccuuucuguuuagccaggaugcaaaguauuuuuccuggcaugugaaaagcuagacuuuuauuuuaacuuagauaauagggaauucauuuuauaaugagauucacugugauaaauaucagcaauuuuauugcauuuaaaauuaaaauuauauucauccagaaccuuuuaggaauaauauacagaugcuccuugacuuacagugggguuacauccugaugaauccaucauaagucgaaaauauuguaacucaaaaaugcacuuggccaggcacaguggcucaugccuguaaugccagcacuuugggaggccaagguggguggaucacuugaggucaggaguucgagaccagccuggccaacaugaugaaacccuaucucuacugaaaacacaaaaauuagccaagcauugugacgggcgccuguaaucccagcuacucgggaggcugaggcacgagagccgcuugaaccugggggguggagguugcaguaagcggagaucaugccacugcacuccagccugggugacagugagauucugucucaaaacaaaaaagcccuuaauaauuagauaaacccaucauaaagugagaagauuaaacaaucaaaaaaucauaaguugaacuguuuuaaguuggggacugucucuauauuauuugaagcaaaaugaccagagcuggcugggcgcgguggcucaugccuguaaucccagcacuuugggaggccgaggcggguggaucacgagucaggagauggagaccauccuggcuaacacagugaaaccccgucucuacuaaaaauacgaaaaauuagccaggcgugguggugggugccuguagucccagcuacuugggaggccgaggcaggagaaucacuugaacccaggaggcggagguugcagugagucgagaucaugccauugcacuccagccugggcgacagagcaacacuccgucaaaaaaaaaaaaaaaaugaccagagucauuuuaaauguuaauugccuaaggccaaaugaauguguauagaauagauguuggaaggucauugugggggcauuacaccccuucuccucuuacuugaaguggguauuuggggauugagguacuuaucacagugaaaguaugaaggagaaaagugaaucaucauuuaguuaaaagauuuaccaaaggccuucaauauacucacuuaggaugagggaaaugagggauggauuauuucagacuuucaucuuuuauuguaacuuuuuugagaauggagaagggggucagggaugaguggggaagaaagguucugcagauuacuuucuagauuagguucuuuuuuucaaguuuuauuugguagggagagcaaaugaauaaaccagaauaugacuggaaguguuagaaaauuggauucacuucugaaucucugacuugcugccuucaugacguacagaagaauaaggagaguuuggaagagaaaauuguuaaauggcucugcucgucucucucugggccuggccaugauguugcccauuucugugcagccuccagggaauauggagcagcaaagaggccuaggcagggcgagggagaugggauggaccccucaauaccacggagaccggaaggaccaguguuuguccaacacuugcuccgugucagccuccaugcacaguaucacauuuaguccuuacacaaacuaguuuuauccccauuuuacagauuaaggcagcugagacucagaagugaagaagcuuaccaaagguuucacaaccugcaaauggaggaguuggggcuggagaacauuucugucuccaaagcucaugccuuuucuaucaggcccuccacucccagccaccauggaguuuccagcagggcuggggguugcaggccaggcugaugcuagaacucuuccugccacaugacagcaggggaaagagcucagguuuccucuuuuaaguggccagguauguuuccucucauggcgucuuguuuauguaaauuuuaugcacagcuagcucagggaagccuccagaaggcacugaccuccuuccuuauggucaacccacaucuuacccucuccgauguggcaugguagaucacucugccucugaguauacccaggagauaguuucucuggcauguuucucuggcacaugccaacccugugucucagucagagccccuccucuggaagcacagggucucuggggucuguggcuacuucccagaggggcagagcuauggucccugaagaaacacacuggaggaaaaucuuaggaaacaguuggcacacacaguagguaaauaauugugaaaugaauggauccguugccuccuggaaagcccuaugaaugggaguggauuuacacguucuguuaccuuuguacuuggcaguuuucccaugguguuuauuugaaaacaaguucagauuauaucccaggucacuuuuguauugccgcugguaacacuaggaacguuuuuguguuaagaaaaaaaaacugcuuucaaaguugccucuuguaaugaauguucuuuuucucugcuaauuaacuuauuuucuugaacuugcuauuucaaaggauaaaaauucaacuagagacugcaggauuauuuaauuuucucuuuccaaccaguaguaaccgugcuaccgugggagcacuuuauuucuccaucuguuagacuauaaaaucauggaacauuuuucaugucuuaauagggagagauaaugcaugugagaaaacuucauauauguuucuacgaaaggaacuuccugugcggcuggcuaacacaaugagagaaguuaaucuucugccggauaauuuacuuaaccgcccuucagugggauugguucagaguugguaaguaaacaauguggcuuaaaauggaucuucccacaaugcugugaacauuuggcagcgagaccauucucuguaaaagugcacauacugcccgucuagguaggaaugagucauuugggauagcuggguuuuccaugcaauuaaaaguuguuuuguuuuuuuucuuuuagagcuguuuguuuuaaaguuguuuuagugaaaaugcuuguuaaguuauacuagacacuuuccugaguuuuucuuguguguggugggauugcaguucuucugacaggauauuugcugcuuuuaucaagucuuaaccuuacuccuuucguuuuccuuguaaagacauuccuugaagucaguacuucuuguagaacaaauuaagucauuuaaaggggaaccucagauuggaaaaauaucaguucccuccuuugcuucauuugcuccaugaaaaguaggaaaaauuuugacagaguauaacauaaacuuaaaucaguuauagcucugaugcuuaaagcauaugucauuuaacugaagaaguugaauuugugacacaaaguccugggccacccgugcuuuugacugaguggcuagacauugaguuuccaugccccuuuucucagauuugauaauuugcuagaacggcucacagaacucaggaagauacuucaccuauguuuauagguuuauuagaaaggguacaauucaggaacagccacaugggagagaugcauagggcaagguauggggggacacauggagcuuccaugcccacucugggcacaccacccucccaguacccccauauguucaccaaccuggagacucucugauggucguucaaggguuuugauagagcucaaucuccagcccucuccccuccccagagguugaggguagagcugaaaguugcaguccucgaaucacuuggccuuucuggugaccagccccauccugaggcuaucuagaggucccguccuaagucaccacauuagcauaaacucagguguggucaaaggcggcuccuuauggauagcagaagacaauccuaucauucagguaguuccaaggguuuugggagcucuguccaggaagcagggacaaagaccaaauguacuuaaauguguuauauuauuccggcaaaguauaggcuugaacaaauugcuaugucaacucuauuguuugguuuuugucuuuuaacuguuccuuuuccguauccauuccaaacaaaugcaugccauuucuuccuucuuguuucuuaaacauucuauuuugaaauacuuuccuacuuaacagaaggguuguaaaacugguagaaagaauuccaguauaccuucacguagauucacuaauuguuaacauuguuaacauuuggcaacguucuaccauugucauucagauucucucucucugucucacucucugcauacacacacacacacacacacacacgugcgugcacacauauauauaaucuaugucuauauaugguacacacacccauauaugguacacauacacgaugucuacaucaugccccuuugcccuaaauacuuuagcauguauuucauuggaacaggucucagaaaaccacaaugugaucaucaaauuugggaaauuuaacauugauacaguaaugucuucuaauauguagaacuuguucucacuuuacuacuaauuguccugauacuacccccaucuuuuuuuuuuuuuuuuuuuuuuugcaguuucuccuccugauuuaggaauccacuucaggaucaugcauuguguuucacugccauuuuuuccuuuuaaaagcgaaucuuaugcauaaugggcugugacccccaccaccauccccuuggucacaguguguccuccuugcucucuugacugucaggcugggaaccucaaaauaaucuuuuuuuuuuuuuuuuuuuuuuuuuuuugagacagagucucucucuguugccgaggcuggagugcaguggcgggaucucagcucacugcaagcuccgccuccuggguucaugccauucuccugucucaaccucccaaguagcugggacuacaggcgcccgccaccaugcccugcuaauuuuuguauuuuuaguaaagacgggguuucacuguguuagccagguuggucucgaucuccugaccuugugauccgccugccucggccucucaaagugcugggauuacaggugugagccaccgcaccuggcccagaauaaucuuuggcucccugcuauuuaugacuuucuccaacuguccccuuuggaaaggacgggaugccuaccuagcuugcuugcauguggcagggcggagggcaucacuggggcuggcuggcuuugaccucuuggcguuuugacccaaugauuuuaacaauaucuaauccauagccuuauaugcccagagacuuuuauuuauuuauuuuauuuauuuuuuugagauggagucuugcucagucgcccaggcuggaaugcaguggcacaaccucggcucacugcaacuucugccuccuggguucaagcgauucuccugccucagccucccgaguagcuaggacuacaggcaugugccaccacgcccagcuaauuuuuuguauuuuuaguagagacgggguuucgccauguuggccaggcuggucuugaacuccuggccucaaguaauccacucgccucagccucccgaagugcugggauuacaggcgugagcuaacacgcccagcccccagagacuuuuaaaaaguauguccaucaaugaacauucauuaguaucaaaugcauuguccaaaguucacaugaagcugaugaaucaaguggcauucucauuggaguauuuauauguguaacagucauuuuuaguuacuagaguguccucauccucuauccaaagguguagauaauaggauuaguggcaauuaaagcuuagaaauaauuagaauaaagggauaauucuuucaggacauguuaaaaccccaaauagagaucacauaucucuaauuggaauaucugaauccccaccagauccaacagauccuggcuggauauagcugcugcacuaaugggccucucuggaucucauuuuucuguguucuccagauuuuaauguuggacagacuguuucuuauacuggcccugauugagauauggagcuauucuuaauccagaagcuguuucugaggguuuaauuggccuucuuucucccccauuaaguacugaugaaauuaauuuaacucagaaggacccuucuucacuucuaguuucuaaguucuuggcaggcacuucagugucacacauguguuucuuaaaauguauaaguacauuuuugguaaucaaacuguagacuugguauauaaguuaggauaugucuguuuguaaguagaaaaaaugcaaccgaaccuggcucaugucacuagaagguccagccguagggugagcuuuugguguugguuugauucagagauucaugaagcuaucgaggcccugcuuucgauggugcuggcuucauuuucagacuggauuccccccugguggcagaauagcugcagcaguuccaggcuuccaauccacacagcacugcacaaaagcagagcagguugauuucucugccaaaguccucuagcgagucuuuucugucauuuuacuggccugaauugagacaguauguccauuccugagccauucccuguguucaggggaaugcacacagugauaggcuuagaccuaaacuauugggcuaaugaauaauuagugacaagagaaauagaauugcccagagaaaaaugggaccacccaggaucuuuggaggcacuggcuucccugaugcacuuaagccacaugggggaugcggaugggauggagaccugagugaaauuuuggaguguucuuaggaagagggagaggagggguggaugcugggcaggcaacuaacauaguaacucuucuuuuucuuuuuuuuuuuuccuuuuagguauaugcagaguuuucuugaacuuuuagaauaugaaaauaagagcccugaggauccacaggucuuggauaaguaaguaugguaccacuuagcugaaaguaaaaauaucuagguaagaaagauuuugguaaauguaauucaagucauuaagacucaaggaguaugaauguggacaaaagcguucauuuucuuaaugaguagugacucaacauugaguuuuuuuuuuuuaauucgagcuaagaauguaacacaauacaaaaguaauaaugacacuuucaguuuugcuuuuaugaucuaauacuuaauaccuuuacccaaggugaacugggcagucacuauaaacacugcaguaaauguuccaucuagugguaguuuuaagaaugcaguggccuuuuuauauacaugaauuuaucuacucaauccuuuacaauuaaaaaaaaaauuucaauaggauauuacauuugagcucaaaaacuguagugguuuuauuuuggagaggcauaaaaguauguuuuuuuauauagcaaccugaauucuauugcucccuuuaugcacagacuggcaaauuaucaugcugaugagauucauuuuuauuuaucccaggaacacuaacucuagcugugaguauguuuuccccuccaagagaaauuaaauaucccuuucacauuaauuucuuccuguuucauguauauguaaguggaugcauaugguaggccuguugugcugagaaauuucuaaguauaaacuaguccacauaguuaugagacugaacaccugacuuaauagauguuccauaagaagaacuagggaaacaccauguuauacaagcaaccuuaggagguauuuaacccaguccucucaauccacagauaaggaaacugaguucagagaugugaagugacuugcccaagauugugaccguucauagcaaagcuggaccuauaagcuauguuuacgucugagccaugaguagcuaguucuagucuaguuguaaacuaaaauucaaaggaaaaacaaaagcccucaccuauuuuauacuuuguuggguguuugucugauggaucugugaaguguggaaggcagggaagcauuggguuagagccccagauguagcguuuuccuugauauaagccacugcugucauuuaagcgauuauuaaaugaauucaauccaggagcuuuguuuucucaaaagucauuagcugguaaccguuuggcagaaauccuaaaaccuagggcugaccacuguagcuccaaauuuuagaacaaauuuguagaaguauaguugguccuuuguacuggcaguuuccacauccuuggauucaaccagccacagauugaaaagauauucaggaaaaaaaaaagcaauaaaaaauaacaaugcaacaauaagaaauaauacaaaauuuuaaaauacagucuaucaacuguuuacauagcauuuacauuguaucagguauuauaacuagucuagagaugauuuaaaguauccgagaggaugugaguaggcuguaugcacuauuuuagauaagggacuugagcaucugaggauuuggguaucugcggggauccuggaaccaguccccugcggauacugagagacgacuauacacgauguuaaauuucugcuguguuuuucccggagucccgucucaguuucuggaacagguuauccgaugugauuuauggccacgagccugcuuugcaaacugucagugcugaauccagugugugcuugacgauagcaauaauagcugagcucucacuccgugaguuuuguagcuugccuagguucaugugguuaguuaugauaguuggcauuugagaaggcugauguucuuggugaaggaaggagugaaaggugagcgaguaucaugguagcagccuuuucuguuuaccaagagguuguaugggaucaccagcagggaaaucauuuuaguaaagcaaaaguagcuuagaggacaagcuuguugaucauuuaugauagaguuuagaagagcccggaagauuggaggagaauucugagcauugagccauugagguaagucuccccacuucagauaaguugaggcacuucucuacuauaaugaaucguuucacuuuaguaauauuuaacuuacaaauacauugcaacgaguauuacauaaaggacaaauugucuauuauaaaauuuuuugugaaugacgauggccuaauuucagaguuuuacaucuuuauugucauuguacguauguauuuguuacagaaauauuucgucaaauauuucaucaaauauuucagaaaaauaagacuauugagauaaguaaaaagaaagucaccccaaauuucuacuaccaggggacaaccacuauuacuauuuuccuuucuuccgugcuuuucccuaggcaugcauauauuuauaugcguaaaauauuuuuacaaacauaacaagugucaacauuauagaucuacaccauuauuaauaguuucauaauauucauguuaauaguccaucuucagauaguucaugcaauuugaucuucuaucacuggauuuuagacugguuuguaguuuucaugcuacuauaaacaaugcuuuaaagaacagcuuuuaaauacaucuguuggccgggcaugguggccgacgccuguaaucccagcacuuugggaggccaaggcgggcggaucaccugaggccaggaguucgagaccagccugggcaacauggugaaacccugucucuacuaaaaauaugaaaauuagccaggcgugguggugggcaccuguaaucccagguacuuugggaggcugcaggagaauugccuaaacgcgggaggcagagguugcagugagucaagauugugccacugcacucuagccugggcaacagagcaagacucugucucauaaauaaauaaacaaacaaacaaacagcuguucaccuuuuccaguuauuuuccuaggaucaauuccuccaaguggaauuauuuucuuugggcuuuugcuguauguugcugauuguccugagaagugccucaguuaagccccaaacucuagcugaugcugauacguggagaauaauaaguaucacauuguuuugauuugcuuuucuuauuuguaagggugacguuauuggcauuugugcuucuucuuugguaaauuuugcauugauagcagauccuuugccuaguuuucugauggggugcuaguuuuuuccuuuuuuuaaguuuuuuguuuuuuuucuacuucauuuauuaaugugugucccuauaggauugcuaaaauucuacauagucauaucauuuguuucuucacauuauuuguuucuaccuuugauauuaagcuuagaacagcccuccuuaucccaagauuauguacuuauucaccugauuuuucuguuaucauuucugugauuucacccuuuuacauuuuuaauccaguauuugguuuuaagucuugaaauuaggaugugacugaaauuguuagcccgcuguuccaguuaacuugauuauuaguuugauuguuuaccuacugauuugcaaugucacuuucucaauaugcucgauuuuuauauauacauacucacucaugggccugguccuaaacuuuuuauuuaguuccauugacugacuugucuuauaccauucuuaauguauuuucccauaugcauauuuacaauaagaugccagauacuugaauaguuuaauuuccuguguucugucugcauuucaucacuguauuuuacugcugcgagauauuuauuuccaaauuuuacucuuaaacuguaugagacacuuuaggaggcugaggugggcggaucacgaggucaggaguucaagaccagccuggccaauauggugaaauccugucucuacuaaaaauacaaaaauuagccaggcgugguggcguacaccuguagucucagcuacucgggaggcugaggcagaagaauugcuugaacccgcgagguggagguugcagugagccgagaucacaccacugcacuccagccugggugacagagugagacuccgucaaaagaacaaacaaacaaaacccaaaaaacagugugacauuauuucuuuauucauggaagcuauugcuuugagauugcuuuaaucaguccuuggagauuuuguggggauuguccucauguucucagaagaaguacugauauguucugcaauucuuuauucaacuuuuauagaaccuguguuauaugcaaucacuuauccaaaaagucuggauuccuaaaaggguauuugagcauuuuuuuucuguacuagaaccuuuuacuuuuugcacuucugaaagaaggguuucuguagaaaaaaaguuucaagcaaaaacuuggcucauacuuuaguuucuugugggugguuccuuguucuauguaguaagaauaaugucucuacuuauaaaaauaccagcagacaacuagucuggggacagagcugggaagucugugcaucagcccaugagauauuaagacugaccacguuuuguuucccucucacacagcuuucuacaaguucugauuaaagucagaaauagacacaaugaugugguuccuacaauggcacaaggagugauugaauacaaggagaaguuuggguuugauccuuucauuagcacuaacauccaauauuuucuggaucgguuuuauaccaaccgcaucucuuuccgcaugcuuauuaaucagcacaguaaguuggaguuuguugguccaguuuugaaaagguaaccauagugauuucucccaaauguuuuccuguuguuaauuuacugaccugcauuuuugguuguagaaauuucauuucuaguucgguuuuuccuaagugaauccuagccauuacaaagcuauuaauuuguauucuugguuaaaagaaauguuugaaaggcuuuuaugaggcucacauuagagacaggaccacugccuaccuuuuaagucucugcugauacagucuugauggggaugagggaccgccuuuaauggcagccggccuucaucucugaauacuuuuauguaucucagauuguauuauuuucuuuauccaggauauuauguguuuuccuuuuuaguuuuaaaaacauugacacuggaaauauugaauuggauguuggugauaggagccaucaguucuuuauuucacagugaucagugaagucagauuaagccagacugucaguccauaaucccguauugagaguuuuagucugcucuugaggguacuaagcagauaugaaaaaaacaacuaaaauucccuccacacaaaaaacuuuuuggcucaucuucagcacugucucuuuggcugauuuuauaauccuugaggaaaagcauccacaugucuagagcauaauucacccuguuugcugcaucacaaaguggacaaaccaucuuuauuuuaguaauuugauuuauuuggauaacugaauguuauagaacuauuaaauguggccuuauauuaaauguauaucuucaaaauggaaauguaugacaauuuacaggaauaaaagagccuaaauacuguucaacuaaacuacuuagauaacuccaguugcuuucugaucuaaauacacauguacacauauauacgugcauguuuuuagaucauuaguuaggccuacacaucucuguuuuucuuccccuuaaucaguucgaacuuuauuaauuagccuaaugccuguauuuaucauuuuucauaguuuaaaauauccccuauuuuauuuaggcauccuucuuuuguuagucgcaauuuuugcuugauuuaaaaauaagaacaccuauaaauauuuggaugcagauugcuuuuuucuuuggggcuucuuuuggcuuuuauucagaaacaaaauuuugcaaaucuuguauauugugaaauuaucugaguguauuuuuaaaaauacuugaacaaguauuguuuguguacacaacauugaaacauaaucuccaugggggaggcaucugaaaugcugccagcgaagacacuuugcaagcuuguccaaaugguauagaccacauguucuaaauauuuaaugaaaguuggaguuugugucuggaguaguacuaagaagguggguauacuugacuaaggaugaaaguaaguuucuucauccaugucacauugggagaggaagaacggauugggcaccuggcacgugucacugcuuuagaaccugcugacugcaacugacagaccuuaaaccacauccuccuccuucauugaccaauaagaguuguucacccaucaauuguguguauuccauugcucuaaguugcuguggaugcuaaaaugauuuuuacacauaagauauccuuucuaaacauaagccccuauauuucccugugugaccaucccagccugcuguguuuuaauccccucccuuuccuuuuguguucgucuagcacuucuguuugggggugacacuaauccuguucauccuaaacacauaggaaguaucgaucccaccuguaacguggcggauguggugaaagguaaggagaccguuguaaugguaucgaucguaguucaaauuggauugugguuuauuggaggcagcuuggcuauaggguuauuuugcagugcagucugcugauucaucaggucacucugggcccaagccacuggauccagaugaaauguucuuucuaggcaguucagguaggcaguucuuucuaggcaguucagcauaauugguaaggcucaaaaugugaguuucuacuuuauugauuagaguuucauuuguaguucugucucaaacaguaaacauuuaaguaagauucugauugccacuguuaucugaaaauuucagagaauccaaauucuuaucauaaaauuagguugaauucacgugucuauaaaauuuaaacauauuucuguuguucacaucuggcuuuagaauuuauguggcauguaagcuucauggguucauuggacuuuaagcuagacauuguuccaguauccuccgggaagaaccaagcccuauauccguaagucccugguacccaggcacuuugaauuugaacagcaguuuccucauuauuuauucauuuaagaucaaugcuaucuccaagaaaccuuccugguugugagcgauccaccagguaccucuucaguuuucuucauuguuacgguuacuuugugcaaccucagauccccaaauugucccuuucugcagauuguaucuccuguguuggccuuuaucucccuucuuuaaacgcucaccucccaaguuucauggcugcaauucucucugaucuucaucaaggaucuucauugcucuucagcagccauagcaaaggaaaaccucuguaauuuguuuacccugggcauuccuaaacccagggaggaggaccagaccuguugguuuuagcuuagccuaggauugucuggcugcccuggccucuguugagucacaacagauuuacucacauuauuucaguuguaaggugaaucagcccagccucagcucuaggaauccuauugguugcucucucacaagauaacuuugugguugaucagaaccuccaaaggccuccgggggcaaggaggaaagggucagucuuaucauagcuuacauguucauuaggccuuagcucagugccuuuuaugaaacagaaaacuugguucagacaguugauuaccccuuugagaaaaaggcacaauuuagaaagcaaaagugcauugugauauaugguaugugugcauuuucucuugaacuguaaccaauuugaggucaggguuugugucuuauauuuguuuuauaacuugcauagaaccaacuguagugcuuguguaggugauuaauaaauauuccuugguuugauacauuuuaaaucuuuugagaauauacuuuuaaaaacagcuuuauugagauacaaucucauaugauaaacuucaaccauuuaaaaugcucaauucaguguuuuuuaguguauucacagaguugugcaaccaucaccacaauccaguuguagaacauuuuguuuuuuucuuucuuuuuuuuuuuuuuuuuuuuuuuuuuugagacagagucucgcucugucgcccaggcuggagugcagugguacgaucucagcucaccgcaagcucuguccuucgaguucaagugauucuccugccucagccuccugaguagcugggacuacaggcgcaugccaccacgcccagcuaauuuuuguauuuuuaauagagacgggguuucaccauguuggccaggauggucucgaacuccugaccuugugauccaccugccuuggccucccaaagugcugggauuacaggcgugagcuaccacaccuggccuguagaacauuuucaucacuccagaaagaaacccuggaccuguuagcagucacucccuucuacccuucucuuuagcccuagacaaccacuaaucuacuuucugacucuguauagauuuuccuauuauagacauuucauauaaacaaaacaauacaauauguggucuuugguaacuggcuucuuucacucagcauaacauuuucaagggucauugaugucauagcaucuuucaguacuuuauuccuuuuuauggcugaaaaauauuccauuguaugaauauaacacauuuuauuuuucucuucauguuaguugggugaucucagacuugauuaaguaaccucuuuggggcucagauucuucaucuguaaaaugaugcucuugguaauucaccuauauuguagaguuaaaugaguucauauuuguagaaccccuaaagcaaugcuaguacacaguaaaggcuguagacagguuuacuagcagcagacaguccuugggugucagacaugucauuuggcuucccauguacgccauugauuauauaauagguuggugccuuuauuuuguuucuggcauaaauuauaaaauauuuuuuaaagucauuucaggcuuuuauaagacaauuggaaauuugaacacuggauauuugacauuaaaaauauguuaacuuuuuaggugugauauugguaucuggucuuguuuuuauaaaggagugcuagcuuugagagagguauuuaaaaauauuuacacaugauaugaaaugaugugagauuugcuucaaaauuauacacagggaggggagugaaaaggacugggcauuuguugaaaauucuugaggcuguugaugggcacaugggcucauuauacuaugcucuguacuuggguauguguuuggaauucuucacgguaaauguaugagucuguucucauguugcuauaaagaacuaccugaaacuggguaauuuaugaagaaaagagguuugauugacucacaguucugcaggcuguacaagaggcauggcuugggaguccucaggaaacuuacaaucauggcagaagggugaaggggaaguaagcacgucuucacuugauggcaggagagagacagcgaaggggaaugugcuacagacuuuuaaacaaccagaucucgugggaacucacuaucaugagaacagcaaggggaaaaucugcccccaugauccaaucaccucccacaaggccccaccgccaacacucaggaucacuauucaacaugagauuugggugagggugcagagccaaaccguaucaaugaaguuuuaaaaacacuuguuuucaucaucuuauuguuucugcacaaauaaagucuuucacuaauuuuuagggagcuuuuaaccaagaaccaguacaacuagauaaguagcagggaguuuuaugaaacuguuaccacuucuauagaacagagcgauuaaguggugcuaaagugagucagaggugucagagugugaggaggaaucgacugugauuugacucuuaaugugaacagaaucgaucguuuuauggcacuuacugucuguguuacucuucucucauauuuaguacauauuaccuggccuugucauuauuuguacuuucuuuuuuuuuuggagauggagucucgcucugucguccaggcuggagugcaauggcgugaucucggcucacugcaaccucugccuccuggguucaagcaauucuccugccucagccucccaaauagcugggauuacaggcacccaccaucaugcccggcuaauuuuuguauuuuuguagagaugaggccauuugaccagauguuggccaugcuggucuugaacuccugaccucaggugauccgcccgccuuggccucccaaagugcugggauuacaggcaugagccaccauccccagccuauuugucucucucuaucuagggugucaauuucuaaaggucuggaauuauucuuauacgcuuuugcaucacuccucuuagggucagaaguuuuguaccaaaaaguagcugaagguuauaugaagaauaguucaauacauaauugaaagaaaaaacccuggaaguuuaugccaaugucuaccucauagcuuccucuuugcuuugucccuuuuagacacaguuuugacccugagccacaguccccuccuuuuucuucccucuucuuguacucacagcuuuaucuuuagucuuucuccugcgcuuauuaacuauauuauacccauuauugcacugugaacaaaguuuacugcuucccuuacuuaaucauuccugccacucacuuagcauaauuaaagcuuggaguuccuggugaagcccuauacaauaacagucacuucuugugcccuuuugugacucaaaaucccucuucccccaacacacacauacacauacacaugcacacacacacgcauggacauguacacacauacaaaucccaccuccacacucaugggguaagcaggaaggacuggcaugcuccccauuccccacgccucucucaaaccaugguuuuucaucucucaacagcauccucccuuaaggaaaaaaacaguggaggugguuucagauuccgaaaguguauaacccucuaaagcagcagccacauaaucaacuuucugacauccuucauucccuucauaaacgaugcauaccgauacccacagcacacuaaauacucuuggcuuauguguguuuucuggaaugcuuuuguacuucugcuuccaccuggugaggugcaugcuuacuaagggucacuuauuuguacccaagcccuugguguaaguuauacugacuguugugacuauauaauuuauuuaaauguuauguaaacugaagaaauaugcauacaagaaagagacuuauuucuguuaaaaccaaguugaaugcuuuggaaggacucuuaaaaauguuaugaaauuacugugaguaagaaaacgauuagauuacagggcagcacggaguaaaaaucuuaccuggaauuuauacccagguugcuucacaaguaucuuuaaguuuauuauacuuuaaagaaauaggaauuggaauucauagauguaagugauauuguucauccaagaaagacgaacuggaaccccaaacugauccacauucaaaggaaaggccuuauaugaauauacugacagauaaauaaauuguauguucaaaugugcauuuuaaguuaauguuuacgauaguaaucacauuuuacgguuucccacuuuacccaacauuuuuguuaaucauccaacuccuuuucccaguugggauaguuaagaagacuaaugccauuuucccaaaauaauaaaagugcucaucgaagaaaguuuagaaaauaugggaaaagagagaagagaauaaaaauuaccuguuuucauaauuuagugagaacguuguuuuauacauuugaacucauaucagauuuauagauagguguguagcugcaaauauugugucuaaucuuugucuccgugaaauccauaguauuuuugaauuucucuaucuccagcacuaaugcccaucacacacacccuuccuggcugaauuugauaccccaugguagaagccucuauccugcugucugcgucaguauuuuggaguucuuccugugucuaaucugugauacucauuaucuguauauuuaaauggucuuuccagccaagugugcauaaccuuuauucugcagugggggauuggccuuacaucaguuacuuuuucuacccuggcaaaugggcuaggcaaccuagaaggaaaccugcaggccucucuuuuccuuguagaccaaagcagaugucuccagucgacugucugcuucauuuccuauggacccuccucuuaauuuuuugagcaucaaaugcuuaugcagaagcucuuucuaccuccaaguaagacugagagagaauaaagaaggcacagagcgccaaagguugaaaggccugaaauuucuucugugucuucuagcuaaaaggcacuggagucuccauccccaaaugccccaggagcaaccaucagaaggucucaagaggcccaggccucaccagcucuucuuaccaaucccugccaaguguugccaaggaagggaagaaauggaugucagccucuuuugacucuuagugaagucuuacuguugccuuccucuuuuuagaguaguugguauuuucacccuggcuuuguaccuucuuccacuauccucugagauuucuuaguuaaucuucuaacucagaaucucuauagcuaaucuuuuauuuccuuccuuuuguuuuaagcaguuggauguuacgagaguaagggcuccagguuuuaaugacagcccuacuaaugauuuucuuagcugugagaauccuacaugguuuaagcauagucagauguccagcccaaaugacccugugugggcgucugugugugagccucuuugugugcacacauguguguuuuauagguuuaauaaguguuggcuaggugcagugacacacaccuguaaucccaacacuuugggaggccaaggcggguggaucaccugaggucaggaguucgagaccagccuggccaacauggugaaaccccaucucuacuaaaaauacaaaaguuagacgggcaugguggcaggcaccuguaaucccagcuacucaggaggcugaggcaggagaaucgcuugaacccaggagacggagguugcagugagcugagauugcgccauuacacuccagccugggcaacaagagugaagcuccaucucaaaaaaaaaaaaaaaaccacacaaacaacaacaacaaaacaaguguuaagcccacucccauccuuagaucucuugagacagauuacagaaaacucccauguagaagaguagagacaauauuuuuauuuuugacuagacaguuguaucaacauauaaaaguggggugcaucuuguguagcauuaauugaaugugcagaacacugaaacaugccuccuugcugcuuauuuagcaccuuaguaucuaccuuuacacaucuacaaauuauagaccccagguagugaaugcuagaauuaguguuguaaagcagguccuauuauccuuugggaggugccuuccacugugacccuuuucccuccuuucuuuguaagaagcuaggaaauaaaauggaaaauccugcuguaagaucauuuugaaaguauaaacuuaaauacuugguguaaaaaucgauucucacagcgaugcuaaguugccuguguuguucuuacaugcuauuacugcuuaauauaauagcacacaagugguauccucagagcgcguggcauuauucugguucagaaauaaugucuugugcucucacuuugggcucuucagguuacaaguaacagagacccacucacgcuagcucaagaaagauuuaucaaaagaaccugguaggucccaugauaauccaaggacaggaagcacuuuauaguuggagcuauagaaauuggaauuaucagccuggccaacauggugaaaccccaucucugcuaaaaaugcaaaaaucagccaggugugauggcgugugccugugaucccagcaacucgggaggcugagacaggagaaucgcuucaacaugggaggcagaggcugcagugagcugagauugcaccacugcacuccagccuuggugacagagugagacuccaucagaaaaaaaaaagaaauuggaauuaggaaacagaaaacaagguuguuuucugugugucuuugcagcuggaguugccaagucauggccuuuccgccuuucucugugccugcuccuuuaccuguuuuugucuguguacuggacgacucaguggcagcuuguugggcacucuaguccuucacagaucaugauaauuuucaguguaccauuuuggcuucugcccugccugaucaccccaacugucuugauccuaaauucucaaaagaugcauuuaauuaacucagcuuaucuuuuuuugcccacgaucuugauucugaauucccaaaagaugaauuuaauuaacucagcuuaucuuuuuuuuucuuucccccuacgaucacaaguuuuaggauucugaucaaucuggagauuggauauucugcucccacucccacuugcccagucugcugugguuuggagcgugaggugugggggccuacuccuuuaaaaaaucuccauuggaucccacuugggauggguuugggguaggaaggaugaugauagacaugccuuauuagaauugcuuugagacuugaaaggguuccuaaaaggcagcauaucaauuccagaagguggggugcgggccaguguugucucuguggguucuaccauggugcacuguggccagggccaaaaagugcagaaggugaauauagcccaucaaccuuaccuucaucuucagauacuugcaaaauagaucucggauucagguauggcucuaugagcaagugaauaugcugauagagggccgugucauugguuuugacgagucugugaaccucauaucagaugaugcagaagcgauucauugugaaacaaagccaagaaaaccccugggccagaucgugcuaaaggagaucauauucugccacaaaaugucucuaaccagaaaugaucaaggaagugagacacuauugagaacuuguuuuuuuaggugucauuuguugggaguauaguucuaaaaugccuguucagauuguuuccauuaucuguauauauuauuaccagaugacaguaaaugcugugggauuguuuuuauuaaaaaauaaaauaaaaacaauuaaaaacagcccaucagcacuuuucuaauguuuucuggucauuuacauuuaccuuuuugugacacuggcuucuuaaacuucagcuuuaugauuuucuguauucuguuagacucaaaguuagggaccuuggcaccuuccuuuuaauuuuuucagcacucacucaaauucauccuaguccagccucucauauuuuuugucucaaaugauugcaugcauucaagauagaggcuaauauuugauagcagaguucuguggugaauuuugaauaggaaaaucugaugaaacaaccuccauuaucuguucaauuuuccugugugcuauuucuuaaaacggauucauggcuaguuugguucuguugggcugauugcugugugaaccuucacccuguucucagccuuuuaaaauuuuagucuaaugcauuuacaguuuagauauuuuaaccuggggaaguauguaugagccacaccugcaguuuuguuaauuacuuuauaaucaguaccuuaaaacccuugaaaacagauuccuaaaagaaggcaugucacuuauauucaguggcaauaauaauucucuaauauuuucuucuaaagauugaugguaaauauuggccccaguaugcacauaaaaguaauuuggcaguuaucuuuuuugaaauuuugauuucuaauuuaaaaaauagaaaaguuugauuagaaagcuuauuauaaguagaauuugcauuuuacucuaaauguaaauuacaagccaugaguugaauuuugguuuugauggcgauuuuuuaaagcuuuuucauuuuuauguuaaauuauuuuacuuaaacagaaauguccuguuugaguauauaagugcuguuaccccagaaccucauaaucauucauauccugggagagaugaguggcagaauuagcgugacucagacuugauuuuccagggaaguggccuagcuucucuuccgaauuaccugcuaaguuuuaagaauguggacucucaggccucaacauagagcuacugccucggaauuuccagggguuccuuucauaaucuguacucuuucuuuuaaauuugguaacgaaucccacacacagcuagauuggggaaugagucuaggccucuaguucccagucucaccaaaaggaacaccucccgucaguguaauuuacugcauguugagaacuuaaucaugggucagaggaucguuccauuuaacaaaugcuaaguguguauuguguccaaggcauugcaacaugcauuguguccaaggaauuuacaaagaugcauaguauauauguaauaccauuaaugcccucaaaauacuuuuggcuagcugguguaugugagucuacauugugaugacuugaguucuucaaggaucaucaugcaauucuuaauuauaacguugauacacuguaaguuguagugaugcuuuaaaaauucuuauucgcacgugguuuuaggagcuguacugggucuuuguguuucgaguuggcugcuucugucuaggcuuggucuuucacauguuaaauuuguguagcacauuuucuuaacaacgcugucauaaucaugcuacugggcaagcgaauuccaugaggaauuagcacauuuaguggguuuagguuauuuuuguuuuguagugaauggaagagcacuguuuaaacaucuuuauuacauaccuggaggaguuguuuugugaagauguguuggcuuuguguaucgauaaugaaugaucguuuuuagguuucagugcuugugaucuuggaaguuuguguucagcuuugugcuuucacgucacuagguggagauguagcauuguuuggcggcauaggcuaagcaagaggagugagucuugauuucucuucuuuugacaaaaguacuuuacagauauuugauaagguuuauuauagccuaggaaaacacuuguaaauuuaguacaauucaaaauuuuuaacuuuuuuuucaggauugaaguucaauccuacuuaagugucuauuuucauacugaucaacucuuuuaaacauuuuuuuucuccucuuacugcuguuuccuuuuugcugucccucauuauuucaccuugucugaguuauuuuaaugucucuaucuuugguucuuuauagagauuuaauucuaaaaguuuaguaaaggaaucagaauucuuacucugaggucaaauaauagauaauuaauuugguagcaauaugaagucaaugaacuaaaauuuauagucugaacauacccuaaucuuaucuuuguauuauuuuagguuaauaaugucaauuuuuaacauuaacauucuguagggcuuacuuuucccccuuugcuuccuuccuucuuucucucaccucuugaauauuaaacaagcacaguauuuacuuugcacgguauugauguggggaauauaaaggaaauaagagccugucuucaaagagcugauaauccuguugagaacauuccaaaugcgcccacgaagcagcaguuuucuacuccuagguauauacccaagauaaaugaaggcauauguucacacaaacauuuggacauaaagguucauagcagcacuauucauaauagccaaaaaguggaaacaacccagaugucuaccagcugaugaacggauaaagaaaauaugguauacuuguacaauggaaugugauauagcaauaaaaagaaaugagauccugauacaugcugugauguagaugaugcuugaaaacaugcuggugaaagaagccagucacagaagaccgcauauuauuccguuuauguaaaaaguccagaauagcaaaucuauagagauaaaguagauccaugguugccuagggcuggguggaggggaguaacugcuaauggguucggaacuucuuuuuguagugaugaauauguaaacuugauuauagugauuaaugcacagcucugacuauauacuaaaaaccacugaguuguauguacuuuuuuuuuuuuuuugagauggagucuugcucuuuugcccaggcuggagugcaguggugugaucucagcucacugcaaccucugccuccuggguccaagcgauucuccugccucaaccucccaaguagcugggacuacaggcacccgccaccaugccuggcuaauuuuuguauuuuuaguagagaaggggugucaccauguuggcuaggcuggucuugaacuccugaccucaagugaucccccugccucggccucccaaagugcugggauuacaggugugagccacugugcccagcuguguguacacuuuacuuucaaugagugaauuguauggcauaagaauuaucuccaauaaagauuuuuaaaaaguaaauuaccaaaagguuuaaaauuuaucaaacuaagguuguuuuuuguuuguuuguuuuuguuuuuguuuuuugagauggagucucacucugucccccaggcuggagugcaguggcacgaucucggcucacugcaaccuccaccuccuggguucaagcaauucuccugccucagccucccaacuagcugggauuacagacgcucaccaccaugccuggcuaauuuuuguauuuuuaguagagauggaguuucaccauguuggccuggcuggucuugaacuccuggccucaagugaucagcccaccucggccucccaaaguccuggguuuacaggcgugagccacugcacccggcucaaggacuguuuguugaccaucuacacaggcacuauacgaaguucuaugcaaguuaugaaacaaguguuaagacacaaacgcugacuucagauuguuuacaguucgagagaaaaggcauauaugcaauguccaaugucuuguaaugcaccuuugcuuucugaaucugcuccccaucuuugaaucuccugaauucugucuuccggcuguuucuguaauggcucuuaucuucuuaccauaugucuuuuauuuuauccuuuaaaaagcggacuguugcuccucagacuuugauaaauaucagccccagccuguuaccuuuaacuaacucaaaggaccuuuuaaagugauaguggcaucuccaguaacuuaaauuguguggcucauggaaaucuauucauucagcaaauacuuacugagguuucacuuacaaauaacucuggcaaaucacaagacuguuggcauuauuauuuuuaagaucaugacaaauauucuuuugcuacaauuuagucagguugcauggugcuuagaacguauagucuugaguuccuaaauuuucaugaaaaauauauuuugguaauaguauaaguuaaacaaguacguguuugguauagagcuagcugaauugccaguauucuaguauguugacauuguuauggucauuaaaacuuugagaaaagaaagccaggcacgguggcucaugccuguaaucccagcacuuuugggaggccaaagaggguggaucaccugaggucaggaguucgagaccagccuggccaacauaaugaaaccucaucucuacuaaaaauacaaaaauuagcugggcgugguggcacacaccuguaaucccagcuacucgggaggcugaggcaggagaaucgcuugaaccugggaggcggagguugcagugagccgagaugacaccacugcacuccagccugggugacagagugagacucugucucaaaaaacaaacaaacgaacaaacaaacagaaaauccuuuaagaaaagagagauuggcugggcaugguggcauaugccuguaaggccagcuacuuggaaggcugaggcgggaggacugcuugagcccaggaguucgaggcugcaaugagcuaugaucacaccacuguacucuagccuaggcgauagagugagacgcugucuuggaaaaaauagaaaagagaaauuuugcauuagucaugguaauucuauuaaagccacaaaaggguauuuuguaaaagguuguaguugauuaauucuacauccauccguuuagacaguuuaucuuauguaccuauagauauauacaugcacaugugcacacacacacacacacacacacacacacacacacacacacacgcuugugccuauguuauuaguacagcagcuaaacuuuuuccuuuucuugcagaugcauaugaaacagccaagaugcugugugaacaguauuaccugguagcuccagagcuggaaguugaagaauucaaugguaaaagaaaacuaauuuuaaccuuacauucaaaaaagcugacuaagaagcuguuuauaccuaagccauauuucagugagcuccaaaaauuauacugauuuuucauuuucuuauaucuuuuuaaaacuuucuacgcuuuuggucaaccagauauauuauuguaaggaguuuuuguacaggaauguguaauguguuagaccccagaauucuuggaacagaaauaaucaagguagaguauguagaaagguauaaauaggcccuucucaaaguaacaaaugcaagcagucgaucaacauauggaaaaguguuuaacuucacuaaucaaggaagugcaaacaaaaacacagacaaaugccuuuuuuuuuuuuuuuuuuuuugagaaggagucucguucuguugcccggguuggaguacaguggugugaucccagcucacugcagccucugccuuccagguucaagugauucuccugucucagccuccugaguagcugggauuacaggugccccccaccaugcccagcuaauuuuuguauuuuuaguagagacgagguuucaccauguuggccaggcugguuucgaacucaugaccucaggugauccacccgccucagccucccaaagugcugggauuacaggcgugagccaccgugcccagccaaaaaugccauuuuugucuuucaaaaugacagugauuaaaacauuuuaaugcuuugaauuugugcccauaaaaauacuuucucaccagcacauacauuucuuguauaagcuaaaagugguauucccuuucuaaaaaaugccagcaauguucuuucuauuuggcccaguaaauaaguuaauaauggucauauucuuugguccaguaaauuaaacuucagaacacuuauuauaagaaaauagaggcuggacacagugguucacaccuguaaucccaauacuuugggaggccaaaguggguggaucucuugaguccaggaguuuaagaccaacccgagugacauggcgaaaccccaucucuacaaaaaauacaaaaauuagccaggcgugguggcacuugcuuguauucucagcuacuugggagacugaggcaggagaaucacuugaacccgggaggcggagguugcagugagccgagauagugccacugcacuccacccugggcaauaguuugaaaccccaucucaaaaaacaaacaaaaaucuaugaaaauagagaugcacagauuuauguacaagauugaugaucacaguaguuuucuuauaaaguuagaaaacaacccaaauuuuccacaauagagcauuguuuaacugaauugugguacacccauuagauagaauacuaugcagcccuuugaaauaaugcuuuaaacgaauaacguaugggaaaaauugagauuuuuaaaaaaauacaggcuacaaaaguuuauaguaguggaguucauuggaaaauauuuugaaggauuuauacuaccaaaauacaaauagcagcucucuggguaaugggguuacagaugauuuuuacguucaucauaugauuacauauuuauuugcacauuccuuuuuuuauuugcaaauuauggaagagacaugcuuaucacaaaaauacagauacagaaaugugacugaaaagggaaaucccccacaacuuucucagucccauauagagcuuugguuuuugcauaaagcauguauagcuuuaacccuauuuauaacgugguuuucacuucaccuugaagaccuuugcaaguauuaaucucauuuagagauuauccauaguguaacuuaccauaauuuauuuaacuguuuuccuauggguauacauuuaggauuuccuguuuuccuauauuccauauaaugagcuaugaaagagugugagagguggggaggguggaaaaauuugugaacguauggaaguauuucugcagguuggauuccuagauguggaaugacugagcagggugugagcauuuacaguuaaagauaaaccaggccaggcaugguggcucacaccuguaaucccagcacuuugggaggcugaggcaggagaaucucuugagcccaggaguucgagaccagccugggcaagguagcaaaaccuugucucuacacaaaauagaaaaauuagcuggacauaguggcaugugccuguaaucucagcuacucaggaggcugaagugggaggaucgcuugagcccaggagguagaggcugcagugagccgagaucacaugacugcacuccagccugggugacagagcaagacucugucucaaaaaaaaaaaaaaaaaaaaagauaaaccaaauucccccucaggaguacacuaaaaauguauuucucuuauaaugagauaaaacugugaaaggaguucaggcugcuguugaaggacauggccccuccauuugacuagaaggcauggagucaaagcugcuuucaaggucucuuggguucucugagaagagucauguccccauugaauaaauauacuaccaggaccgagugggcuugucuggaguguuccugaugagaaccaucuuaauauucuuucucucucuuccuauggacuaggcaggagcugaucucacaucugcagguaguaacaaauugcucuuuugcgugaguggcagccucccucauucuaaaggccaaagcagcaggccuguucuugcugauucccaagugccagccaugucagcacauucuguccccgcugaggcugucaugcugggcagcucacccaccaggagaggagcuuuccgacucuuuuuggcauugucucacgaauuacagaagcccccuuucgaucauguuuugaagccccuuguccuaucacuaagauaaaugaaugcugguguuucuagguagcuucuagcuuuauguugcuuuggguaguguagugauuauuuuuauguauaaguucuuaaugcuagagcucucuugugagcaugauuaaggaaugugcuuucgccuuaacaaguucuauguuggagaugcagguuggagguugauccugaacaccuuaaguggaugcuuuuuuauucuggaaggagaacugucuggaaauaaaauuccuuauaucuaaugguauuucuuaaaugcuguuucaacuaauggcauuuggagcaaugacuguacaaaauagagacuucauuauuucugaagucuugagcaugacaaaccuaggccauuuuuaaauugacuuuuaaaaauguacccuuagauggaaaauucauauucuacuuauuuuauaagucagcaaacaucuauuaagcaucugcuacuuaacagccagccucgagacccagaacuaggaaagagucauggacaaaagcauuugacaugguuuuaaaaggaaggaaagaaaucuaaacuguaauguucccaaagaaaagugcagguaauugagcaagccuuuagauggcuccuagagaauguuguuuaaacugaaaaaauaaaaauaaaaaaacccacuauauaaaagguguuugccuuuucuugagauuuggggugaaaagguugaauucauaaggcuguuuauauaacuaaucaugccauuugguacaagauaaacugagcacccagcuuguuccucgagccccauuaaaaugacaauaaaggagccaggcgcaauggcucacaccuguaaucccagcacuuugggaggccgaggugggcggaucacuugaggucaggaguucgagaccagccuggccaacauggugaaacccugugucuacuaaaaauacaaaaauuagcugggcaugauggcauguuucuuuagucccagcuacuagggaggcugaggcaagauaauugcuugaaccugggaggcggagguugcagugagcugaaauugcgccacugcacuccagccugggcgacagagcaagacuccaucucaaaaaaaaaaaagaggggaaaaaaagaaauaaaaauaaaaugacgauaaaggaauccaaagaaaagcagcaaaggaaagcagaggagcucauuaguggaccagugccuuaguccauuuaggcugcuauaacaaaaauaccagagaccaaguggcuucagcaaccauuucucaugguucuggaggcugggacauccaagaucaugguuccuggagauuuggugucuagugaggacccaccuucugauucauagcuggcuucucacuguuuccuuccaugggggaaggagcgagggagcucucuggaguuucuuuaaacgggcauuaaucccauccauaagggcucugcccucauaaccuaaucaccucucacaggccccaucuccuaauaccaucacaucaaggguuacauuucaacauaggaauuugggggagacacacacaaacauuccguccauaagaggcaugaaucccaacuuuugaaagagggucacuagauggaaguaugcugauuggugggacagagcagaagcagccacaggggaggaggcugcagcagagguggcaacugguuugccgaagauuguccuggagggacucugggggcagggccagguggugcaauggacuggaaugggaagggaaggcagaggguaggguuaacugaaagcuggucuaagaaagagcauggagggaugacgggaggcagcuguacucuggccggguucagccugccaacaggcaacuaaguauuuuguucgagaacaaccuaggaagaauuagggcuuuucaugugaguguuguuacccugcagcaaagcccuguucguuuaagcauuugggggccucucugcucagaggcccauuuacuaccugcucauccucaagccaaguugaaaagucuugaccaguccagagagcucuaagucaggcuucccacuuaauggagagccccagggggauaugaacgccagcucccucauacagugaauccgguucuucauucucaaacaagaauauugcaaccaagauggaucagaccuucagcaaaagccagcagcaagaaccaaaccuaacuggcauuaaacuuaucagcucuacuguuacugccagaaaccccccuuuugaaauucugagagaaaaucauuucaaaccuagaauucucuaucuagccaaaccuuuaaucaaauagaucagagguguaaagauugacagaugugucucccaugcaucccuuucugagguagguuaccugacugccuugauguuauguauaauaugcaucuaagaaaggggaaaacauucuagaacuucaaucaaaaacaacuuuaggaugauggcuaugcagcauguuugcaaagcaauugauucuaauuugaaaaaucuugaagaauggacuggauaccaugcaguagguauggaagcuggaaguagguauggaagcuggaaguagguauggaaacuggaaguagguauggaagcuuccaguaagcuggaagaucuuagcgaaauggcauggaccaacuaugaagcaacccaaaaaggguagcaugauguugaccaguuggaggaguauaaagaaacuccauuucauguuaaggcugggaacauucuccuccaagggacacaugaaucauuguuauugcauuaauagggaagaaaaugucuagguacacuguugugguuguucuacagugaucaauauuuacauaguuauaaugucaccaacacuugauuuucuacuuucuugaaagaaccuauaggcaauuuacagcaucccuaauuuggguuacagaacagaauguaaauauuaccaacccaaagacuacagcagaaguaguaaagaguggcugccucuggguucagacugaaggauaagauaggaaagggggaaggacuuuuguuuuucuucuuuuguuaaauuuuuaagccguuuacauauauuacuaagugauuuuaaaaacaacugcucaggccaggcacgguggcucacgccugcaaucccagcacuuugggaggccgaggugggcaaacaccugaggucgggaguucgagaccagccuguccaacauggcaaaaccccgucucuacuaaaaauacaaaaauuagccaggaguggcggcgcacaccuguaaucccagacacucaggaggccgaggcaggagaaucgcuugaacccgggagguggagguugcagugagccgagauggcgccacugcacuccagccugggcaacagagugagacucugucucaaaaaauaaauaaauaaaaauaaaaauaauugcucuuugaagaguucgggauuuagacucaaaagcucuuuguucaggugucugguuucggugccacuucugggaccacgggcaagucacacaggcuucccaaagccuguuuccagaccucuaaacaccaccaccccucuaggagccaggaaguguugucaggaggagucaauugaauaauguaugugaaagcucuguguagacugcuaagaaucaagcaaaugugaacucuaauuuguauuacuguuaauuacuuuauuagaggaaguagcugguugaaauuacagcauucuaccugagagaguucauguaguuucaaucucuuaagugauuuugggucaugaggaggaggaaggacuguauuuuugagcaucugcucuguaccgcacacuguucuuauugcuucaccuggguuuugguguuucucagauugucuucagaugacccauggugcaaggggaaaagaucauaggucucuagggguuuaugugcuagcugcuugagaaaaaguuaugugaaccuuacauucuaugcuauaagaugccuuguuugucauaauuuaacaaaacugaacacugccauuuaguccaguucaccagcccuuuuuuuuccuguugcuccacauucucccguggaauucccccuggggucaguggcagaagguagcccccaauuugaaaaacaccaagugauaucugacuggccuucuguaauacucaggauguuauggcauaggugauaauauuccaauucugcucaacaaaguuucaaagagauugagugauuuauccaaggucacauagcugguaagugaaggaacugggugucaccccagguuuguuugauucuaaagcauaugcuuuugcucagcccugccuuuagagguggaaacucaaauuagccuuuuauagagcucuguuuuacacacuuggaaaauagaaugcaaacaucauucuugaauuucuccuacuuuggguccuuauugauugaugguuuugucucuguuuucagccaaagcgccagacaaaccuauucaggugguuuaugugcccucacaucuguuucauaugcuauuugaguuguucaagguaaguggaauuuuaaaaacguggaaagaagucuucauuuuaaauuacuuugauucagggcauaauggauucauuagauuagcauaagaaaaagguuuugcauaaccauuuuaaaaauucuauuucugauauccuguggguuuuauaauuuguacacugugagaugagaaauugcuguguacacuauaguuuuugugaauauuaguacauauugauuuugaagcuuaauugcacuuuagugauuuuauguaaaauccauacuguuuuuucuuuaguuaugagauuagagaugcuuuuuaguuuccaaaccuggcaaaggcuuuacuggugauagccagaucaaaauaaaaacauguuuauacauauuuaugcuucugaaaauuaaccacacugguacauuagugguuguuccaguccugagagauccugcaacucuuuuauaaaauauuugaaucaauucagaagauccaagagaggcagaggagaaagauguagaugagcuggaccaaaagaaccaccccucccccccaccaaauucuuuagagucugcaacuuaagcuguugcuuuuguuaaucaguagcuaaugacauuuacaguagcaguauuacaggcacaaggcauuugagcuaaaauuucauuucuuccaaugcgugaaacacuaaauugaacaccugaaaaaucaguuaugcugauuugcuuccaaaaauuagaauguuacugauguaacgcuuuaagguugaaaugggcauucaauugugaacuuucucuucagcagcuguggcuuuuucagaauuucuuuuuaaccaauauuucuucuacuuuuuucagccaaaugauuaauuuuugugggaagcaugcauccuuucaguuuuucugccuucuuuagagaaaaggugcucuauaaaugcagacugauaaauaggauuuaaagugcacaaaucagccucugcauagccucauuacaugcgauaaaaacauuccucuggguugaguugaauaauuuaaauaccguaaagcgaaaaaaaaaaaaaaagaggaagaagaagaaggaaagaaaaauaaauauuuagcauguuggaugaggcuaaaacuaggugaaaaacaaagugucaggaaauuuuuccuugauuugagcacguuuagcuaagcucuuuagagggaaaaaugccauaaaaauccaacuaauauuugccccaaaaaaggguuguuggguauaagucaucuugcgcuucuuucucuuuaaaaauugugguuugugauucggcaguaugauuaauaaaaagaucuuauuauuuuagaacucaaugagagcgacaguugaacucuaugaagacagaaaagagggcuacccugcuguuaaaacccucguuacuuuggguaaagaagacuuauccauuaagguaacuguuuuaugugcauguauacuuuaauuaucaguugugauuuaauaguaucuagacauugaaaaaucagagggaaggaaauugacauuuauugaguguccuguuuguaaguucuaugcuagauccuuggcuuaaguuaccuuauuuaaacuucauuagaaccuuguuauucagggaguugaacaagaccucaacaccaagccuguuggaucccacuguaccauucggccuccuuuguuuuacacuguucacaaaggaaccguaugucacugggggauucaaaguccuuguacauuguggaguaaucugcuauguacuuuauuuaaugaacccauugccuccuacuaaguauagaucaacuucuuuguuuugauuguuaacauuuugaacauugcagaucagugaccuaggugguggugucccacuucgaaaaauagaucgucuuuuuaacuacauguauucuacugcuccuagacccagccuggagccuaccagagcugccccuuugguaagcaucugaaagugcugcugaaggaaagaucauaaacacaggaaggggcucagagggagcugccucucuccccagguugucacauuaguguaguugauuuagaagguugcguguauuaugguuuggaggagggagaauuuuuugccuuggcuacuugcuuugugaauccuuuggacuucaauuuccucucugauuugugucuaagaaacacuccuagcugagugccucauucccauauacagagaaaaaguaccucauugugguaagacugcuacuguagcaccauuuuccacuuugugcuacccuuggaagggguggaaguugccagugggugagcaaagggacaguacugaaugcauagcugccgcuugguccugcgcacucuggcgugcguaccacagaggcgcgaaucaccuagugccuuggaaucuccacugucaaauuuguuuauauaauuaaaauguuaaauuaugaaaacauuaaauuuuuauguuaaauaacauuagcaugaaacauauaggugguguaugcauuuucagagcccuuucugucucacucuggaaauaaccuucagcccuguuaaggcagugagaaaagccacugguuaccaugguagcauuuagauccugguagggccacacuugcuuccccugcugaguguuucuaauugacaaacaacaauugaacccuuugucauuaaacacagcaacauaucuaucagucugcaaaaugguucaggguauaaauuaaguuucauuuuaaagucguaccugacugauaagcacauaagauuauauuuuauuuguaugaauaaaaucaaacacuuugcaucauuuauuugagacagaguuuguuaacucagcauguuggaaacaggaaaucauuuauauaggagucgagaaaauucaugaaagaucacauuugagaggcguugccuugacuaggcucuggcaugcacuuaaauacacaucaaaaggaaaaaaggcaccacaaacaaaucuagcaccuuccccaguuguuuaaaagaaauauagauugucucuuccaggucuuaaaauagcaucuugaggauagcuguuauaucauagguuuuuuuucuuauugaaacugagggcuuguaagagacuuuuaacaguuaacgcaugcgcacucccauuguauagaugaggaaaugaggaaaugaccuuguccaaagucauugaacuaauuaacugcagagcuggugcuggccaugucuguguucuuuccaguguacuacguggccgaagaaaugcuucugcuaguggcucucccaguuaggaaacuggccuguaauccuagcacuuugggaggccaaggcggguggaucacuuaaggucaggaguucgagaccagccuggccaacauggugaaacccugucucuacuaaaaauacacgaaaauagucgggagcaguggcgcaugcuuguaaucccagcuauucaggaggcugaggcacaagaauggcuugaaccugggagguggagauugcagugagccuauaucaugccacugcacuccagccugggcgacagagcgaggcucugccucaaaaaaaaaaaaaaaaagaaaagaaaaagaaacuguccucagcuuuaaagugggcacauggauauguacuacuagaaaacauaauuuccucauugagcaacuuacacuuuuacaccuuuuacaccucugugccuuuacaugugcauuucuguuugagaauauccacccagcgaacuccugcugauccuuugacacucugggaaaccuuuccugaaccucagcaaauccgagguccagaccccuccucugcauucuuugggagucugggcuuacacucacaucugcauuggccucggaguucucggcucuucuguguuggacaugagggcaggcucugggccuugcuugaacauagaaggcagauuugcucacaucucuuccuagagugagcuaguuucuuugcugugguuaccugagucacuacuauaaauaucucaucuucacuacuggccauauucagcaagucccaaagcccuuaaauaaugggguacguucuuuuacccccugcccuuucaguuaaacccuacccugagggaagguaucaaggagagauguuagaaaauggcagaaaucuguguaacuucauaaaauugcugcuccuaguagccauaguaccagccucaauuuauuuaguuuuacuguguuaggcacugugccaagauuuuauacuuguuauauuauuuaauccuuauagcagcucugaggucaguuuuuuaucauauguucagaugaaaacauggucucaaagagguugaguaaacugcucagagucgcacagaaaguggauuucaacugggucugucugagucuaaggcccaugugacucugugcacaugguccccugcccuccuuccuuaaccuuguucauagauuuaaccagaagugaggaagcuugguguuacaucuccuuccccacccugccccacuaccaccacaaaugguauuacauuuaguuuugauucuuacuguucuuguccauagaacaccuguuauugacagucaggauuccuugacauagagauauaggaggguacugaaaauuuuuuuaaucucuaaaaauaccugaacuacaauauaccaaaauauucucacauucccggaaccuuaguaguugccucucagaaaauuguuuuccuuuccauguucucgucuuguuacugguagauuuguacucagcacugcgcuauugauuuucacuugcaaaagcaaggaaaucugaucaugggacuuugaaaugaugugguuuaguuuugucaucaggucacauuccacuugauuuggaaugugcuuuuguguguguguguguguguguguguguguguguggagauggagucuugcucugucgcccaggcuggagugcaguggcgccaucucagcucacugcaaccuccaccuccuggguucaggcgauucuccugccucagccuccugaguagcugggacuacagucucccaccaccucgcccagcuaauuuuuguaguagagaugggguuucgccauguuggccaggcugaucaugaauuccugaccucaagugauccaccugccucagccucccaaagugcugggauuacaggcgugagccacugugcccggccuuggaaugugcuuuuaaaaaaaugauaaaauuuugcuuuaaaaugcuaaaaaagcauuagucaaaaauuagaauauuucuauuauuauccaaacauauaagacauguuuuugcagggugaaaauaaagggguuguuugccauagaagaggauauacaucauuguaaagguugagucaguaauuuauuugauuuaaaucugaaucaagaauuuauuuuaaccuucucugaauggucaucauauaaaauguguuagcauuugugccugucucacuguauuaauuuucuuuucucaauaggcuggauuugguuaugguuugccaauuucccgucuguaugcuagauauuuucaaggagaucugaaacuguauuccauggaaggaguggguacugaugcugucauuuauuugaagguacugcguuuuauuuguuaguaugaggcaucuuugcuuuuuaaagcuguaaguucuaaucgcugauugagaacagcacuguaucaucucuuagauucaucucagauuuacuucauuuucccaugaaaaccauguuaugccucacgcuugauucuaugcucagauaaagcaaaauaugaaacguggagguauagaaauuaaaauacugauuuuggccgggcgugguggcacaugccuguaaucucaggacuuugggaggcugagguggguggaucaccugaggucaggaguucgagaccagccuggccaacauggugaaaccccaugucuacuaaaaguacaaaaaauuagcugaugugguggugcacgccuguagucccagcuacucaggaggcugaggcaggagagucauuugaacccgggaggcagagguugcagugagccaagauggugccacugcacuccagccugggcgacagaaugagacuccaucucaaaagagaaaaaaaaaaauuaaaauacugauuuuuaaaaccauaauuuuaaauugugacuuaaaaaacuacaugccuauugaaaggucugaucuaaaagaaggcagauuuucauaaacugaaguauuuuggucuuuuguuuuaaaaacucacuggcuuucccaaagcuacaagaauucaguaaucauaauaugguuauguaaaagauucauuuaauaacaaacuucucuguaacacaguuuuucuuauucauuggugaucauugggcuuuuauuucuaaacucuagaauauuuguaacauuuuuuugaauagguaauauaggcacauaauaaaaauuuaaaagcuacaaaaggaaaaaugaagucucuccucccacuggcccuaaaccgccaguucuguucagcgaagaucaccaccggucucagcgucuuauggauccuccuagaguugauucuacauuuauaaauaugggaaaaauagaauuuuucccacauaaaugaaauuucagcaccuucuuauuuuuuuuacuuugcaaucugucuuagagaucuuuccagauccauuuauguagaacuggcucauucuuuuaaacaguggcauaacaugccacugugggucaagcaucccuaacccaagaaucugcaauccaaaaugguugaaaaucuggaacuuuuugagcgccaacgugaugcuugcucaaaggucaagcuuaaaggaaaugcuuauuggagcaccccagauuucagauuuucagauuagggaugcuuaacagguaagcacaaugcaaauauuccaaaaucggaaaaaaucagaacuacuucuggucccaagcauuucuuucuuucuuuucuuuuuuuuuguuucuuucuuuuucuuuuuuuuuuuuuuugagauagagucucacucugucacccaggcuggagugcaguacugccaucucggcucacugcaaccucugccuccuggguucaagccaugcuccugccucagccuccugaguagcugggauuacaggugugagccaccacacccggcuaauuuuuuguauuuuuaguagagacaggguuucaccauguuggccaggcuggucucgaacuccugaccucaggugauccaccugccucagccucccaaagugcugggauuacaggugugagccacugugcccggccuguucccaggcauuucaaagggauacucaaccuauguaugugauaccagaauuuaaccaguuacugggaguauuuaucuuagaugcccaugcaucuaaguaaugcgauauuuaauauacuugaugguguguguuuauaaaccugggaugcaugagacuguaucucuuccugggcccuuugugagaccagucaccagguauagucaaaacaguugagcaucucaaagcaguaugagcugaauuaaaauauguuuuguucuggucauguguauuucaguucugauuuugaaugagcaaauguuuucauuccuuuaaaaaagcuuuaauguuuuccuggccagucuaaguaaacuacuaagguguaauuuuaauaucauuuugaaaauauguauuaagguuucugauguuuuaaauaauaaaauuuggguuacuauuucacuugagaaaaaugacacugucgaccuuugguguauauuuuuguuucuccaauaggcucuuucaagugagucauuugagagacuuccaguuuuuaauaaguccgcauggcgccauuacaagaccacgccugaagccgaugauuggagcaaucccagcagugaacccagggaugcuucaaaauacaaagcaaaacaguaauauaccaccuugauuuccauuacaaaguaucugauuugucugaauaaaggugucccacucacuguuccaggaauucuugcaguguagagguauucacaacagcaagcagggauuuggccugccaucaauuuuauuuaaaaagcaauuaaguuugcaguuuguccucauaaacguuguagguugaaacugaaaaauaaguuaaaaugaucaaucaagauaaaaggugaucuauccauccaauggaauauuauuuggccuuaaaaaggaaggacauucugauaugugcugcaacaugggugaaucuugaagucauuaugcuaagugaaauaaaccagacauaaaaggacaaauacuaugauuccacuuaugugaaguaccuagaguagucaaaugcagagacacaaaguggaagggagguugccaggggcuagcgacgaagauggaauggggaggcauuguuucauggguacaaaguuucagguggaaagaugaaaaacuucuggagauggaugguggugaugcuugcacaacagcgugaauguacucaaugccacugaacuguacauguagcaaugguuaagaugguaaguucugggcugggugugguggcucacgccuguaaucccaacacuuugggaggcugaggcuggaugaucucuugaagccaggaguucaagaccagccuaggcaacauagugagaccucugucucagcaaaaaauuuaaaaagguaaaauuagccgugugugguggugugggucuguaguccuagcuacucaggaagcugaggcgggaggaucacuugagcccaggacuuccaggcuguagugagcuaugauucgcaccacugcacaccagccugggggacagaauaagaccgugucucaaauaagaaaaaggugguaaguucuauguuauguauagcuuaucacaauaaaaaauguuaacauuauaaaggaaaaguuaucaaucacagaacaaguuucacuguuuuaugguaauaaggaaaauaaucuguaguuuucuucugacuauguacccuuaagcuucaacucuacuagcaacagugggguucugcuucauuuaacuuaaaauaauccuguauuaacaaaaaagcaguauaugugcauuauaaaaaauaagaaaacauuggcugggcgcaguggcucacgccaguaaccccagcacuuugagaggccgagguggguggaucacuugaagucaggaguuggagaccagccaggccaauauggugaaacucugucucuacuaaaaauacaaaaauuagccgggugugguggcacacgccuguaauuccagcuacuugagaggcugaagcaggagaauugcuugaacccaggagacagagguugcagugagccaagauaguaccacugcacuccagccugggcgauagagcuagacuccaucucaaaaaaaaaaaaaaaaaagaagaagaagaagaagaagaaagaaaacauaaguaagccaaaaaagaaggagaaaccucuguguucccaaaacccagagauugccacugcuauagcuucguguauauucuuccagauauuuugccauuuguguauauauguauuuuuuuugcaaaugagauuacacuauucauacuauuuuacaaccugcuuuuguuucauuuaaccaucccaucuuuccaugucaaugaucauucacugcaaccucugccuccuggcuucaagugauucucauuccucagccaccugaguagcugggauuacaggcgugggccaccaugccuggcuaauuuuuauauuuuuaguagagacaggguuuugccauguuguccaugcuggucaaaaaaaaaaaaaagaaagaaaagaaggaaggaaaggaaggaaaagaaggaaggaaaggaaggaaaagaaggaaaggaagaaaggaaggaaggaaagggagggggaaggggaagggaggggaggggagggaagggaaggaaaggaaaggaaagagcuaauggagcauuuuuugcuagaauauccauaaacacuguugcagaauuacacugagacccaugacaucucauugacccaccauuagugauguuaugauugagcauaguuuaggugauggcugucugaucccucugaguuauaguuauuuuucccuuuuucacuagaaaauaaucugugugguguuauuuuggcacuaugcaaauguauacuuacccaucagcuguucaccuaaugguuuuuaccccaauugaucauuucggccuguguuaaaauuaacacaguaauuuuauuuggguuuauaaaagaauguuuuuuuuuuaaaucauuccuuugucaauuauucuccuauaaaguaaagcucuuccucaucaaauaaggccauuuagguauuuugaaguacaguuccucugguaacuguuuaacuccuuccuuuuaaauuuaaagggacaauuaaauucccuucaaguuaccaauuuuccagguaagaaauauguuaaaagccaccuuaaaugguuaacaaaugaguuuauggcuuugucuuuuuuaguguuauaguagauuuuguuacuuugauauguuuuaauuggcacuuauuuuauugaagcauaacauauaguaauaguaaagugcacacaucuuaaguuuacagcuuuuuuuuuuacaucuauauuuccucuacccacaaagacuccuuucuagucaaacaguugucccucccuccuccaccauauaauugcuuuucuaacucuaucaccauagguucucuucuugaauuuacaaggaacacauagucuauacucuuuuugugucuggcuuuaugugagauucauccauguuauugcauguaacagucauuuuccuuuuugaugcuugaauugacauaccuuuggccaaugagagcuauuuccagcuggauccuuaguguucuauugccaaaacucauuaaucuuugaaagcuuuucuugcccaagaugauauccuagauucaucuuauaccuucugugccuguguccuagaaucaacuguuucccucaaggagucuuguuucuuuucuuuucuuuuuuuuuuuuuuuuuugagacagagucucacucugucacccagguuggagugcaguggcgcaaucucagcucacugcagcucuaccuccuggguucaagcgauucucaugucucagccucccaaguagcugggacuacaggcaugagccaccacgccuggcuauuuuuuuuuuuuuuuuuuuuuuguauuuuuaguagaguugggguuucgccauguuggccaggcuggucucgaacuccugaccucaggugaucugccugccuuggccucccaaagugcugggauuacaggcauaagccacugcacccagcccuguuucuuuuuaaucaguauuagagaugcuaaucugauaauuggggaugcuuguuauaccuuuuuuaggcccuuuuccuugacagacagagcuauaaaauauagcuauauuuaaaauauauuuuaaaucauaaguucauauugauauuuuauucuauuuuaacauuguaauguuucuccccaauauauuuuaauuguauauauuucuuauuauccugaaaaccuugauuuuuaacaucuuuaacacaaugcaacagaaagauauuuguacacaaauacaguuuauauagcuuugcaguauuguaccauuuaguagcguuggucuucucugacaaguguuauaaaugauauccauauggauguuuauuuuuuucuauggaagugucaugguggacugcuacgcaauauugcuggacuggccacucaucucaaaugaugaaguuuagagaaguuugguuuguggaaacaaacauacuuacucucaccauucccagccaaguuuaagcuaaaucagcuugaaauaccuggaucauaucaauuucuguugauuccauuuucagucuguauguaagucaaauagaauguugagcaucgaugugaccaguugauucaaacugcucaaacuauugcucugauauguggaguaauuugaguagugcagaagccaucuuuagaaaaagguuugguuguaaaaagguggcuuuaauugaauauuauuuuaaaggcaauuuuuaaacuaagguuuaaacuaagguuuaaauuuuaaacugaagguuguaugcugauuauuagucuuaacuucuaauauauuauuaggugaacaaauuuaagcagaaagcaguucuuaaaauuuuaaaaugcuuagccugacaguuaaaauuguuaaacuauacaaauaaucgguagagauuuggggaaagacuuuaguaaguaugguaaauucacuagguauuuauacaugagagguucuaagaaaauuuauuuucaaaacaguuucuaagugagaguuuuauugagauuaauucacacaacauaaaauucacccuuuacaaauauauaauucuggccgggcacaguagcucacgccuguaaucccagcacuuugggaggccauggcggguggaucacuugaggucagaaguucaagaccagccuggacaacauggcaaaaccccgucucuauuaaaaauacaaaaauuagccgggcggugguggcgggugccuguaaucccagcuacuugggaggcugaggcacgagacaaacccaggaggcauaggcagcagugagccaagaucacgccacugcacuccagccugggcgacagagcgagacuccaucucaauaauaaauaaauaaauaaaaguauacaauuccauauuuuuuaguauauucacagaguugugcagcccuucccacuaacuuuagcauauuuucaucaccccaaaaagaaaccucauaguuuuuagcagucacucuauauuucuaaccagaguuuucacugacaguaaagaaccguuuuaaaguauauauaaguaauuaaauggucauucuauuucuguaguaauuguagaaaauaauucugagauauggcaaggguuuuugaauuaucacuauaaugaaauacucuaaaaguccuggucaaaacagaggagguuguacucacaaacucacuauggauauucucauuauuuucuuuguagagacaagaucaagacuaauagaacuuucuagaggacugaaugcugugguccucucugugaagaaagauugccuucugcaagucaaacagagagaacugcuuucucccaccugcucugagcguggcaucacaguuauuccuagugcuuaaauguguauuuucucucuaccaccuggacuuucccaaagaguuuuuccuguagcuacuccagaucuuccacuaaaguaguaacuuuuuaaugacaucuugcuguggugugauugaugccugucaccgaagagcacagagccuccuuacagcucuugugcccucguacucuccaucuuguuaucauagcaucugaugucuucaguccuuccaggauucugugcgccuuucccauuccagauacagcagaucguacuguugcuccuugugaccaaauaccauauuugucccaaaccuccaccuagggcccugggacccugaaaguggaagacaucagguggccaugcccugaugauuuagucccagagcccuccgucucucccgugccucccuccgccacucuaugauuuagacuuuugccuucuuccaucugaucggauucucauugugagauguggugacuuucauguuagaucuucuucauugaugccuugguuuuauuuuaaaauucauuuguauaugucuguugauuaaagcauucgaaauguuaucuuagaauuuuucacccaacugcuugguuucaaagaucuuaagugaaaaacugccuccuggucaauaccaaauuuguacagagugugaaguggaguuuuuaugcuucugucaaacuuccauccaucuaauacuguaccugugucauauuuuauuccuuuguagucuucuaaggaauuggaaguuucuguaugaugcgcuuuacuaguuguaaaauagacuaucagagggaaaaggccucucuaguuuauuuuugaaaaaugcuccaggucuuaauaauuuucauuuucauucaucuuaguuuuagaauugucaccucagucugauuuucacaauccuuuuugcuaaaaguuggaagugggaauuagcagacgauuugggauaaggaaagaggaaugauguuauauuuacccuuaggaauagaagugaccgaagaauccggauugaaaccagcauccuauauacagcuccacaggaugugcuucucuucaugguaauuuuccauauauaucaucuacuuugauuucugccccguuuuaauguccauauaaauguuucaguccaauuuguaaguguugaguccacugauguagaaguucugacuuguaaaccauucauccugcuuuagucauaugauaguaccgaugcaauuagcuccucucccaccaccgugggggauuucucccugagaugaggugugcuuugaccagcugcauguggcuugauugcauuccuguuucucuuaguuccacuggaucuuguuuucuuuuauuucguuauauuaccugagcucaggguaguuccguucaucuuuagaaagagcucaucucuuccauccuuagaaggaucucaucagagaacucauauguaaucaaucagguaaaagaaauacugauguacuucugagagacuggugagaggugggucauaggaagcccauaggucugaggaccgagucagugucuuggggauggggcuguuccauaugauuauuuuuguguggcauaaaagauguaaaaaaaaaaaaaaaugguccuuuacaugcaaagacccuagcuuccuuuuuuuuuuuuuuuuuuuuuuuuuuuuuuuuuuuuuugagacacaguuucacucuguccccuaggcuggagugcaguggcaccaucucggcucacugcaaccuccgccucccagguucaagcaauucuugugccucagccucccgaauagcugggauuacaggcaugcaccaccacgcccagcuaguuuuuguauuuuuuuguagagacgggguuucaccauguuggccaggcuggucucgaacuccugaccucaagugaccuacccaccucagccucccauagugcugggauuacagguucgagccacugcgcccagccgacccuagcuuccuuauaaacaugagauaauaucuuccuaggccucaauuuccaacgauacuccuuuaugcuuucaagugugauacacuguaggagagaggaggcagcaguuuagggggugcugccuacugccugacucugacagcguuucucuuguuugaggaaggcccaucgaucaccacauccucacaagcaguaccauguaaggggccgaauauggauaauaugguguagaaaaaucucaucacauucuucccuuuacaaguguuuuucaaaaguaaagauugauuucagugucuucaugacuuaaucgguaguucuuuacuagcacgcuuuuuggcuuacucacauccaucugaccccaguacaaccuugcuucuccugucuuuguuuucuucauuaagaauuuaucuuuaacccuaaagcaacugcaagaagaguuucaggaacaucuguguucuucuggcuuacuagccucuuuacccaaguauucauuuauccuguuugucaacuguacaugauucuuuuaauuuaggcagagaaucuggcuguuuacuggguuugccuauaagcaaauggucagauuucccccauauagguuguaacacaaauagacauggacccuuuuucagcuaaauucuuucccauuccucuguacugcucuuucauuuacucuauuuuauuuuaaguggggacugugucuauuuaaaauagugccugacacauaguaggugcuuaauaaacaauguuaauaaauaauauuaaaauaaugaauaauauucauaaauaguaggugaaucaaagauagaaaacugucagacauuuuccuugggugguagggcaacaucuuucuaaguucuuaaaccauccuugucucuaaauuaaaaauauggaaguucaagucaggagcugugaaagugcugaauuuccuuuuuauagugcuaagagaugacuuuaaaauguagagaaaugcaaggaaguggagggauagauccgcaggagccaucucuuccuuuuuuugucucugaauaucugauuuuggcuccugaauacagaauucuuuccauccaaacagugugacauaguuuuacagccuuguguauagauuccaaagaccuuuugcauacagcaugccauuugauccuuacaaugccaugagcuggacuacacagguauaucgguuuuuuguaugaaucccaaagcaauuaaggaguuugccaagguggcaugguaagucaauggaagggccaaagcaagcacuugggugcuuggaacaguacgccaggugauuuguauuaucucuuuugaggaauuucuucaguauacuauuccucaaaggguaagcucuaaaccccaaauuaucuguagagcaaguuaauuccguucaggagaggguuucuuuuguguguuuccauuuuggcauaguuagaggagauaaucagauggauuuggcagcuuuuaccaaaaaugacaggcaacuuaaaguggauagcuguagguaauuacuagaguuauuuagacuuaauucugugucugaaugaauucagugcuuacugccagcccuuucauacaaagacuccacauuugagagcugauguuuuuaucuuuuuugcagacuggauuacagcuucgguuggguuuucuugcauauuuacaaauguauuccuguugcuguuacuuacgaacaauaacuuggcuggcuaucggauucuuggaucacagccuuuuuccuugaauucucuggagacaggauguuauugcuacuuuaugguuguccauaucugguggugcugacaggucugaguccugauggauuuuucuuccccuuuuguagaugaccugauuguuugcccuggauacuugaauucuuuguuuauccuugaaauuuaguaacuucguuggaguauaucucaggauugacuguugucuguugccuuuuucuggaaugcagugagcauuagauauggucauuucaagccucacugcguuuuguaucaguuuagucuguucucuucuugaaaacuucauuuuuauauuggcucucugucaucuguccuucacaguuaucuuuccuuagauggcacucaucucaucuuucuucauucaugcuguaugauuuuuuucucaagucuuauccuccauuucacugacugacucaguuuucuguacuguugauucuagggcuuguuccuuguaauguggcuuccacuucuguuacaguuuuauuuauuuuauuuuauuuuauuuuauuuuuuucaagauagugucucacucugucacccaggcuggagugcaguggugugaucucugcucacugcaaccuccgccucccggguucaagcaauucuucugccucagccuccuaaguagcugggacuacaggcuuaugccaccaugccuggcuaauuuuuguauuuuaguagagacaggguuucaccauguugcccaggcuggucucaaacucccgaccucaagugauccaccagucucagccucccaaaguucuuggauuauaggugugagccaccgcgcccagccuaguuucauuuuuuaucucuuucuuuccugagcucauuauguuguccucuuugauugcguauuucuuccagugcugaacaauuuugucuacaguuuuagugguuuaugagcucauucuuuuucuagaguguauuuaucuauccuuugcaucuuucauuccuuuucuuguauuguuuugcuuuuaucuugaugcacaaguaucaugaugaccccuucugcuuauuauuuaucuuugcaugguaccaguuuuaccuguccaagaagaguguggguaaauccuccuugacuccuucucuuuugagcgagacauguuugaaggauaaccuuagcacuugaacccuaaggcuagcucuugauggguuguagugguggaggguguuuuugguuuucauucuguuuggauuugggggaauaaggagugacacgaagccuccuuggaacauguugucugugagugccuuccauagacacuguugaauccucugcccuggggguggccgggucccauugggagacagauccucuuugcauuuccccauucccacuagucgucauccuagcaggaacaugguggguuuguacuucugcccuccuggauuccauguagcccacauuugugagaucggcuccagaguugguuucucuccucugguccugcuucucgccgcucuuccucuuuuggauaccggaggggaugaacacacaugguucaucugagaucucaaccgccuguccucguuuuucuggaaacaugcacgcgcagagugugcccagcuucucccgacuguugccaguccuguuuugccaaguuaacaaaugaucaguagagucuugggaaucuucucauuaacugcccagcaguuguggcugcuggagacucggagaaaugccuggcaaaugcaagaacucuucuucgauucauccccaacuugguuguaucugucagacauugcccuggaguccgugguauggaguuguagcuuuuacuaguuucauuauagacagcuuguuguucaacuuuuggaugugugggucagagggcaggagcacuuauauaaacaugcauuuauucugccaucuuuucagcaguccagaugcuuaaacauugacuuugaagcuaauguccuucauaaucuacauuugagcaaacagaaggaagcaauauugccagcaagaaaggacgauuaacuuaaucaauacgggauuuuuguuuacuguucuguguggaaagauaacuuuuaagucaaguuccugucucauugauuagagauaucaguaccuucugguuugaaaauagaggacauaugacauuuuaaugaacuuaaguuaucagccauugacaauuauuaguuagcugauuaaauaugauagaauacuccaaacuagcacaucaccagaguuaccaagagacgccuaagcucuucuuuaugaacagguuguugguggagcugugccacugaggggguuaacaucucugacaccuuaacugugccacagguuuucuuaccugucuuuucaaucaacccauuuuaaaauuuaguucaucaagaaagagaaagguguuaagucuucaucaggauuccuuuugguuucucaugaauacauauucacaugguuuggagaccuggagcccaccaccaaagcacacugaguuaauguuuugaaagugcauuuguagguagauccuggggcugggguuuuauuuggccuguuuguagaauugaagccucuuugccucaguggucagcacaucccaccagacauccggcagcaagcuuucgucaccuucagagcucuagcauaaugauaaaggagcacuagugacagccuugcuguaugcaccaagcuccacccugggcagugccuuucccuaaugucuguccuggugugaaauggagacuugaagaccgguacccacauguaagagagguuaacgaagggaggguggcagagagaggagucaugugaaggaaagcuaccuuuaguccuccaucgcaauacuguccagugucuccagcgugcuagaaacugugcugaaugcugggcacauggcaggggucaaagcagacagaaaucccugccucaugaacccacuuucuauuaggggagacagacuagaaacacaaaaaggacauugaauaguacgauugagagaugagugcuauggagaaaaauccagccagaaagggagaugcagaagauagcaccagaucuucucaauguuguuuucaucauggacaggugcguuccuuagaagaugaaguguuagugauuccugaguuuuucucaccuucacgucgauugaucugaauuuggagagucuguuuucugugucuggcucugcacucaacuuuguaggggacccugucgagguccccacacuguggcuucagguagacagagcagaugggagcccauuucaguucauugucuugcugaccaauggggaacuguggucaggugagaggaggcagcuuuuacaaucagacuucauugaauagugugggcugcuguuuccuuguaacaaaaccccauaaugauggcaguuuccggaugugucuuuuuaggacuucagaacuuauuauuugaauagaaguuuaaagcaucuggaugaugaugcuguagcuaaaacagcugcuugucagaagagacccuauuuaacacuucuaaacuuguuucagagguggaggaaaggauaaucugggaaggccucccucucaaguccacagguugguaucagcuguguucaucccccaaaaggaaaauaaaaugacaacaauauuuuggucacagaauuccugagaaaccucuguuucuaucuucaugucuuuaagauagggacaugaauuccccaugaucugggugauaggguuaggguggccaggacacuguuacuuugugugugacacagguggcuccucaugacaguuccuccaugccuuagaacauguugucugucuggucaucccuggggguagagcugagugacccagcagugggagauuuaacaacuggagaagaagaugggauguguuuaauuauccccagagguagggccaauuugucacccuuuaaauagacuuauuugcauauaaacuaaagcaccuuagggcaucauuaccgaaagugucuaagcaaaugucugauauaguuacgugccugcauuaaaagaaagcagcccccuuaucuugccuuaauauccuuacaguguuuuaauaaguucauaaugcauccuguaugugcauuuuuugguauaaaacaccgaaagguggagaauugacuucaguucucuccauccuuuccccuuaaguguugguggcgcugcaggggcaacgugccucccauuggaaguggugacuuccucuuugauagagguuugccugucucuugaaaaugaaaagaagcggagauugaucucuggagucccaugguccaguuuggacuauugggaauauuuuuuaugggauguuaaaaacaauauuagagacgugagauaguaaauuugugguaauaccggauccaggaagcuuacagugaagaguaugaacuuaaccugaaaaguauuucucuguucuauaaaucucucagugacauuuggauuaaucaagcauaauuaaauguaguuagauuuuugucagauuguaguucaaaauaauauucaucuauggagaggguaauauauuauguagaaauuuuauuaagcacuuuaguuaagcaaacacuaaggagaacaaaaucaaccucaggaagguuaauuacuaaaaaaaucacaaaguauaguagauuauguaaaucauuuuaauuuugaauaccauggcuugagcuuuaauuuacauagagacguauuuuggauuuguuuuucacauuauauuuucuaguacaggauugcaauugcauucuugaaaaguucuacucauuuuaggauuccauuaaguuugcuuaacuuuuuucauguuauaauuuccaaaagcaaagaauuacaauuguauucuagcuaauuauuuuaauguuucacuaacuuuguguguauuguaagaccauauuuuuauuucuauacaaaugaugauuuuaagagaaguaucaggagagagaauguauaugaaagcaucgcguccacgccuggcuuugcaauaaguguucauuuaaaagaaagacauuuacaaagguaaaacauaagaguuuagacuauagcgauaaaucuuuuuauuuuaguaauuucuuuaaagggaaaaguaaagagaucaaaaugauuuuauauguauuuuuuuuguacucagagaauuacauuuucacuacccccgccugucucagggaauagccuuugauaagaaucccauggagaucucuggaacucuauuacaguguguucagauuuguuaguucauauguaaauuucagagcuagagcuucaaaacuagaguauuguaaucucaggaacauaagauuauccaagaagccugaaccuugcucuuuucaugauaaaugacauccaaauuuccuuugucuaggagauaagcauagaucccuuuuaucaugcuucucugagauuuucacagaacaacccugcaauuugauuuuguuugauaauuuugcuuuuuggcuuuucagugaggacucuauuuuccauuggaacugacuccuuuggggauaauaagcuuucacuuaaaagaacauuccauuagauaguucuaacuucaaugaaccuaaaaguggcuucuuaauuugaauaaucuggauaacuuuugcaaaugggucaaaacagcacaaguaucaacaaucacguauguacugaguaauauuugcccuccaguuagcaaagucaagaaaugucuaacucuggcacacagcacugguuuuaacuacucuuuaguucaucuuugccuuccaaauugguugaaaauggcaagcuuagaauggaaugcauauuaauaacagaaccacuuaauguuuuaaaauauucauaccuugagauucuuuuugagagaaaaaagaaaucuuaacauccaauucuaguuguuuuggcuuuucacauaugcuagacaugaaaaaggcaguuacaaaagugaaauccgauuggaagucagugguguccgccauugagccgugcuaaaugucgugucacaaaaggaguuugugaaaacaggaugaguagaaaauguuauacuguuguuucuaucguggcaccgcuuucuuauaaauuccauuugcuuuuugucaucugaacuguuacaaccaugggaaaccucaguccauauuuuuaaaagcacuauauacuuacaggaaaaaccgacuuaugccuucauugaaaaaauguugaaguuaauaucccaaauguuuaaugagcauguuuuagaauauuuacagcuaaagucugucacuuuagggauuugacaaaacuugagacugccugccaccgaagagggaccaggcagaaucuucucagccuuguaaccagcguuaaaaaaauauaaggggcuugaugagauccuagaucugcuccuuuucuccuaggugccuggguaacuccuggggaaagcaucauauuaaguccuuuucaagcaaggugugugauuuugaccaaugaauugagcugauaugugauuuugaccaaugaauugugcaucuauuuaaaaauuaccaaguguaucuugacucuugaguggacagucaaggcaaaguuuacuuaggaaauguaaaguauggaguguuuuaaaaaauucaaauugaguuuauucacuguuggaggaauugaauucuauugccucccucauuuccauuauguucauuguuacaauugugcugcucuguucucauugugaugcuuaguucucguguagaacugagugcuacauugugauuagaaacuggaguugugcuugagucaguccuggaaaacaggacccauuuuuaagaagaacggaacauaccacuuuggcauucuggcugacccuaauuucugcagaguuccuugguguuaaaaucauuugaggucauaguugcugcuuaugguuuauauacacaccaucugcugcucuaaguucacauccucucaaaagcaugcaagugcuugaaauuuaaauauuucccagaucuaaaacaacuugugacuaccuaagaaaugcuugaaccaaauaagaaacagcacuguggaauaaaauauaccauugugaacauaucugaugcugcaaugaaauguaaaguuccuuacuuugcugauuuuucaucauaacuccuugacucauaaaagcggugucuaaacugggaacagcugcuaauaggguaaaaguauuauacaucaaauaaaaguucauuacaauauuuguacucauaagucaaaaucugaccugguucgcuuugugccucugucagccuacuuacagugauaaauguacacacaaguccaguguugccaaggagcuuuguuuauagaaagaagcuugguccccucaguucuaugcuguuguguggccugguugguacaugccgucaugaugaaggaugacuuugguuugagauaauuugucacuccacauuccauggagaaaaguguuucauuuugauguuggaaaaacaugaccagagaagcaugugacucagauaauguuccccggaaguugcagagcaaucuguggugucugucauagcccaacuaguccuggagcacauggacaauucuguaccccaauaaucagaacaauaaaaugguaguugugauuca

SEQ ID NO: 192838 - RNA, 66532 nt, Homo sapiens
ggcccagugcuccagagaaaggccggccugcagcacccgccaccgucgccggccgcccgcacguccguccggugagucccgggugccgccgcggccgcggggccuagugcgcgcacagcggccuggucucggccuggucggcggcccgcaaggcgcccucccgcgcuaggccgggcggcguggcgcgcggcgccgagcaggccccgaggaggccgcaguuaggcccggggaggagcccggcugccccgagcggcggcggaggcgcgcuccguaagcgggcggggguugggggagggucgcccgguugugccggaggcggucgaggggccccgggucggcuccgcggccgaccuggggcaccgcgccggggugaggccuggcgaggaggcgaaggcugcaggcgugaggugaaggccgcaggccggccgggccgauuuucgcuauguaaauaucggugagggggggggagggacgggggacaagauggcggcggcucggcgccugcugcaggggacgauagaggggguugccgggagggggagccgccaucuuggaggcggugucuggagagaaaauuccgcuacagcccgugagggggggugggagagcgggcggcggcggcagcggcgccggugacgggccccggaggcccggcgcggcggcgugugcgcgcggaggggcgugcucgcuccccguggcggccauugcccuugccgccaugaugagcgcucgggcuccaggcgcucggcggcagcgccaccuuccugccuugccucccgcagccccgugacuggcugcaguuuccgcugcguuucagcugagcugccgcaggcggccaccgccgccgcccggacgccgggaccguuucacccucagcgccccuggcccugcgccuucccccgcgccuguagccacccgagggcagucggggcagguggcauuccggacaccugggcuuaccagggcauacgggaccccaggaaauguuauuuuugcuuaagucaaaucauauguggcugcuaaggugcuuucgaugcaguuguuuuuccaacaaucuuugccgccccgaguaucugaauaaaggaagaaaaauaaagauugaugggaaaguuuuugccauucuuuuguccuauagggaaaaaaauugcacaacacgagagcggaggaauaaaauuuugaaucauucguacucauuuauguggaaacaacuuucuugaaaaacgauuuaaguagugaucuguuggugguauuuuuuuaaaucgaggaauaagggcagacuuuuuuauuuucuuauuggaggacaacuuaguguggugcauauuuauugugcauuugccugucaugguauuucgauuuuucauuugugaaguuuuaaggcggaguuucauccccuaacguacuuuuuugauugcacacugugcaacuuucuugauaaacucggagccuacuguuagcgaugcaccgugcuagaugcuaagaaacauuaaaaagguucuuguaaugcagacgguggcugcaagaagucucauguuuagagguagguggggcaaggugaaaugcaguaaagugagagguacaacuaauuacugggauuuccgagggaagcaagguugccauuggaggaucagggagggacggguuccugaaguauuaauagguggcauuuugagaagguuaccgagggauggguaggacuuuguuagguagagguggagguggagaaaggacguuucaagggugaagcuucuucaguaaacaguaaguauuuacaguuuggcaaaaguggaugguauagguaggggaguggugggaauucaggcuagaaaaguuagauugcagaagggcuugcuugccagguggaggggcuuauacucaaugggguaggcagcgggggugcccucaacuagaagagugauggcacaccugagcugcaccuuguuauuuacuuauuuuuuauuuugagacagguucuugcuauauugccccaggcuggucucgaacuccugggcucaagccguucucccgccucccacugcccgccugucacugccgucuguucccugagcugugcuuuacgguacuuaguaguuccauuggacuaggaaaaguuucaaaguugaaaaauaaugagaguaguaaguugaucaguguuuucauuaucagaacgauuacaagaauguucagaaguuaagcaaauuuugcuacuuuuggaacgaugcgucucuauuaagacagcugcuccuuuuuucuauccugauuucucauccgaaauaaucuuuugcucagaguugucagaauuucuaugguacacaaauagggagggguuucuaacauuucauuuaccaugguugaaaaguacaggacuagugcuguggguuauuugacgaaaaugagaaaugaguauucccgugguaauuuuuuuuuuuuuuugagacugaaucucacucugucgcccaggcuggagugcaguggugugaucuuggcucauugcaaccucugccucccggguucaaguaauucuccugccucagccucccgaguagcugggacuacaggacccugccaccaugccugguuaauuuuuguauuuuuaguagagacaggguuucauguuggccaggcuggucucgaacuccugaccucaagugaucugccugccuugaccucccaaagugcugggauuacaggcaugaaccaccgugcccugccuguuuccuagaauuuuaugauggaaaccuuuagguggcauagauacccauuuucaguuuuuccauuuuucuagacuguaacaggucgugagcagcggugcuccaugaaagggcuggagggaaugagagucucauguuuauuauaaagggcuaugguuuagaaaaguucgagaaacagugcauugcaugaggcugacuagaagcaaguugagaaggcgggcugugguuguugagguguuaaggguaaacauaaacuuagaagaaccaggugcuuuuauauuuugacagcugggaaagacauagaagaacuauuaagaagauagaauuguuuugcugcgcaguacagcaacaguggauguucaagauuaagauuagagucaaguugugugauuaagacagguaaguguguaguuuaguuucaauuagaaaugguuaaauauaaaauuauuuuugccugaaaggguagaccuugaaacuuuggaaaacugacugguggaacaccuucgaacccaaccacccuggaugaauaagguguuaguuuuuaauuucuguguauuuuucagauagaugcagauuucuuuuuuuaaaaaaacaugcucacgaauguguuacaaauuuuuuuuuccacauugcuuuuuguaaaugcuuacucucauugcaaaugcuuacucucacuuaacccauuuagacugauucugucacugauaaucuucuuuguauuauuuguucuuguguacacuggcaauuccaaacuuuuuuucacucuuaaaacuacucaacggguccuugaaaucucucaucuucagcaaagauuacccagucuuucacuucacugagaaggguagauggccaucugauaaagagccaagucuccccucccuuccccuucaugccuuuccugucuucaccuaggccuuccuccuuuugccgcaggggagguugcaggagggauugcugucucacaagccccacugcugcucugagccugcucuucacccuggcugccuccuuagggaccaagcucugugcgugaugccgucucuugcaucauuaaccucucuuuacaaauauuccuagguuugcucaucuuacaaaagccucaccugucuucacuuucuuugcaccccacuuauucuuaaauccaguauuacccaaauugggaaacuugcacagcauguuaacagguguguuauauaaaagugcucuguguuucagaaacucucugugccuucucugucuucuauggugggauuccccuuaauuuaucauuuaauguauuauauuugaacuguguguuuauauuuuuuccuucuacacugugaauauagagacaaguucugauuuaucuuugucuccaagcaguaccuggcauauggaccauuaucucucaaagcaauaauuucgguuacuggguacagagaauucuacguaguuaauaguuuucagcuguucaaaaaucagguauccagucaguguguuuuuugacucagggacauacauauuaaggcacacuuauuagggcaccaggucaaggaguaaccccucccaccaccccuuaucugauuggaauauggccagccuauucuuauuccugccaaguuauuuuuccagacaacauuuuauaaaacccagguaucuuguaauuguauuuuacucaaaggaaguauacucuaaggaaauuguguggccuugagguacacagccauuaggcauuuaaaaaauauauuuaaaaaguuuuauggaauauuuuuaaauuacugaaaaucagaaucacccagauuuaagagaucuuaauauuuugcuacauauuugauucauaucuuuuuguuguuuaaagaaauaaaaucucacagauucaaagggucccuccccauccccuuccugucuucuuuucuccagaaguaaccaccugucccaauauguauguaccaaaacaauaucagguauugcuuguguguuuaacuuuacauaaacaguaucauaaccauaccuuauauauuauuuuuacuuaacaguguguuuuugagauuuauccauguaauguguuuaguccagcaguuuucaaagugugcugcagggauuccuggggaucccuaagauucuuucaggggguccaugaggucaaaacuauuuucauaauacuuuuuauuugcucuuuucacccacauuuuccuguacacuauaggaauacuguacagaggcugcaugacauaugaugucauaauagauagaaugcagaaacacuuacgggaauccagccgguuucuauuaagccagacaugaaagagauuugcaaaaauguaaaacagugccacuuguuuuacuauuuuuuuuuguuuagaaaaauaguuauuuuaaaauaaauaugcagccauaaaaaagaacgaggucgugucuuuugcggaaacauggauggagcuggaggcuauuauccuuagcaaacuaacgcaggaacagaaaaccaaauaccgaauauucucacauacaggugggagcuaacugaugaacacaaagaaggaaacgagacacugggggucuacuagagggugaagggagggaggagagagaggaucagaagagauaacuauuggguacugggcuuaaauaccugggugaugaaauaaucuguacaauaaacccccgugacagaaguuuacccaugugacaaaccugcacauguacucccgaaccuaaaauaagaguuuuaaaaaaaucucaacaaaagggaaaaaaggaauaaagaaaaaaaguauuuuuauggguuaauaagugcuuuuaaauaucucaguuuuaauuucuaguaugauaaacaucuauagauacgacccacguaaaaacucuuugugguucuuaauuuuuguuuuuuguuuuguuuuuuaaauuuuauugugauccuuaauuuuuaagagugcaaaggaguccugagaccacgaaguuugaaaacuacugauuccauucauuuuauuuguauuucaguguauaaauaaauauacugugguuuauuuaucuuuucuucuuggagggaccgauagaaacuguuugcaguuucugaauuucaaacacuacugcuaugaacauccuuauacaugguuugucuuucuugggauuauauacauauaguagaaguagaauugcuucauuuaagaagucugugcauuaucaacuuuacugggaauugccaaaauggcaaauugucuucuauuugacacucccgcuguguuugaucccguuucuccaaaucacugccaaaggauuagauuuugcaauuuuuucccaaucuguuggguauaaauggcaucuccuugcuauuuucauuuugcauuucuaagauuacuagugagguugaccuuuuuuccccauguauuuaucggccaucagaguuuucuauuaauugcuugugcauaccuuugguucauuuuucuguuggauuguugccuccuccuuauugguauauggguuuuauuuauuuauuuauuuauuugagauggagucuugcucuguugcccaggcuggagugcaguggcacguggucugggcucacuguagccucugccucccagguucaagcaauuguccugccucagccuccugaguagcugggauaacagacgccugccaccaugcccgguuaauuuuugugcuuuaaguagagacgggguuucaccauguuggccaggcuugucucgaacuccugaccucaagugaucggcccuccuuggccucugaaagugcugggauuacaggugugagccacuguggcuggcugguuuauggguuuuauauucuggauacuaauuugugauuauauacacugaaaauaucuuuuccuggucuguggcuuggcuuuuagcucuguuuguggaaaguuuuuuauguaggacuucauaauaugaugguagccaguucucaguuuuuuucauuuauggcuuguguuuucuuaugucuucaauacauucuucccuuaccccaagguuguaaugauacugugcuguuucauauuuaggucguuaauucaccggaguuuuuuguauauugugugacguaggaaucuaauaucuuuuucauguggauuuaucaaaugguucagcguuucuccccacugauuuauaaugcaacuccugagauauaucauauucccacauauguaucuguuuuuaguuucucucuuuugguuucauuggucuguuugccuaucucuauaucuauacuauccugauuuaauaauagccuuuuuuuuuuuggagacggaguuuugcucugucgcccaggcuggagugcaguggugcgaucucagcucacugcaagcuucaccuccugggcucacgccauucuccugccucagccucccgaguagcugggacuacaggcgcccgcaaccacgcccggcuaauuuuuuguauuuuuaguagagacgggguuucaccguguuagccaggauggucucgaucuccugaccucaugaucugcccaccucggccucucaaagugcugggauuacaggcgugagccacugugcccggccuuaauaauagcuuuauaauuaaaacugaguauaucuucuuuuccuucaggauuauuuuagcuguuuuccucccuuugcuuauuuugggguuaguuugucauuuucugugaaaacuguuggauuuuuauauuugccucaaauuuauagaauaaauacauagauucauguagauaaaugcuaauagagcugggauuugaauucuggguaugugcuacuacuuuucauaaagcucuugcacaacuuuuguuagauauuuuuguuagauacuguguaauuuuuguugucauugugaauaggauuuucuuuuaguuauaguugcuauuauugcugauguauaaggaucacuguugacuuauauguauugaucacguaaccuugcugaacucucaucauauuucauagauucugagguacacuuuuccccccuacaucuucacauaucugaagucaaaauagaucuuugauggugucccauaaucacuguugucuaggcagcagucaugauguaguuaucauugcuugcacaugcacaaacuuggucagggcucuucauuuugucaucacuuuaaaugaguaugugcauugcuguauuguuauuucaugccaaacaauaaaacuggaggcggaagaaauugcaaagugggugucugccuugaaagaaaaucccauaaauaauaauggaucauuuuaagaagugcugcaucaccaacacucuuauuggcagagcacaauauuguuagcaacaguugaacaguuuugaguggaagagcaauccauaguaggaccuugaaugugaaguuguaggaauaccuuaccaauuuauuuugcuucuuuuuuuucugucgcccaggcuggagugcaguggcacgaucucagcucacugcaaccuccgccucccggguucaagcaauucuccugccucagcgucccgaguagcugggacuacaggugcacgcugccacgcccagcuaauuuuuuguauuuuagucgagacagguuuucacuguguuucccaggcuguucucgaacuccugaacccaggcaaucugcccgccucggccucccaaagugcuaggauuacaggcaugagccacugugcccggccaauuucuuuugcuucuguauacacaagauaugauaaaagucugucuaaauaagucugaauugucuugauaaaucuagaaugaaaauccuagauaauaagaaaauacuguaucaguuuaauuggcaauguuuuuuucuuagucauguaaaauaaggguacagcuuacaauugguaucuucagagucagugaaauguaguaguaauaacaguucaugccggguguggugguucacgccuguaaccccagcacuuugggaggccgagacggguggacuuugucucaaacaaacaaacaaacaaaacaaaccaaaaacaaaaaaacacaguucauaauucuuuuguauauaguuuucaugucugugaauaauacaguuuuauuucuucuuuuccauuccuucuugccuccuguuucuuguucugguuuuacugcauugacuaauuccucuauugaaguguucaguagaagcauugauaaugggcauccuucucuaguuacuuuaauggagugcuucuaauguuuuaucauuaaauaugauauuguagugggcuuuuuugagagggggugcugaugauauuuuuauuuauuuauuuauuuugagccggggucuugcucugucgcccaggcuggagugcaauggugcgaucucggcucacugcaaccuccgccuccuggguucaagcccuucuccugccucagccucccagguagcugggacuacaggcaugugccaccaugcccggcuaauuuuuuuuuuuuuuuuuguauuuuuaguagagauaggguuucaccauccuggccaggcuggaugauauuuuuuaguugcaguucucuuuuacuuaucauuuuagaguuucuacugugagcaggaguuuaauuuugcuaaugcuuuugcuacaucuauuggcgugaugaaguccauuaaucuucaauuuuauuuuuaguuuuuuuuauuuuucauuuugagauggggucuugcucugucgcccaggugggagugcauggcucacugcagucuugaccuucugggcucaagccauccucccaccucagccucccaaguagcugggaccauaggcaugugccaccaugcuggccugauuuuuuaauuuuuuuguagagacggucuugccuuguugcacaggcuagucuugaacuccuggucucaagcaguuguccugccugggccuccaaaagagcugggauuauaggcgugagcuacagcguggguccuacauuuucuauuuuaaacuauuuuucgauucccggauauucgcauaucuuuguuauugccauguacuuuuccuuuuuuauguaaucuuguuuggauaacaaaguuguauuaaccucauaagauaaauuggggaguauuuuuuucuuuuuucuuuuaaacaguugcuguuuaauagagacaaucuguuucuuuucuuuuuuggagacagaaucucucucuugucgcccaggcuggagugcaguggcacgaucucggcucacugcaaucucugccucccugguucaagugauucuccugccucagccuccugaguagcuggauuacaggugcccgccaccaugccuggcuaauuuuuguaguuuuuaguagagauggguuucaccauguuggccaggccucaggucuggucucgaacuccugaccucaggugaugggccuaccuugaccucccaaagugcugggauuacagacaugagccaccguguccgagcgagacgaucuguuucuuaaaaguaagaacccaucugugagauuaucugugcuuggugucuuuugaguguaaauuugugguuucugauuuguuaauuguuucuuucaugaugauaagucuuguuuuagcuguucuugaguuuuuuuggucauuuauacaaaaugaacaauuuucuagaaaaauauuaaauuucaaaugcauuauuauaaaauacagauuucccugaugacuuuuaaaaaccuaauuuuguuaguuuguuccuuuuuuucugaucaguauugccaguaacugccuuuauuauuggauuuuuuaacauaguuauuuuuauugauccuuucuauuucuacuccugugguuaauauuuuccuucugcuuuauuugcauucauucugacauuuaaaaauguaaguuagaggcuuagcucauucauauuuaaucuauuuuuauaauauauauacuaaaaacuauaaaauuuucucuagacuauaauuggaugcuauuuaaaaaaauugaaaugcuuuuuuuuuuuuuuuuuugagagcgggucucgcucugucgcccaagguggagugcaguggcgcacucucggcucacuguaaccuuugccucccggguucaagcgauucucuugccucagccuccugagucgcugggauuacagacgugcaccagcacaccuggcuaauuuuuguauuuuuaguagagacgggguuucaccauguuagccaggcugguuucaaacuccugaccucaggugauccaccugccucggccucacaaagugcugggauuacaggugugagccacugagcccagccgaaauacacguauuuaugggguagagugauuauguacauguauacaauguguaauggucaaaucaggguaauuagcauaucugucacaccagcauuuaucauuucucuguguugggaacguucagaauccuuucuucuagauauuugaaaauacauaaugaauuauuuuuaacuauaaucacccuacagugcuauagaacacuagaacuuauucccccuauuuagcuauaauuuguaucuguuaaccaaacugucccuaucucuggauacuaugauuuuugacaugaauugguuuuuauuauuuaguucuaaauauauugugaucuccauaauuuuccuguugcccauuaaaauuauuuagaacuuuguauuuacaggauuuucuuuuuguauuacuguuaucucugugauauuuauuucuaauuuuauuguauuauacuuggggaacauugagaugcaaaaaucaacucuguuucucuauaccagcagcaaacaauuugaaaaucaaauuugaaaacuaauauaauuuauaauaaggucaaaaaacaucugauaccuugaaauaaauccaacaaagcauaccaagaccuucaguaaaaaccuuacuaagagaaaugaaagaagaccuaaauuaauggcaagagauaaccauguucauuggauuggaagugucaguauuguaaagauguccguucucucuaaauugauacauacagaaauucagugcaaucgcaauaaauaucucaauagggcuguugcugcugccacugcugcuuuuuuuucuuuuggauaggcuaguucucaaauuuacauggaaaggcacagggccaagaauggcaaaggcaaucuugagaaaaaguuggaagacuuaacacuaacauauaucaacacuuauuauaaagcuacagugauuaaauuagugggcgcaaagccagauugaccaguggcacaggauagaguccaaaaguugaccuacacauacaaggucaguugauuuaaagaaagguguauugggauuuugauugaauguagagguuaauuaagggagaagugauacuacuaaucuaacauauucuuuuuuuucuuuuucuuucuuuuuuuuuuuuuuuuuuaaagacagucuuccucugucauccaggcuggaaugcagugcaguggugcaaauuuggcucacugcagccucugccuucuguguucaagugauucuucuucugccucagccucucgaguagcugggauuacaggugugcgcccccaugucugccuagcuuuuguauuuuuaguagagacgggguuucaccauguuggccagccuggucucgaacuccugaccucaagugaucuaccugccucagccuuccaaagugcugggauuacaggugugagccauugcaccuggcccuaauguaacauauucaagagcaagauugcuuucucuauuuauuugucuaaaaaggaaaaaaaaaaaaaaaagaaaucucuagcugggcgugguggcacaugccuguagucccagcuacuuggaaggcugaggcaggagaaucgcuugaaccugggaggcagagguuguggugagcugagaucgugccauugcacuccagccugggcaacaagagugaaacucugucucaaaaaacaaaaaaaucccacacaguagaguuuuuaauuacucuuaucagugggauuuuuucauucuuagguguuuacaugagaaagcuuuugucuucaaguauauuaauuuuguaccagcacaccuuaugaauucauaccgauaauaguuuuucaguugauucucuuguauuuccuagauauagcauaugcaaauaaguuuaauuuccuucaaguaauaauuauaucuucuauuucaucaucuuaccuaauuacacuggcuggcauuugucacacaauccuauaauaauaguauuaauggccauucuuaauuuugacuuuagagagaauacuucuaauguuuuaccuuagguuuaauagaugucuuuuuguuauaaagugauaacugacaucauucucauaucccaaaacacauguucugacaugaacugguuuaagauugcauauacuugaguauuuuuuaaacagcuuuauugagauaaagcuauuauuaaaucuacccuuuaaaauguacauuucagugguuuuuuaguagauucagaguucuguaacuauuaucacuaauuagaacauuuucgucaccccaaaaagaaacccuacaccuacugguaaucacucuccucuccccgcuuccuucauccccuagcaaccacuaaucuaccuucugucuguguggauuugcuuguuccugacguuucauauaaauggaauccuauaacguggucuuucgugucuggcuccuuucacuuagcauauuguuuucaaggucauccauguuuuagcguguauccuauuuauuuaauuuguuaacuguuaaaauaucuaucccaauuugacucaaaaguuugcuuuaaaucaaaaguaggcguucaguuucaacuuuucagcaucuguugagaauaucaggcguuuuuuuuuuugaccuauuaauuugggccauuauuuggcuccauccuugaauucuagaguacccauacugugccaaggucugugguguguguguguguguguguacauguacauggaugugcuuuuuuuuuuuuuuuuuuuuuuacaugacggaucauauuugcggauacuugacuugggauucauaauuaaccaaguuuguaauuugguuaaauuauuuuuguuagguuuuuuuuuuuuuuuuuuuuuuuuuuuuuuugauacagagucucacucugucgcccaggcuggagugcaauggcgcgaucuuggcucacugcaaccucugccuccuggguucaagugauucucgugccucagccuccugaguagcugggacuacaggcgcgagcaaccacgcccagcuaaguuuuguauuuuugguagagaugggguuucaccauguuggccaggcuggucucgaacuccugaccucaggugauccacccaccucagccuuccaaagugcugggauuacaggcauuagucaccaugcccggccgccuagcuaauuuuuaaaauuauuuugucaagauggagucuagcuauuuuguccaggcuggucuugaacuccuugcugcaagugaucuccugccuuggcuucccaaagcgcugggauuacgggugugagccacugugcccaggcccccucuuuuaaaaaaaagaaaaaaaaaaaaaaaaaaauucauuacgaucggguuuucuuuuauugaguuaaugcugguaauuuacauuuuccgucacugugcuaguguagaauucuagaccauuuucauacaaguuguuuucuuuuuuucuguuuuuuuuuuuucuuauuucaaauuguauauguuugugcuuucucccaguuucuuccccucuuuuagauuauuaucuuguauuuuauugucuucccaacccccuggaaaaagcuugguuuggagauuuuuuugggguaaaaauuagcuggcucccuagcuuugcuccagagaauggucaugaaauuaaugguugcugauacucaaccuggagcaugccuguuguuggucuuuugagaagcaggcguauuucaaaccugccccugcauugcccagcuuguucuuuucuuuuauuauuuuuuuaaugauuaaaggauuuauuaaauuccaugugcaaaacacauugcugauugcauuagcaaaagaucaauguaaaaauaccccacaauucuggaacuguccauuuaaaauauuuguucuaguuguugaaaggcccaguguuauauucuugccagugcuuaagguauacagagaauacuguaaguguuaacacugaguuuacagaaccucauaggccgaaaguaauguauuuaggaaaagcaauaauaguaaguaugcauucauguaggugagauauaguauggucaauaugggucaaauuacagcguuggugaucagugacaagggaguuggcaagacaauuauguuaagaaagaucauaguuuaagaauauuuagggcugggcacggugccucacaccuguaaucccagcacuuugggaggcugaggcggguggaucaccugaggucaggaguucgaaaccagccuggccaacguggugaaacccugucucuacuaguaaaaaauacaaaaaauuagccaggcgugguggugcaugccuguaaaugccagcuacuuuugggaggcugagguaggagaauugcuugaaccugggaggcagagauuguagugagcugagauggcgauguugcacuccagccugggcaacaagagugaaacuccgucugaaaaaaaaaaaaaaaauuuagaguguuuugaaaacuguaaaccugcaaggcaugauuuuuacaacuaguuaccagaaaaugaaggaaagcacauaauuagcuugaauaaaguaacaugaaagcgagacugcacuaauuuaaaaaaaccccaaauccuaauacaguaucagaaaaauauuuucuuuucuuucuuuuuuuugagacggagucucgcucuaucaccaggcuggagugcaguggcaugaauuuggcucacugcaaccuuugccuccugaguucaagcaguuccccugccucagccuccugaguagcugggacuacaggcacgugccaccacgccuggcuaauuuuuuguauuguaguagagacaggguuucacuaucuuggccaggauguucucgaucuccugaccuugugauccgccagccucggccucccaaagugcugggauuauaggcgugagccaccacgcccggccagaaagauuuucuaauacaaggagacauauugcucauugagaagggguuugauaagaaaacuuacuaaguuaacaacuauguuaaugacuaguucagagauaaauuaaaugcccaauuuugggaaagguagcaggugcaagaaaaaggaaauguauaagaaaacaguuucugauacuuaaaccuuucuucaucauguacugcauuugacagaaauuaaccuuuuaaaaauuuuaccuaggaugguuuuauuucauuuauuccauguacaauguagucuaaaucuccacuugauaccaugucagaauccugucuucauccuuugauuacaucaaguguuucucacacugcucgaacuaagucugcaacuaaagguagaauacuucaguagaggaaacgugaauagaauuucuuuucagaauuucagcaaaaacuaauaagcuauuuuaaaguuuuucacuaugaaauaaaagagugauccaaagaguugaguuguuuuacucauuccauuaugauauaugguagaauguuauggaaugaacauggauauugcuaaauuauugaaugcauuaaauggcaguacuuuauuaaggaggcuguacugcuuuaaauaucugaaaacuaguuagaaugugugcauuuccucacaucaagcuaagccuuaaaaacaaaagcauuuaaaacuaguguuuguagcucauugguacaaguagguucagagaguauugugucaacucuuaaucugagcaggaauagaagcuuugagaaaauaggcuuuaagaagguuugucauuuuacagccaaguuuuaauagauugugaaaguuuggacucuuagauuuuaaacaaacaaaaccuugaaauuacugauuggcucagcgugguuuuauggaaaaacuaauacaaaaacuuggccuugacuauuugagcaaagccuacaaaaguuccagaugggacagggcaaggaaggauggggcucuauuuacaacagcagauauuuucuuuuccucuucuugacguggaguaggcagggcuauuugaaaauaaaauauucuuuucuuagagaauggaacuugaauuacaguuauuagauuaauaucgauuauauacauuuucucuuuuccuuuuagacuaguugaucuguuaaguguugauaguuguuguaaccuuccacuacuauugauuuuuuuuauuacugucucauagguucuuuugcuuuuuuuauauuuacauauuuccaugcuguuuuauuuggcacauaaaaaugcauaaugacuucaaauucaacauagacuagagaacacacacacuuauuuuuucuuccuucuaaaaucacauaaagaauauaaaaacaaauccagagaaacaagaaaaccucagugguaugaaucagaauaugaugaauuuuugguugaauaaagcaauuggaaaucaauuaaugucaaaacccaagagagcuuagugaacgugugaccuuauucagaaaguagaagggaccagccaagaauuggcauccugcaguaccaccaacaucaaaagcagggaggcacuuggagauagaacaagccaugaguacagccagauaauuaaagccauggaaagcuaagccauuuaccuauuaguauaggugcccgcaaugguuuuccugcugggauaaugcccaaaauucagcucucugaauugcuuguuuguccauaggaaauuccaaagugagugcuguauagcaagaaagauaggggcaguaguuuagguagcuuguggcuauccugaaggauauugaaccuccagcaccuggaagaugggauacucuuccaccauuaaaggagaaccuggcugguuacauggcuccuuucucgccuauggacucauucuagauaggacuucugugaucugaauuuaaguuuauuguugggcaaacaggaauuaucacuugggcugaagaaguucaccccagcagucagaauauaacucuagucuggacccucaucuacaaguaggaauagacaaccaggaagaaccaugcuuuucaggaaaaccagcaguuuaaaagagaggcaccaaauucaacuaacugaauaaugaaacaccagaggagacaguuuauauaggguacagaaugaacuuuaaauccacagagagauuugggaagauaccguguccacccaaaaaagaaaagauugcuauggaaaagaaacuauuagaauuaaaauaugaacuuuuaaagaaaaauucaguagaugggguggagaucaaauuagcuagcuuagaagaaagaauucagggauucucugagaguguaguagaaagacaaaaucugagagaaaaguuaaagcaauauagaagcuagauuuaguagccuuuuuacauccuguaauaaaugcuaguaagaaugaacagagaaaauggaggaaaguauagaaacaacaagaaacuuuccuaaguucaagaagggcuuaagucuuuugauugaaaggccccacauggucugcaugugagaagagaacuuguuagagugguagcagugauaauaaagaggaagugauaaguauaagaguuacuggcuuugagaugaauuuaauuuaagggcugauagagucagagaagagaaauaugacuccagauuugaaaaugagauaucuggagaaaugauggcuaacauugaacaacaugggggaaaaauuaggaaagaaaugcagcuuaagagagaagauauuaauuaggccuuaaauauaaguuuucaccaguucugauuucccucuaagacaaauuguuauagacacauuugccuuuguuugccuuuccugcagcuuaagcauuccuucuaccauguauaauaaaauuuaguucucugagugugacuuagugagaagaauuagaguugagucauagaauuaacaggcagugagguuuugggagaccuaaagcagaaaagugauuuuuauaugcauauuagcugcaaaaagcaaagugaauaaauaagaauccuguuaacuugcccaagagggagaucacagaaguaucuaagcaucaaaauauauaaaacaaauaaauuauaucugugaucccuaauuuaagauagauaaaaugccauugcuauaccuguuaacuuuuauugcuuuauuauauauuuuauuuauaauuaccuucuucuaggaugauauugcuuuaaagaauggaaggacauuuuugugaauuuccuggguucuccuagcccauuauuucccucaaaacuauauguuuuucuuuucuuucuuucuuuuuuuuuuuuuuuuuuuacuuucuguccucacagucuguucccaaaaacuauguuuuuccacugugaauuauuuucaggaucaugauucucguaacugggaagggaauaucuuacugaguuugagguguuaguagagucccagaaauaccuugagggcguuugauaguaagacuaaauguuaguacuuguucacccaaauucugagauucuugguucucugaaccauccuacuuauuugucuuuagguucaacugaucucugggcuugguuuguacuacaaaggcauggacaccgccaguuacauuaucacguaccuucuuccacccuucguuuaucauaucugagaacuccucugaguagguucuguucugagaacaguuucauucugauugucaaagggaguuaguauucuaacuccagagggguuacaaaguugagguauagucaucucuguuuagaauguuugaauuuuuguaaugacaaaaccgaagggaaaaugaccaggcaaaacaauaguuuguugaauaauuacugcucacuuaagaugagaugagcgggcacccccauguaggccagaauaucuauuaggaaaugcacgugauguaaaaggaugggaagaaagcaaaucagucuguuaaugguagcuuggguuaauacugcagagccuuugaguauugaggaacugcugaaguguucagagcagggaaguaguaugaucaaagcagugcuucaggaggguuaauuugccuacagauugcagaaaugccucaauacuuggcaccagcccuuacguguaguuuuaggguuucuagucauuuguugugggaguggcagaaaggagcaaggccaguccagaggcuauuuucaucccccagggaucaggaaauaugaagcugagugggaaugcuaacuaggaauuaaaaaaaaaaaaaaaagauucuugagaaguugagaauugacaagaucuggcaaucugacugugagcagagaagaagaaaaaggccauaguggucauaucaggagaaggcuggguuuuauccggaugagaauauucaacagucuguuggacauguuaggaugauuguaggaaucauuguuguggaaauaguaguugaaaccaugggaauaaagagaaagcagaagaggagaggguugagcacacaccugggcugagccgcaguaaggggugaggggagggugagcagccagcaguuaagaagagggaagagaacuagaagucacuuaaagcaacagaggaaggagagcacuucacaaauuagggaguugauuguuuaauagaaaugccaaggaggaugaaugccaagaaaaguuguucugcaaguugagaauccguagagcugaugggauuggguuuauguagggaaauuugugcggugaggggcuuaaauaccuuaauguauccccuuuauugccuucuuaauuggcuugcuuuaaugucauaguguuucauaaugcuuagaauuuuuuuuuuuuuuuuugagacagagucucgcucuguugcccaggcuggagugcagugucgcaaucuuggcucacugcaaccuccaccucccggauucaaguaguucucccugccucaaccuccugaguagcugggauuacaggcaccuaccaccacgccuggcuaauuuuuguauuuuuaguagcaaugggguugcgccauguuggccaggcuggucucgaacuccugaccucaggugauccacccgucucagccucccaaagugcugggauuacagaugugagccaccacguccagccaaugcuuagaagauuaauuuacguuuaucauuuuuaaaagggggaaaagguauucuauagccagaggugguuuugcgggaguggggcaguaauaacuuuuucagagcauguacacuuucuguuuuucauuugcuuuaauuuuuuuucuuuaauuuuuuuuuuuuuuuuuuuugagacggaguguugcucuauggcccaggcuggagugcaauggcaugaucuuggcucauugcaaccuccguaucccggguucaagcgauucuccugccucagccuccugaguagcugggauuacaggcaugcgccaccauacccugcuaauuuuuuuguaucuuaguagaggagggguuucgccguguuggcuaggcuggucucgaacgccugaccucaggugaucuacccaccucggccucccacggugcuggcauuacaggcguuagccaccaugcccagcccauuuacuuuuauuugaaacaguuugaauaaauaacaugaaacaugcuauuucuuaaaaaugaguagaauauaucucagaguugguauguugagaauuccuuuuaugaauguuaauuuucucaauuaacauuuaauggauauuuccauuacuauuccauguuaauggauuuuuuuaaggacuauauauguaauuuaguaucuguaaguaagacauauauaaauaaucauaauaugacaaaccaguacaauaagagaagaauagagugcuguggaaauuucagagggaaaaauuguuuccagcuuucucuuuuuuuuguggggaaggagauuuagagggaaagaucaaagcagagauaaugggggaaagggguuccagguagaaggaucccugaaucaaauaugaaguugggguuuuauggggauguugagcauuuuuguuuggcugaacuuuguguggguggggaccauguguuuguguacaugcugacagugguagagggaagugcuugaaggaaaguuaggggagaugaugaugggaagguaguuuggggccagaacuuagaagaugacagguguuugaauuuuauuuagagggagcaagaagccauuaaacauuuuugaacagaggaaugaugucaccuagcuuuagaaaaaugacuuguguuucuguuaauugaaauuuuaauaagcauguaguacuuauaaaaucagcaaaaaaaagcgguaaaggugaaaauuauugguuagaguucuuuuugucagaaguuuuuggcuuaaguagaaaagggagaauuaaggccauuggaaugucuuacaagaauucaaggcaggaauauagcuggaccucagauaggucuagaaccaggagcuaaacagcugucuccccucccugcuuacucuauucuguuacucaaggcacucacagucuaagccagaguugcaaaaugacuuuucucagcucuuauguuccagccaccaggacagagagagaaggagagagagagagagagagagagagagagagagagaggcagacagacagacagacacugauucuugcucaugguuuuggauucucagggauaggacuuugauuuuauugugcuuaaagaugagcuuacuguuuaccguuuuauagcuagugccaaucaacuguggccaggagaauauaaauacacuaugggaauuuacuucucuagaugagaggguuaguuaagagagguuaggcagaaucccaaggguuguuuacuacaguuaugcacuuugaauuuuuaucauuguguaaucuacugguuggaaguuaguagacuaauuacauauagagaauaugaaaauugugcaaaaauuucccccaguaagcuacagaauguauuuuaaguugaaucuuaacacaacugguuacccuugugggaacaugggguguuacagacugaggacacaagagugcuggggucuuaaaagcguucuauauuuugaucaggguagugauuacaaaaguuuauguauguauuagaauucaucaagaugugugcacuugauagaccuaagcaauacauuuauugcuucaacuuaaaaagaaguccaggcaaaguugacuuguuuaucugcccugcuuugucauauagaugcccauuuaucauuguaaaucaaguaaguucuauuuuacuuuagauaaguaaguuuuugauacacauuuaucuuucacauaauuugagugucucagaaaugaaacuaucaugauggcauuuaauaccugauaugaaaaaacuaauggcuuugguuuacuuuuuucccugauuuaggagcugugacugaugagaauuaaaggccauggaugaagaugggcuugaauuacaacaagagccaaacucauuuuuugaugcaacagguauaacuacuugaauuguuccacuucccaucuaccagauuuggaguugguugucaucaaugaauugcuagaacucucacauugaucauucacagguuaucuuguuauccugucaaaauucacagguguuacggugagcacauuauuauuacccuccucaaagauguggcucccucacaaccaacucucauauucuugucaguaacagcagcaauaucaaaccuuaguuuuaucuucaguuaugaagauaauaucuugacgaguuaugucccuaauuccuguuguuuuucccuuugaaaauauuccuuguuagcuuuguuuggaccuuuguuuaaaaaaagaaaaagaaaaaauauucuuuauuuacaucugcucuucuucauccuagugccuaccacauagacaggcucuacgucucauucuuagucuggaaauaacuuuugcauuauuuuccuuauccuuagucucucuuaucuagccugcugaucagaguacucacuguaaaauaacauguggauccugucauuucucuauucucuaauacccaguagauaaagaaggucucccacauugacccuguccuauuuuuauaacucucucucuugcaaguucccaaaaagagacuucugcuucaggaagauggagucuucacuccccauaguguacaaggaaaaauuauacucaggaaguucuaaaaauaggaaaaaaaacaguauuagaaaacauguauuucagauuacccaugguuauaauuauauaacguuguaaagugguuacacuugcguuuuggguuuuuuuguuuucagacagggucucguucugucacccaggcuggagcacaguggcgccaucuggguccacugcaaccuccgccucccaggcucaagugaucugcucagcuucccgaguaacuggggcuacaggugugugccacaaugucuggcuaacuuuuguauuuuuuuuuuuuuuuuuuggguagugacgggguuuugccacguugcccaggcuggucuugaacccgugggcucaugugaucugccugccucggucuccuauaaguauugggauuacaggcgugagccaccaugccuggccuauacuugguuuuauaacauaaaagggauuugaggccagacacgauggcucgcacauguaaucccagcacuuugggaggcugagguggguggaucacuugaggccaggaguucaagaccaaccuggccaacauggugaaaccccgucucuacuaaaaauacaaaaaaauuaucugggugugguggugcacacuuguaaucccagcuacucgggaggcugaggccugagaaucgguugaaucugggaggcggagguugcagugagcugagaucgcaccacugcacuccagucugggugauagcacgagacgcagucucaaaagagaaaaaaaauaaaaauaaaaaauaaaaggguuuuauaucacaccagguagcuaccccuuauuauaaauaaaaugcuaauaaguuuuccauuggacuguaaaugaucagauuguaguauauuaaagaaauagcaaucaacuuuaucaggaaauuaaaugucagugauuuuaaauuaaaauuuuuuuuuuuuuuuugagacggagucuuacucugucaccaggcuggagugcaguggcaugaucucggcucacugcaaccucugucucccgaguucaagugauucuccuaccucagccucccgaguagcugggacuacaggugugcaccaccacgcccagcuaauuuuuuuguauuuuuaguagaacgggguuucaccauguuggcuaggauggucucgaucucuugaccucgugauucgccugccucggccucccaaagugcugggauuacaggggugagccaccgcaccuggcccuaaaauuuucuuuuuauuauuauuuuauuuuucuuuuagcggcagggucucacccuguugccugggcuagaguacgguggcaugauuauagcucauuguaacuucagacuccugugcucaagggauccuccuaccucagccuucugaguaccuuggacuacagaugggcgccaucaagcccagcuaauuuuauuuuuuguggagacggggucucgcuauguugcccaggcuggucucgaacaagugcuccucccaccuuggccucucauggugcugggauuacaggugugagccacugugcucggucaaauuuuaaaauuuucuugaaucucuaaauccaguggggauguguguguguuucuuaacaacuugggauacucuuuuaacucguuugguaauuucaauuugauaaugauaaauguaagguuuauaauucuuucuuccuuggaacaugaaauauaaguaauauacuugaaagagacuaaacucuuuggagaaaaaugugcaguguuuguucacuuaaucuugccacaggcaaaccuagguaauggacuaagugguagauugaagggcuauugcguuuuagucuugauugauaacacuuaaugguauuuguuuaucuuugagcaagucacuuaaucugccagggccuccguuuucauaugucauaauaauaaugaaaccucucauuacaguuuuucagaacacuucccauacauucccauuugaucaucaccacaguccugugagguaugcauggcagauacuacuguccucauuuuacugaugaggaaacugaaacucagagguugaaugacuugcccaaggucacaaaacuaauaaguguccuacccugauguacucucugauuuagauuuugguuuuuuuuugguuuuguuuuugagauggagaauugcucuguugcccaggcuggaguacaguggccaugaucucugcucacugcaaccuccaccucccugguucaggugauucuccugucucagccucccaaguagcugagauuacuggugcagaccaccaugcccggcuaauuuuuguauuuuuaguagagaugggguuuugccauguugaccaggcuggucuugaacuccugaccucaagugauucgccugccucggccucccaaagugcugggauuacaggcgugagccaccgcgcccggcugauuuacguuuuauaaccagugcucuugccacuagaugcuuucaucuuuauguaugcuaaauggagauuagugaucuauuacuuaaugauaauauuguggauauugaaaacaaguuuaaagcauuuuguagaaauucuguagaaauuaaagugaacauacucuuuuuuuuuuuuuuuugagauggaguuuugcucuuguugccuaggcuggagugcaauggcgcgaucuuugcucaccacaaccucugccucccggguucaaaugauucuccugccucagccuccugaguagcugggauuacaggcaugcgccaccauguccggcuaauuuuguauuuuuaguagagaugggguuucuccauguuggucaggcuggucucgaacuccugaccucaggugauucgccugccuuggccucccaaagugcugggauuacaggugugagccaccguucccagccuaaagugaacauauucuuuuuauuauuucuagauguaauuaaaauagauauuaguugacuuccuauaauuucuaauauucuuuggccuuugauuuuuuuuuuuuuuuuuuuuuugagacagucuuacucugucgcccaggcuggagugcagugauacaaucucggcucaaugcaaccuccgucuccuggguucaaggauucuccugcuucagccucccgaguagcugggauuacaggcaugcaccacuacgccugguuaauuuuuauauuuuuaguagagacgggguuucacaauguuggccaggcuggucucgaacccuugacuucagguaaucugcccaccuuggccucccuaagugcugggauuacaaggcgugagccaccacgccagaccugaucauuuuugguuguugauuaagcuguguauuucucugagggccuggccagugacacauagucauugaguuaggcaccugguuggacucagccuggucugagucaaccagaggcacuaaucuacugaauagcuauguagguaagacuuauaaaacuuucuuugcuuuucuguagaacagaagccaagauauuuuauuuauuuauuuauuaauuauugagacggagucuugcucugucacccaggcuggagugcaguggcucaaucucggcuuacugcaaccucugccucuuggguucaagcaauucuccugccucagccucccuaguagcugggaccacaggcacgugccaccacacccagcuaauuuuuuguauuuuuuguagagacaggguuucacaguguuaggcaggauggucucgaucuccugaccucgggaucugcccacuucggccucccaaagugcugggauuacaggcgugagccacugugcccagccuucuuuuauuuuauuuuauauuuuugauaaggauauuugauucuauuuccauuugugacauucauucagaauaauauuuucugagcaccauacacugugcaaacugugugaucuugguuaagucauuuaaucucacugggcuucaacugauucaguccucuaccuucauuccuuaacugcaaaauggacuagaguaggggaacuauguuccgaggaacugccuugggaguucgggucuagggggacgggaggaggcuagauggaggcaacguacccuggugaaguuggggcagcuccugcuccaacuacucucaaccuccaccacuccagcgcagcugcacuuguauuuauccuaucagucuccagagccuccucaacccaguugucuuuccuccucaacuguggucuuuagucccucuuuuaauuuauccuuugauccuuguauguccuagauucagaggaugauuucuaaauuucuauagccauagauggagcauauuggugguauauugcaccagaacaaaaagggaagcgugugaagggagaaaggaaaaaaaauagaaguaaaagaaacacaugggagagauggaaagaagaacaaauaugaguugaggagagggagguggagcaaaaagguaaaacacauauaaugaaggaaaauaguauguuugucaccugaaguugcauuacuuaauuuuuuuuuuuuuuaagagacuuagagacagagucuugcucugucacccaggcuggagugcaguggcacgaucucggcucacugcaagcucugccucacggguucacgccauucuccugccucagccucccgaguagcugggacuacaggugcccgccaccacacccggauaauuuuuguauuuuuaguagagacaggguuucaccguguuagccaggauggucucaaucuccugagcuugugauccaccugccuuggccucccaaagugcugggauuacaggcgugagccacugcgcccggccuacuuaauuaauuuuuguaaucuucccuuaaguaccuauguguaugguuuucuuuucuuuucuuuuuuuuuuuuuuugagacggagucucacucugucgcccaggcuggagugcaguggcgugaucucggcucacugcaagcucugccucccggguucacgccauucuccugccucagccucccaaguaacugggacuacaggcgcucgccaccacacccggcucauuuuuuuguauuuuuaguagaggcaugguuucaccauguuagccaggauggucucaagcuucugaccuggucauccgcccgucuuggccucccaaagugcugggauuacaggacugagccagcgcgccuggccuuuuuuuuuuuuuuaaaacagucuugcuuugucacccagguggagugcagcagcgccaccuuggcucacugcaauguccgccucccugguucaagcaguucugcuucagccucccaggaaguugggauuauaggcuugugcuacccaugcccggcuaauuuuuguguuuuuaguagagaugggguuucacaauguuacccaggcuggucucaaacucuuggcuucaagugaucugcccaccuuggcuucccaaaguggugggaauacaggugugaagccauugcaccuggcuauauauggauuuuauuagugugccuaaaauuuuacuuucauguauguauuuuuucugugacugccucaauugcuuuguucuccuaauuuuuaaaaaucuauugauuugagaugauuacaaaaguucuuggguuaaaaacaugugauucaaaaauagauucccucuuuauuucuuuaaucuaucuuaauguuuaagaaaacugaggagcuaaucuguuuucccaguagaaauuaaguaacauuuacguuaauuguagucaugcauacuuaccugaaauuugucauuuuaauuuuuuuuuuaaggagcugaugguacacacauggauggugaucaaauuguuguggaaguacaagaaacuguuuuuguuucagauguuguggauucagacauaacugugcauaacuuuguuccugaugacccagauucaguuguaauccaagauguuauugaggacguuguuauagaagauguucagugcccagauaucauggaagaagcagaugugucugaaacggucaucauuccugagcaagugcuggacucagauguaacugaagaaguuucuuuagcacauugcacagucccagaugauguuuuagcuucugacauuacuucagccucaaugucuaugccagaacacgucuugacgggugauucuauacaugugucugacguuggacauguuggacauguuggacauguugaacaugugguucaugauaguguaguggaagcagaaauugucacugauccucugacuaccgacguaguuucagaagaaguauugguagcagacugugccucugaagcagucauagaugccaaugggaucccuguggaccagcaggaugaugacaaaggcaacugugaggacuaccuuaugauuuccuguaagucuugggguacagugauugucaaagguguuuuuguaggcugccucuucuaauuuacaucaggggugaaauuuucuugacuuaaaugucuguaaaaguaaaucucauagaccuaccugcauuguuguuuccauuugcagccuacaagauaacugaaaauuaagaaaagugaggccgggugugguggcucaugccuguaguccgggcacuuugggaggcugaggcagguggaucaccugaggucaggaguucgagaccagccuggccaaccaacauggugaaaccccgucucuacuaaaaauacaaaaauuaaccgggugugguggugggcgccuguaaucccagcuacuugggaggcugaggcaggagaaucgcuugaacccgggagccggagguugcaguuagccaagauugugcuacugcacuucagccugggugacagagcaagacuccuucucaaaaaaaaaaaagcugaaacaaacagaacugaacuuuggaaucaugaagaaugugauuaggcuguuaccagccuuuauuagaauuaugaacucucuugaaaccuaaaaggaguucaacuuggaaaaacaaaaagucuaaccaagcuacuuacuuuuuuuuuuuuuucggagggagagucuugcucugucguccaggcuggagugcaguggugcgaucucagcucacuguaaacucugccucucgaguucaagugauucucgugccucagccucccaaguagcugggauuguaggcacgcaccaccacgccuggcuaauuuuuuguauuuuuaguagagaggggguuuugccauguugcccagucuggucuugaacuccugagcucaggcaauccgccugccuuggccuuccaaagugggaggauuacaggugugagguaucacgcugcuacuuauuuucuugaauauggauacacgguacuguuuauguaauacuuauguacuuauauaauauguaaaacacugcauaacagauaacaugaaaaagagcucugguauaguaugaaacaugauuccaaaacaugguaucaaguaugauggauucauauuagguuauuggagaaaaguaaaguauuuugaaacacaccuuuacauguuuaucuuagcaucuggaaagacaaccguuaucuucuuacaacauacuucuugguaccaauuucggagauaaaauucuagauuggcuaggccacgguucugacccaguguggaaauucuuaugccuuaaggaacuaaacuuaaaauauaaaggauucacagacuauuuauaaauuuacaagaauauuugcuuuguucgaauaccuguuuucauacaggaauuuaauauaacauuaauauacuggaguccaccagcauuuuaggaaacuucuuugagauuuugaaacuccuuugaaaacuucuugagauuuugaaaaucaaagaauuauuuguggaaaagggaagaaaaugccuucauucaacacguuuauuggacccugaaugugugagacauuguuguagguagcguagauacagauaugugcuaaauaaauacauacauaagaccauuaucccuggagagcuuuugaucugcugugggagagaaaguuuguagugugaugcagaggugugacuaaacugccauggagaugggauggaguagcugaccuuugaaaucaaggaugaauucuaguuuuacaggaugaagggcacggguggcaggaagacauuccaggcauauaguauaguguauuaaaaaagaaaaaaguucuggccuuugcugauauugcugauaaugaugggaacuuuaggauacacuuuuauaucuuuguguacguucuauuuuauuccuuagaauaaauuuguagaaauagaauugauagaucaaaggguguacacauuuacaaguuugguuaugcuugaaguuugguuaaauucucuugguauuuugccuuaauauucccuucaccaaguugaugagaauguucauuucccuacacuggaaccaacacagaguauuauuuuucuuuuuaguuuucgccauucugauagggaaaaauacguuacccuguuucaauuuugaauuuauuuuaggaugaugauccuuguauguggaauaagacuuaagugagggagagauuaguggcagugaacuguugaaaugguucauauauaagaugaucugaaguacguuaauaauaguaaaggggacagagagguagcugcauucaagagagauuaggaagaaaaauggaugagauucgaugauagauaaaagaggcuagggguuugaggaagaaagauaauucaaggaugacccuaaguguucuaccuugggagauuggaugccuagucaugccauuaccugaaaggaggaguagguuuggugggggaaggugggggaagggggaagauuuaggaucuguuacaguuugaauugcuuguugguggauguuucuucuaggcaguugaaaauaugacuuuggugcuuuugagagaguuuguugcuagaggaagaaauuuaggacaacagaauguaggcaguaucauauauggaaauggaugguagucuccagagcaugcuugucgagugagagugucaaguauggcuccuuuagguauuuaagaaguaggcagaaaagaguccuugaaaaaucaggagguuuugggaagagaaggaggagaaaaaguauuuccaacacuguuaaggauagaguuucuacaaguuaucagccacugaggagaaagcaggcuuuuuuguuuggcauuuaggaggucauugguaucuaaauuagaguagguucaguaaggcaugggcuauuggagaggagauggaagagaugagcugugauggauugagaaguuaguggaaguagaguuaggugaagcgguuuggauaaauugccauuuuggucagcaaagggacuaaagaggugggaguauagcuuuugaugguugccuggauggcgaaaguaaguugaacauguuuauagacuuaagggaaaaaaaaaaucacuggacagagagaaccugaagauaaagaaaggaugggcuaguggagcagguuccagagaaggggaagggacugggguccagggcugcaggagauggcuguuagguaaguccuggagagggaaagugaguccccuucucugagacaggaagacaguuaaggaugaggccccuuuccagggacagaagguaaaaggaguacuugaauguugggagcuauuuugucugugaagcagguucaucugcacauauggaaggacugcagaggcuggguggaaagcugaaggauaauggcaaaggguugaaaagcuuuagucuuuaggggaugggccaguguaggaagccaagaauuuaugagauagauugcugaaccgcauugaggggccagcugagguuaggagucuauuuuauuuuauuuuauuuuugagauggagucucacucuguugcccaggcuggagugcaauggcgccaucuuggcuuacugcaaccuccgccucccggguucaagcgauucucaugccuuggccucccgaguagcugggauuacaggcacucgccaccaugcccagcuaauuuuuguauuguuuaguagagacgggguuucaccauguugccuaggcuggucuugaacuccugaccucaggugaucccacccgccucggccucccaaagugcugggauuacggacgugagcuaccacgccuggccgaaaaugcuauuuuaaaaugcagguugagcauccuuaauccaaaaauccaauaucugaaaugcuccagaauccagaacuuucuaaguacagacaugacaccacaaguggaaaauuccacaccugacacuugcuuucugaggguucaauguauauaaacuuuauuucaggcacaaaauuguuuuaaaaaauuguauaaaauuaccuucaggcuauguguauaagguguauaugaaacacagauaauuuuuuuuuuuuuuuuuaauuugagacagucuuguucugucucccaggcuggagugcaguggcuccaccucggcucacugcaaccuccaccccggcucacugcaaccuccacccccuggguucaagugauucuccugccucagccucccgaguagcugcgauuauaggcacgugccaccaugcccagcuaauuuuuuuguauuuuuaguagagacgggguuuugccauguuggccaggcugaucucgaucgaacuccugaccucaagugauccaucugccucagccucccaaaaugcugggauuacaggcgugagccaccaugccuggcugaaacacagauaaauuucauguuuagacuugggucccaucccuaagauaucucauuguguauaugcaaauauugcaaaauccacaaaagucugaaacacuucugguccaaguauuuuggauaaggguuacucaacccuuacgacugccagauuuucuauuacaagaccgggcaacccaggaccaaggcuagagaaagcagagaguugaguucgucccaguuugugaggggaagagggccuggugaaauacugaagaggauaaagcacucucgcuucuccuugacuucucucugcacuuucugcccuuucugucuuccucagcuuuuuugcuaaggaguaaaaugcaugguauugguuugcccuuuaacugcgcacuaucucuugccuuuacuuucuccucuuuuaggaaguucagcccuccaaggaagucauugaaaaaaacccagaaguugcuuuaguaacaauuuacucagcauaucagguucuuguauuacagaauuuguaauacaagacauguaaaauuuuacagacuuguaaaauuuucauuaaaaauuuuauuuauagucaucuuuaggcccuggguuucuucuaauuuauauagauuuuaauguuccugaaaaaguaaauauggaugaacauaaauggcuauuaguguauuuuauauauuuuaauauauguuuuauguauguguauauauuuugauaauauaauuucuuuccuuuuaaaauaaaacauauccaaacucaaauaaugcagagauacauuuaaacaaauacauacacacaugagcauuugcgugcacacaugugcuauuccccuauuucacuauaaugaaaugguuguuuuuaaguuggguuuagagaugguggccuuuaguaguaucuuuugucuucucuauuauuauguuugagaugaagucucgcucccuuacccaggcugggagugcaguggugccaucgcggcucacuaccaccucugccuccugcgcucaagcaaucuuuccaccucagccucccgaguaguugggaugacaggcaugugccaccacacccgccuaauuuuuacauuuuuuguagagaggggguuuugccauguugcccaggcuggucuugaaccuggucuugaaccagccugggcuuaagcaauuugcccacuucagccuccccaauuucuucaauucaggugugagccaccuugcccggccucuacagccacuuuugcacucuuacuucccucuacuucaucauccccuuuccuuucaaaguaaugaucauauuuuaaaauuuaauuuacuauuggcuuugggaucaaaccaauugaacacuuuagaauuaacuaauauuucucuuggcugugccucccagcaaagauacuuaaugaugcauuuuauuuuaauuaauuuauuuuugagacagagucuugcucugucgcccaggcuggagugcaguggcaugaucuugguucacugcagcuuccaccucccagguucaagugauucuccugccucagccuccugaguagcugugacuacaggcgcgugccaccacgccuggcuaauuuuuguauuuuuaguagagacaggguuucgucauguuggccaggcuggucucaaacucuggccucaagcgaccugcucaccucggccucccgaagugcuaggauuacaggcgugagccacugcuuccggccuuaaugaugcauuuuaacuuaaaacuuauauugaggucgggcacaauggcuuaugccuguaaucgcaacacuuugggaagccgagaugggggagggucgcuugagccuaggaguucagagguuacagugacccuugauugcgccacuguacuccagccugggcgacagaaugagacccuguuucuuaaaaaaaaaacaaccccucccaaaaccccccuaaaacaccuauauugauuucagaaguuaaggauuaacaaagguuuugucguaaguauauagaggaacuaugggcugauuuaauccaugauagagaaugugaagauaccauuaucgguagucaacuuuaaugcuuuucauauuaugaugagagaugguaguauuucugaaucuuauauuuauuaaacacucuaucuuuaggucagaaauguggccagauguccaaguacucucuuuucuacucucuucuuuaaaaauuucaguaaguuacuggaucugagugucuaauaaacagcuuuuacaaugucuuuaguauccaucuuggcagguuucuucccucugcacgucucauuuaaaaugaugaugggccagguaagguggcucacaccuguaaucccagcauuuugggaggcugaggugggaggaucucgaggguaaggaguuggagaccagccugggcaacauggcgagacuccaucucuacuccccacaaccccccaaaaaaaagauuagcuggugugguggcaugugccugugguuccagcugcucaggaggcagaggcaggaggaucccuugagcacagguguucgagguugcagugagcuguaaucauaccauuguacuuccgcccgggugacagaacgagaccccaucucuuaaaaaaaaaucaaaaaccaaaaaaccacacaaaacaacaauaaaugaugaugaagcaguccucauucuuuauaauaucaugguuguguauauagacacagauguucauugucacaguauauagcuaccuuugaggucaggaugacugccuucuucagucuuugcaaucuagauuuuaugauuggcuucuaaguuaauuauauguuucuugaggacaggaacuauuuacugcaucuuugcugcuuauguaucuuccccaucacaccguauguauauuagguaugaaauaaauauuuguugaauaagugaauauaugaauguuauagcugaaaguccguguacaucaugccucauccaaggcauuaacgauaaauuucuucccuaccaguagcuauugucucuugauaaaaauagguaauaguaaaucuucaauaaaugauaucuaugugccggaauugaaaauauaguuaguuuuugagaugagaucucaccguguugcccaggcauacauacauacauacaugccuguagaugugcaguggcuaucugcaggucugaucauagugcacugcagccucgaauaauagcuucuccaaggucacucccagcagcauuagggugaggcuuugaaaccaguuauguuuuauuccaaaguguccacucuuaauucucuuauuggcccccccuuucucucucugugucucucucucuguguuuguauguuuguauguauguguguauaauuuaauacuacaaagcaguagaguucaugauaaauagugcuuauugguagaugggggaggcaaauagaauuccaaagauaacuacaauuuacaauaauaaugaauuccaaauuucaacaauguuaaacaauaauuuguugggaggguuuaagcauuuuuuuuauuuaacucauucuagcagaagcccagacagcuuccaaaccccauccuguuguuuuucuaacugaaaaguauuaauuuuuuucaaauuuguauuuacaugagaaaaaggaaucauauauacgcuaucacuuuuacucuugccaguguugauuuuucuuuugccuucauucauucagaaaacauuuauugaucagccauaaugagcugcgaaccucacuagggguuggagauaaacagcaaagucccuggcuuuuuaaguucacagucugggagggaagauaaacagaaacaggcaauuacaguugaguguaggaagguauguaaauagauauagaaaguacuuuagaagcacuaagaggauggggcugggcacggugacucacgccugcaaucccagcacuuugggaggccgaggcaggcggaucacgaggucaggaguuugagaccagccugaccaacauggugaaacccugucucuacuaaaaauacaaaaauuagccgggcaugguggugcgcaccuguaaucccagcuacucaggcggcugagucaggagaaucguucgaauacgggaggcagagguugcagugaacugagaucaugccacugcacucuagccacugcacgcuggugacagagugagacugucucaaaaaaaaaaaaaauuuuuuuuuugguacgcuugagggagacaaaugcuacaaaagcguuauaaacugaaguucuauggaagcucacuugaagauauugaccaaguuuauuuuaucuccuauucauuuuccucccuccuguauuuuaagcaaauuccacauaacauuuuuuucauaaguauuucaguauuugcuuuucaaagacaaggauuaaaaaaaaacuguuuucaaagcuuuaaaaaauaauuugagaugaacucaaucugaaggguguauaaaauaaaauguucaugagguggcugaggagggaagaaaggcagagagaugugagacaucauugaguguucagagaccuauucuuugggugcuaauaaugucuggugaggaggauggaggaaguggugagaaagaagauuggcaaauagggcccaaaacauaaaggcucuugaacauagacgccugcuuuacuuuuuggacgugggaagcuguuaaaggauuuuaggcagauuaauaauaacauguuuagauuuauaguuuagaaagauaauggcaauguucagggcaggcgcaagguaagagcgaauucagaaacaaaaaguacauuucggaagguuauugugguagucuagguaagaaacagaugauaauaguuugagauaaguuuguguuuuguuuuuuugagauggagucuugcucugucacccaggcuggagugcaguggugcgaucucugcucacugcaagcuccgccuccuggguucaagcgauucuacugccucagccucccgaguagcugggacuacaagugcgugccaccacaccugacuaauuuuuuguauuuuuaguagagacgggguuucacuguguuaaccaggauggucucgaucuucugaccucgugauccgccugccucggccucccaaagugcuaggauuauaggcgugagccaccgcgccuggccugaaauaagguuuuaucgguagaauuuagcagaaacugauucaugacauauguaggaaguagaauuuggauuaaauuuaggguugaggaagaggggaggguuugcagcucacuucuugguuuccagcuuaugcaacugggcacauggcaaaacuguuacuagaagaggagcagauggacaugcuaaagauuuauuuacaggguugcugcauacaacuacaauguaaagggacuccugcaaauguguaaugagguggcccugguuugcccuggccaucuaguuuagguauuuugaccagucauucuaauauuagcuccuaauuaagcaugacuuuggucauaguagacauccaauaaaacgugguucagggagcgaauaaauacauaaaguccaaaccccuauguuuaauguauaaacccugagggucaacacaaucugauaguugauugauugauucuagggacuguuagcacagaagagauaguaaaauauuuacucuuucauuccaugggcuaauuauuggcuagguauguauuuuaccauuauuuuuauguauguacccuaccaguuuuuuuaaaccagggagcaaauaaauacauaaaguccaaacuccuaucuuuaauguauaaacucugagggucaacacauccuaauaguuuauugauugauucuagggacuauuagcacagaagagauaguaaaauauuuacuccuuuguuccauggguuaauuauuggcuagguauguauuuuauuauuuuuauguauguacccuaccaauuuuuuaaaaaccauuugauaaaacacaggaaaaaguuuggaauuugaaaacuauauaucuacaugggaauauuucugaaaugugagaaaaguguuauuuacugaacuaaggauauuuuggagaagguguauugaagauuuuuaaaauuuauuucauuauuuuuuaauuaaauuuuuuuaguugcccaguaaaaaugguauauauuuaugguacacaacaugauguuuugaaauauguauguguuguggaauggcuaagugaagcuaauuaacguauauuaccucacauucuuauuuuuuuguggugagaacacuuaaaaucuguucucagugauuuucaaguauacaguacauuguuauuaacuguagucaccucaagcaucuuuuuaaagcuuuuucagauaaaauucgaaaagugguuauuuuaauccaucuaaaauuguaucuuuacuguaaacugaaauuuauuuagaaaucaacacuacaauuaaugacuuaagaguuuucaguauaauguucaaucuagguguuggcuagcuuuauaacaagaauaaagcacucaaauaaggcaaagauguuuuaguuucucccuuccccugccaaaaacaagguugggaaaaggucucuauuuugaaagcauuacaagcaauuggagcuucagacuggccuugugguuaauauuuacuguuuaucugcugaaaccuagacaaaaaugucacccugcccuuugaacagauauaugauuacuuugugagguaaugggcuuggggagggaagagaaaaggagagagggagagagagaacauaccucuccuugccuaucuuagagaagcaacaucugguauauggaaacucagcuugcagcugagucaggcagccuuggauuuggauaccagcucugcuacucauuagcugaaugaauucgggcaaguuaacuaaccuuuuuguuuuagcuuccuuauuugugaaauggcagcaauacugcuugacuuccagggugguugugagaaugagagauccugucagucacugcuagcuguugcugugguuaucauccagaggcuuucagucaguagcauccauugggcuagcaaggcucaaucucgacuagcuucauuaugaccuuucuguugucccaucagggaauucuuccuggguaagggcagguacagggugggauuguaacaguuauuccuuuuuuuuccuccugaauguauaaagaaaucaguuauuguuuuacuaguuuuagaccuauucaacuauuuuucauuacuuaggucucugacaccaugcuacagaucacucuaacuuaggacagggaccugacuggcacuguuccuuuaauuccucgucuacggaaugaggcuaauuucacuaaaccuuugaaucgcucuaggaauguuucaagaauuaaaggagaucagaucguacccaauucuuucaagucucuuauaggcuauauaauaaaaauaagguggaauuuuaaccccacaaagaggguuccugaggaggaaguuaagagaggaaggucuaagagugaaauuuaaauguauuuaucuacuaaagcauuugccuucuugacagaauacuuccugcaaguuacucagucuuuuaggugcucuguuuucacauaugucaaguagagacagaacaucuaaguucugggguugucgucauugauuucauaauaaaauacagggaaacuacuuaccauagugccugggacauaauaguugcucagauauccuuuuaggaggaaauacccaucuuugauaucuucauuggauuuuuuuuuuuuuccgagauggagucuuguucuguccccccaggcuggagugcaguggugcgaucuugacucacugcaaccuccaucuccuggguacaagcgauucuccuuccucagccucccgaguagcugggauuacaggugugcgcuaccacacccagcuaauuuuuguauuuuuaguagagauggggguuugccauguuggccaggcuggucucaaacucccgaucucaggugauccacccaucuuggccucccaaaguguugggauuacaggugugagccaccaagcccggccuucauugaguauuaaauagccauccacacagggacccugaggauguugaauaauaucaagucuauccuacaguuuuucuuuugauuggauuuugggguuagagguuuaaaaaacauucugguaauuagguaguaagacuauuagacuugccauaguaaguuagaauaggcucauuguucacagaaccuaauuuuaucuuagcaauagugagguguaugguaaggaaaggccugguuucccucauugacaucagucccaagaucacaggugugaaucuuguuaaaacuuuagaaaagauuuguguauucauacugccccuugagguaacuuacuuaggaaguaaaaucaucuuuauuuuucucucagauuagccuguuuaaagauuuaucaggugucuggaaggcugggauuuagugaaugaauuuaugucuaccuugugaguauuggccguagguuuauugacuucaaguuuaauuagaguuugagacugauuguguccucauggcauagauuuucccucuuguuugugccuccuagauaauuucaguuguucucaagacgagcacaagaucuuuucaaucuuuauugaaauguggcaaucaguguugcaguguuaagauuuugaagccuggcacaauggcucacaccuguaaucccagcauuuuuggaggcugaggcgggaggaucacuugagcccaggaguucaaacuagacuugacaacaucgggagaccccaucucuagaaacaauuaaaaaaagaaaauagcuaggugugguggcacaugccuaggaggcugaggugggaggguugcuugagcccagaaggucagggccacagugagccaugauugugcacugcauuccagcccgggugacagagcgagacccugucucaaaaaaaaaaaaaaaaagauuuuauuggagcuuauuuuaaugacuguuuaaugacuucucuuuucuggguuuuauuuaagagaucauuucuuaucuuucaggucuuguuguuucuuuuauacuuccaaaggcuuaguacuuccauguuaugcccuucuagugucauuagcagacacuaguauauugguuuaaagauguaaaaccagaugggccauugaaaacauguucacacaaaaacuucugcacauucauagcaguauuauucacauuagccaaaaagugaugacaaccuugauguucaucagcugaugaauggauaacugaaaugugguauauccauacaaugggauaucauucagucauaaaaaggaauuaaguuuuguugaaugcugcaauauggaugaaccucgaaagcguuaugcuuagugaaagaagccaggcgaaaaagaccacauguuguaugauuccaucuaugugaaaugucuagaagaggcagagccauagagaaaguagagaagugguuuccaggagauugggggaagaaugaguugggccugacugcuaauggguaugguguuucuuuauggggaauuagaagggugcugaugguugcaccacagugaauguacuaaaaaucacuuaauuguacacuuuaaaauggauaauuuuguuauguaaacuauaucucaauaaugauaaaagccaaaugggccaagcaacaauccccuagagccuuuauuauuagcuuuucuauuuacuaaaggucccaaauuagcuuuuccucuuuaagcaauuacuuuuuucaguaaaauaucuucagguaucaugagggauguuuaaaaaaggagaggugauaguuguggaauuguggcaaaagcuuuuaauuuaguuuuuaaaauuauuguuuuuuaauuauaaaauacaccuacaauuuaccaucuuaacaauuuuuuaaguauacaguucaguggcauuaagugcauuuacacuguugagcaaccaucaguaucauccauccccagaacucuucaucuugcaaaacaaacucucuauauccauuaaacacuaacuccccgauccccuccuuucagccccuggcagccacccuuuuacuuucugucucuuaggaauucgacuacccuagcuaccucuuauaagugggaucauacaguauuuuuuccuuuuguggcuggcuuauuucaccuagcaugauuuuucaagauuuauucauguuguagcuugugucagaauuuccuuccuuuuuaaggcuaaauaggauuccauuguauggauagaccauauuguguuuauccagugaaaaacuauuuuaaagcaguaauccuuugccuuaccuacccuuuguucuuccuggcuuacccuucucccccccaccaaagcaacuguagcagguccuggaauaacacguuauuuccuuauaauguugaugagaaagaaaaucgacuuucuguuggggccacugucccuguggcguuugcacauucuccucauguccauguggguuuccucccacaucccaaagcugugcacauuagguuuauuggcaugucuacacugucccaaugugagugagcaugcccugugaugguuccugccugguacccugagcugcuggagaggcuccuacacccaugacccugaucuagaaucacugggcaaauaauuaucuuguuuuuacuacucuuucuuaaauauauguguagcccacauuuauuuccauguuuaaugcuacaaguguuuuagacuauauuuagaaguuuggugauguuuuugugaccagaaaugugccauaggaacuuaacucuuguuuauaucaauuagccuacaguaaaaaauuuuuuuuuuuuuuuuuugaggcagagucucacccugucaccccagcuggagugcaguggugcuaucucggguuacugcaaucuccaccucccuaguucaagcaauucuccugccucagccccccaaguagcugggacuacacgcaugcaccacccugcccggcuaauuuuuguauuuuuaguagagauggggguuucaccauguuggcgaggcugaucucgaacuccugaccucaagugauccucccacauuggccucccaaagugcugggauuacaggcgugagccacugcacccggccaaaaaacugcuuuuguuauauacuacguuguuuggcugaaagucacaauuuccgagaaccuaccaaugacauuacgugaggacuuacacuguacuucucuuucagcuauuucuaaugguacuuaucuauaugauuguaaauaauacgcuuucuugauuuuuuuuugagacggugucucguucugcacccaggcuggagugcaguggcgugaucuuggcucacugaaccucugccucccagguucaagcaauugucccugccucagucuccugaguaccugggauuacaggugccugccaccgugccaauuuuuuuuuuuuuuugagauggagucucgcucuguugcccaggcuggagugcaguggcgcgaucucggcucacugcaagcuccgccucccggguucacgccauucuccugccucagccuccugacuaguugggacuacagaugcccaccaccacgccuggcuaacuuuuuuuguauuuuuaguagagacgggguuucaccauguuagucaggauggucucggaucuccugaccucaugauccgcccgccucggccucccaaagugcugggauuauaggcgugagccaccaugcccggcgugcccggcuaauuuuuguaguucuaguagagacguuucacgauguuuugccauguuggccaggcuggucucuugugaucugcccaccuuggcuucccaaaguguugggauuacaggcaugagccaccacgcccggccacuuucuugauuuuuauuacuucuguuuuauauguucuuucuucacguccuguugugauagcugacaauuuugcucacuuuuguucucaccucccuuucccgugacuuuucaugauaaguguguuacaauuuuugguucuuugccuuuuagaauuuaaguaauacauuaacaucuuuauuucuuguuccaucaaauguggacaguaucuuuugacuccuccuuuuuaagaugaggauaucagugccuuugcccuccacuuuccuugagcuguucagccuaccuuccaaucuauguuuacuuuguauuguugaggcugauccaucuaaguuuauuuuuuuugagauggaguuuugcucguuacccagguuggagugcaguggcgugaucucagcuuaccacaaccucugccucccggguucaggcgauucuccugccucagucucccgaguagcugggauuacaggaaugcaccaacacgcccggcuaauuuuucuauuuuuaguagagacgggguuucuccauguuggucaggcuggucucgaacuccucaccucaggugauccaccuuccuuggccucccaaagugcugggauuacaggcaugagccacugcgcccagccaauccauguauguucuauaaccauuagccuuccaauaaaguagaaaaucaguacucagugcuuacauuauuuugauugugaaaauaucauuugcagcauaaccauugaucacuuugauuacauuuuugcauacagcuuuuuuccccuagaaauuuuaauugucuccuuucccccuuguauuaccuuuuuuuuucuuuugggagacaggaucuugcucuguugcccaggcuagagugcaguggugugaucauggcucacugcugcaaccuuggacuccugggcucaaacaguccuccugccucagccuccuguggagcugggacugcaggcaugugcuaccacacccagcuaauuuauuuuauuuguagagauggggucucacuauguuguccaggcuggucucaaacuucucgcuuaagugauccucccaccuuggccucccaaaguguugggauuacaggugugagccaccauguuuggcuguagguugguuuguuuguuuguuuaugcauuguauuuucaugcaugggagcccuuugaauuuggagauuuccucuaauaguagccacuagccacauauuuggcuaaauaaaguuguuaaaaugaauuaaacauacaguuccugcguugcaccagucacaguucaaguacucaauagcuacauguggcuagugcagagcauuuccuucaucaaagaaaguucuguugguuagcacugaucugcaggcucagugaaauugcaaacaauaugaugucuuuuuaaaaacuugagacaggccaggugugguggcuuguaccuguaaucccagcgcuguaggaaauggaaguggaaggauugcuugaggccaggaguucgaggccagccugggcaacacagaucccaucucuaccaaaacaaaaacauuuauuuaucauauauuacaaggcaauaggggcaguuagaguagaaauugacaaaauucagaaagaagcugaagagaaaaaaauaugaucaagguaaaagccaccagagaagcaacaauaagaaaaaauguaucuuagcauauagccaaggacagagggauugggcuuuaagaaaucacaaaaugaaauuguaagaaaauaaaauugugaaaaugcuuauggagaaggaggauagauauggagaaagauaaaggauacaaacacacauaagugaaauuccagaagagaacaacuaaugaacuagaaaaauauuuauaaugggagauuuuuuuccugagauaaagauuaggaucuuucuuguuccaagaaauugucaaaaugguaaaacaagcaaaucauaaucauacuguuauuuagugaacuuuaaggaucaagaauuacagggacauccacacacaaaugcucaaugcuaggagacaguggaacaaugucugcaaaguucugaggaaauuguaaccuaagaguuuuguacucagccaauucauucuucaaguaaaggccauggaccaacauuuucaaguauucaggaauucagggacuguaguacccauuggccuuucuugacagggaugggggaacuauuugguauugaaucuagcagaugaaaggaucaaucaauagaaagaacccuagaauggagaaacugauuuuaaaaaaacuagaaaugagcagugaauucauuuaauauaaaacuagcuauaaaauauuugggggaguggagaagucaaaauguuaacuuccacaucuuucacauagugacaguagaugcuggcucuaaaacuuauuuguguauuauaggcaaaauauggaugcuuuuauaauauuuuuucuuuuauuuauuuuuugaagugggguuucgcuuuguugcccaggcuagagugcaguggcacgaucaugacucacugcagccuugaccuccugggcugaagugauccuccuaccucagccucccgagcagcugggaccacagccccauaccaccaugcccagcuaauuuaaaaauuuuuuuagagauggucucacuauauuacccaggcugaagcaauccucccaccuuggccucccaaaguggugugauuauaggcgugagccacugcaccuggcuuuguuuuuuuuuuuuuuuuuuagaggguuaagaacuaauaucuuaaugaccaaacauuuacuugaagauuagcauucauauauuuaacgaaugaauguugcuugcuuacucuauaugcugggcaguauuguaggcacuuggaauacauuagugaacaaaacacagggaaguuucuuucccuuauagacauuacauucuagcagagguacacagauauaggugaguaauacagcauauuauaaggugauacguacuuagggagguaaaaagcaguauaaggaggauuuggguuauaaguauggucaggguuuugcugagaagguaacauuugagcagagacuuauuuuugagacaucugauagacaccaaagaggaaauacauguacaaaucugaguuauggagacaggucuagaguggagauguaaauuugggaguuguugguacauagaugaaauuuaagccaucagacagaaagagauaaccaaaggagugauuguagacaaacuaagacuaaggacuaagcccugggguuugcagcauuaggcgguaagaggaggcuccagcaaaagagugaggaggcauggucuugguuagugaggugagaggaaaccaagagguugggucaggggagccaagugaggaaaguaaaucacagagagugagcaucugucagaugcugccgcugcaagucacacgagggcugagaauuggucacgagugaccuugaugaacaguuuuggugaaguuaugggcaaagaaugaccugauugaagugaaucuuuuuuuuuuuuuggaggcagggucucacugucacccaggccgaagugcaguggcacaaucacagcucacugcagccucgaccucccagguugagguuguccucccaccucagccuccuggguagcugggacuacaggugcacacuaccaugccuggcuaauuuuuuaauuuuuuguagagauaagggucucgcuguguugcccaggcuggucucuaacuccuggguuuaagcaauucuccugccuuggccucccaaagagcugggauuauaggugugcaccgcugcacccaaccuugaagugacuuuaaaggaugaaaugaggcuaauuugagaaauggaggugguggagaaaugggaucaagaguuuuugcuuagccgggcacgguggcucaugccuguaaucccagcauuuugggaggcugagguggguggaucaccugaaguaaggaguucaagaccagccugaccaacauggugaaaccccaucucuauuaaaaauacaaaauuagccaggugugguggcgcacgccuauaaucccagcuacuugggaggcugaggcaggagaaucgcuugaaccuggaaggcaaagguugcagugagcugagaucgcaccauugcacuccagucugggcaacaagagcgaaacuccgucucaaaaaaaaaaaaaaaguuuuugcucguuuuaagcaggggagaaagaauggcuuguuuguauccugaugagaaugauccaguagaggaugcagggaaagagaggggagaggugcucaagcagugaagggccuucagaaagaggggaugggcgauaggaaggaacacaaugguuugugggaacaggcugaagacagcguuuaugggcuuaguugcugguagguggauuagaugugcuagcaaaucuucucuucugauuguuugaauucuaggugaaguaagaaguaagugaugauggggaggugguauuagacauuugaggggagaugagaauagggaaaagaggagagaacagaaaguagcagaaauggcucacugcagguucaggguuaugaauuuaaagugaaaccaucugcuggguguguguuuguguuucuguguguuuccagccacauuuagcuacauaggugcuagugcagaggcaaagaggcaaauuguaaagugucugauugugccaagccugugugaugaaacaaaagaagggguagggaaagggaauugagaucgugggcaagggaaugggaucgacuuuggaguuaaaauuguuuuguuguugaguuuaaauucuaauguuguaccuuuguuuaaaaagagcauguuacaauaucuuauuuucacaaaaaaaucucuguucuuucuuccauccuuuuauuuguaguaugcguggagaaaugucuaaugaucuguaaauucuguugauaguucccaguggcaggauuuugagcacauuuucauuucuuucagaagaugaagauaaaggucugaguucuaaagacaggcaccucacuuucucuuccaccucucacuuaguagcucacugacuuugggcaaaucacaugccauuucagagccuguauuucuuuaucuggaaaagaugagaaucagauguaauaaaaaaauguagaaaugcuaaggauauuacaaaaugccaugcaauugguaguuauuauuagaaguagucuuaauuuccagaaauuaugcucuucuauuuuggagaagccuuauucuaaagcucuaguucuucauuacuacauuaggagaaggcacuuaugcaggaaucauagguaggaugacucaauuuuaucgaagccuucuuugucuguuuuuagaaauucauuuuuaauaaugguagcuuuaaaaucauagugaaauuuugaguacuuaacaggaccauaaaagugucuuuuuuaaagauaaaucauuccuguaacauuucauauucagaauaauuuuauagauugaguuagugggauaaauguucaaggugaaaaucugaaggugaauuauauuuauguaauagaauagcuuugcuaccagguaagcucauauauuuggaauguguuuucccucacauuugugaaagcaaacaaagggcuuuuacuccaaguuacagguaaaaccaugacauuuugcaagcucuaaaaugauuggauuuucuagucaucagagguuuaaccugaaggguacagacaaauugacaugcaaaaacaacaagccuggcccuguucuuuguaaacacaaggacauuggauuuuccaguacuuguuagaaucaguuuugacaagccuugucaaaagaggccagcuuuaucaacaacaucaaacuguuucgaguugaguuauccaaagauguuacagauuucugccuaguuuggugauaacuuuaucccuccacugcuaccucaguuugaaauuccaaaccaccuuuaagaaaauaaccuuggcccaguuagccggguauaucauaaaaauagcuuugaaaaaggguaaguacauaucaguccagaaguaagaacauuaauauugacucuuucucccuacaaaccauuuuuauaaagcauaaucaaaauacuuuaauuuagauaguuauguccagcguuuagagaaccuguaguuguuuucuaacugcaaagacuuuaaccaguuggacucuuuaagccuucauaucauuaagcuuguccuggaucacucauuuucucuaguuucucaagcucuuaacccagucuguuguuuucucacugauuauccaaguucuugccuccuguuucauaccuaugauugaagccaccagccaugaacuacaacuuucugcauuaucaccuucccugcuucccuaaacccagcauagcuacauucucauucaagucucagaaggauagcauguuucucuucuauuuaaggaaaauuccuucaucuuugcuccuaguuucauuuaucccuuuuccucugagaucuggaucccaaaauuucaucaugugcucuggcuucagucucucacuuucuauuccguuuucucccacagacugagcaugcuugaguauuuuuaucuauuaauacuaaacggaaaaguccuugacucugcaacccauucuaguuauuguccuuuuguuugccuuuuuacauacuugaagaaauucacauguuccauugacuccucagcccacucuagucugacccccuacagccuucacuccacugauuuuaaccaagaacaucagcgaccucaugcuacuacgguggacauuccuccuccacguuccuucuuguguggugcugcauuauugccaugggccuuacuaggguuccugcaucuuuuaacucccuagcuuccuucaugcccuucuacugcccucuccagcuuucccuucucugguuuaugaacuacucuugccccucccuucaacuguggcauuccccaggacucuguccucacacugcagauucucacugcaugauggcaaagcuuaguuaacacaguugagggcuccccaaagugugucagccuuccaauuucagacuugaauauuaagcagcuggcuucacaucucauucauucagugaaucguugauucaucaauauucugaucaucuaccaucaccagacugggucuuaaaagacugaguaaugaaaauacagguucugcugugucaaugggaaagacggggagaaaaaccagacaguggccacacagugaaucacauauuccaagagaagcaagcaaagggugccgugagcacaaagcaauagugacaaucacugguucuuagggcuuuucaggacguuauucuuaggaccuuaaguuaaucaaacaugcaggaagagagauccuuuuccucauuucucucacauuucuuaccccagucacucagucaccuaaauuuaaacccaguuauccuuggcuucuucgucauguuggguuuucagucagacaccaaguucuacucauuucagucccaagauaggccucaaauccagcccacuccgccaguuguacuaccuccguccugauucaaggccucgucaucuaucaccugcauuacugcaguagacucaggucagcuccaugcuuugaucucauuggaucuaccuuuccaaggccagcaaaaacgggcaccugacuuagucacugcuccgugugaaagucucccaguccugcagcagauguucuccagccucucaucagagucccagaggcagggcgccccuaaaucugucucuauauagcgggucccagcgcugcagauucuaauucuguagagcugcuggacuggaugcuuuguuuuuaaauucccuaagagauuuugacaccugaccagauugagaaacccuuggccugcaaggauaaagucggagcccuucugccugugcaugaggcccuucaugaccuggcuucagcuuagcagucggcugcauuuccugccauguccugugccacccuuuacccucacauuccagcaauauugaaccaugcauucccuuaccaucacgccguuuugugucucccuucauuuguccccucucuuucucuucaccugagugagguaucuuuccuuuguucccauggcagcgaucagugcacagugauauuugccagucauuucagacucucauccucucauuuucuguaucaguuuauuaaagauugcauuagaggguucaacauuaaugucaucuuacaauauacauaaauaagcuuuugcuuuuuucucauaaaugaccuucauuucaauuuauguaggaaaaaguauaauuuaucaacaagugcauuuuuaagugacuuguuugguuuugaaacugaagguauauuaaaauguaguuuguugauuagugauaucaaaaauagaccaaaacaacaacugcuuucagugacccagaguuugggaaucuugaacuuugcauuugaaacaagcugauuaaauuuuauaauuuuuauguuuguaaaugacaaagguuuggggcugccauuuucaagcuuuucuuugcaaguaauuugggauguggauggucuugauucucaguaagucagaaguuaaguugacaaauugucacuguauuuuugcuuuuuaauguuggcuuuugagauauuagauucaucuugauguucuguguaagaauuuugauuagguaaacacaguuuuuggaucugauggagaucacgacagaacuuugcagaaguaucauuucaaagacgucagaaucugaguucugucuugguauaacugguguaaauuacacaagggaugacugugaauuuuaaaaguuauaguggucagaaccaccaccaccuagccuugguugcaauacugauuaugccugccugagucaugagcacauucauuuguuuuucacgaaaagaaagcauguuuagauaguuacacuauuuucugauuuuucaaaaaucacaguugccucuaccaauuuaaaccccaugcuccauauuccagaaguugacgagcccugauugggacuaacguagcuugagaucugaauugcgugacuccagauaaguuacucaaccucucuaaacuucaguuugcuuugcugugaaauguagagaauauuguaccaccugccucacaggguuguuguagguauuaaguaguacuuaccauaaucacuuaguaaaugguagcugcauuauuauuacuacauuuaaaaauacucaccuguuuacuuguccacuuugccauaagacuguaaauuucuggagcccuugacuuuuucauauuugcaucuccaauaccugccuagagucuaauguaguugugauucacuguuuguugaacugaauaaaacaauguccauccaaaaggaaaacagauaugucuagcagaggaacaccagaaagggaacuaaaagggcaaaggggaaaugaaaaggcuuguuguugcagguauuacagacaagcucaaugagccuucuuuucugggccucgguccugcuccccucuaguuggucuuccaccaugucagauaggccagcugggccuagagcagagagaacauuccuucaguguuucacuaauggacucaacauugaaaaaacccaacuuuuugugauaaauuaaauuguauugggugcuaacuuuucauuagucuuugccacacuuuuuguugagcuagacauagcagugaguguccauaagugacauguaauguaaggcuacauuauauggggauuaugcuuuugguauuuauucaaauccagagucuguuauuugaagacaccauuuuuugcagcuuuauuuuccagguccugugaauaacaggacacuuauuuucuuggcuacuuuguaaaguuuuaaaaaaugugauguuuggcugggcgugguggcucacgccuauaaucccagcacuuugggaggccgagguggguggaucacuugaggucaggaauuugagaccagccugaccaacauggcgaaaccugucucuacuaaaaauacaaaaauuagcugggugugguggcgggcaucuguaaucccagcuucuugggagacugaggcaggagagucgcuugaacccaggaagcagaaugagccaagauugugccacugcacuccagccuggaugacagagacucuguuucaaaauaaauaaauaaaaauaaaauaaaauauaaaaauaaauaaaugugauguuuguuguauauccccugagucucuacuauuggaaaucauauguaccucuuuuuuuuuuaaauuuuuuuccucuuuuucuccccuucugucucucucuguuuguucauuuuuuaacacauacaggcuauuauaccuucauuaaugagagcaauggguauaugagaauauguuuaaauucacguauugcugcauuugccagcaaggaccuagacucauuauugucauaaacuaaaguuguguguguauguuaugcauauuuacauuuaagcagauugaagcugaauuuccauugaccaaucucauugugguguaccuuucuggcaaucauguuuugauuauuuucaaauguauuauucuauugcaaauagaucauaucaagugauauucaagaauagugaccacgaaguacugcuuauaaaauauuuauaugaagacuauuucuugauuuuacuucuaggacauucuucuaaguuuuuuuguuguuguuuugagacagggucucacucuguaacccaggcuguaaccuucaccucccaggcucaugugauccucccaccucagccuccugaguagcugggacuacaggcgcaugccaccaugccuggcguguguguguguguguguguguguguguguguguguguguguguguguguauuuuuuuuuuuuuugguagagaugggggucuugccauggugcccagccuggucucaaacuccuggucucaagugauccacccaccuuggccucccaaagugcugggauuacaggcaugauccacugcaccuggcugguucuuuuaagguuuuaguauuagaagaucuuuaauauaagagugcuuuuaccuuauggcuuagcaaaggcuguuaaguauauucuuuuguauuuacaguuuucuaggcuaccaggaguuuucucuauguauaguauuuuuugcuuuaauaucugauucuguuuuuagaagucuuuagaaauguauuuauugaaucuucuaguugucuagguaaaauccaauuuuaugugaaucaaguuagagauuauauuuguaaaagaacuuuugccgggcgcaguggcucacaccuguaacccagcacuuugggaggcugaggugggcagaucacgaggucaggagaucgagaucauccuggcuaaaauggugaaacccugucucuacuaaaaauacaaaaaauuagccgggcguggugguaggcgccuguagucccagcuccucgggaggcugaggcaggagaauggcuugaaccugggaggcggagguugcagucagugagcugagaucgcgccacugcacuccagccugggugacagugagacuccgucucaaaaaaaaaaauuuuuuuuuuuuuuuuugcgaauaguaacauuuuauuuaaauaucuguuacuauuugugauuuauuuccuuccuuuuuaguggaugaugcuggcaaaauagaacacgaugguucuucuggaaugaccauggacacagagucggaaauugauccuuguaaaguggauggcacuugcccugaggucaucaagguguacauuuuuaaagcugacccuggagaagaugacuuagguaagaagaaguguuuagacauuauacauccucauccaaauguuucagccugauuacuuuuggguuauuuagauugagaacauuuggagucucuucugaaguaacuuuuauguaagaauuccgguguaguaauaccaaaguuuguaaaaaguaauaagaaaauuauguaaaaagaaauagguggaaaugcaguuuucaaauaaauuauugaagcugucuucuucccugauugauagguggaacuguagacauuguggagagugagccugagaaugaucauggaguugaacugcuugaucagaacagcaguauucguguucccagggaaaagaugguuuauaugacugucaaugacucucagccagaagaugaagauuuaaguaaguagguggccuuuuugugggagaaaauuuuauguuucuggagcuuuuaaguggccaguguuugaaauaaguagcauuauuuuagagauuauuaugcuacuacauuccaagggaaacaucuuugacucuuuuauauaugcuuaugauguugcuuuaaaaccaaguuauggugaaagccaagaaguaaaugauucauucaacaaauauguauugagugcuuacuacgugaaagcuauguucuagguauguaauauuuggaccaucuuuccauuuugucuauuaacugaauucaaauaaaaacguguuuccugugaucucuguaaaccuggucacagaaguuuuuguaacuuucuacuuagauguugcugaaaucgcugacgaaguuuauauggaagugaucguaggagaggaggaugcugcagcagcagcggcagccgccgccgugcacgagcagcaaauggaugacaaugaaaucaaaaccuucaugccgauugcaugggcagcagcuuaugguaaguugcccagcagcucuuagcauugaagaaguugguucuuaaacaugaauccaugauugaaaaaugguuucuguggucuuagguuucagaagucugaaauaccaguauccuguaaggauuauuugaauugaauuagaguauaaagucuacuuuuugucuuuauuuuuaacaggaauuuccuucauguguauauuauguagaaggaaguacugcaagaaguacacaggcuuucaggcugaaaguuuucaucuugauuauguuuggcccaugacuuuuucauuuugggagacaacaagggaguccauggcgcaaaaaugcugacauguguuuuuuagcuuuggaagcuaggcguuuccuacggucucgcgauaauaaaugugcucauaaaacccaugaccuagaauggggaauuucugucauucaugaguaucauggcuuacuuuucguuguuguaguuaaugaagaauuccuaauucuuuaaaauuuauaauacuguauaauuuuguuuuuuaauacacauuguuagguaauaauucugauggaauugaaaaccggaauggcacugcaagugcccucuugcacauagaugagucugcuggccucggcagacuggcuaaacaaaaaccaaagaaaaggagaagaccugauuccaggcaguaccaaacaggugagggcgcacgaguuccauggcgcagcgugcucugcgagcucucagaggaaacucuaguauguauccacaggggugucacaauggcauuuuagcugcuagaccauauauagcuuugucuauugaacuugaaaauauaauuuucagaauucagugauauucaugaaugauuuccuuggauaaaaagaaacaggacauggcugaaacauggaugagaaaaauugaaaacuuggaugauuuuuauguguacauggaaugaaaucccucaaauauguuauaagcauuaacuuuuuaaauaaauuaauacauuuagagaaucuaugucagcauaaagcaggcauaauuuacagagcagcaggauaaguacuuuaguucauaugacauuccuauucuuguaugaugauuugcguauuaaaaauuuuauggguauauuuaaacuuugcuguaaguuaacguaaguuauguuuuuuggaauaaacaguggaaauuuuugucaccaaaguuuauuuuuaugaauaauuuuccaccaguuuauuuacuuauuuuuuuuugaggcagaaucuugcucucuugcccaggcuggagugcaguggcgugaucucaacucacacugcaaccucugcccccuggguacaggugguucuccugccucaaccuuccaagcggcuaggauuacagaugugugccacugugccccacuaauuuucauauuuuuaguagaggcggguuuucagcauguuauguuggucaggguggucucgaauuccugaguucaggugaucugccugccucggcuuccgaaagugcugggauuacaggcgugagccaccgugcccagccaauuuuccaccaauuucuaaauugcuguagguuuaaucacuaauugauaaaaguuacauauucauuaauuuuauuaaacuagagggagugaaggcgguacagucuucaugaaggaaguuuccagaccauuuucucuaugacuagguugcuauaucucuuguguugaaaaacaguaaaaggaauguuaagcagcaaauaguccaauuuaggaguccuuggccaacaguggucagaacccacacuuuauauucgcaaagaaacuggaacagaacuugguuugagcacucauacuccuuucuuuuccuuuuuuagcaauaauuauuggcccugauggacauccuuugacugucuauccuugcaugauuugugggaagaaguuuaagucgagagguuuuuugaaaaggcacaugaaaaaccaucccgaacaccuugccaagaagaaauaccgcuguacugacugugauuacacuaccaacaagaagauaaguuuacacaaccaccuggagagccacaagcugaccagcaaggcagagaaggccauugaaugcgaugagugugggaagcauuucucucaugcaggggcuuuguuuacucacaaaauggugcauaaggaaaaaggagccaacaaaaugcacaaguguaaauucugugaauacgagacagcugaacaaggguuauugaaucgccaccucuuggcaguccacagcaagaacuuuccucauauuuguguggagugugguaaggguuuucgucacccgucagagcucaaaaagcacaugagaauccauacuggggagaagccguaccaaugccaguacugcgaauauaggucugcagacucuucuaacuugaaaacgcaugucaaaacuaagcauaguaaagagaugccauucaagugugacauuugucuucugacuuucucggauaccaaagaggugcagcaacaugcucuuauccaccaagaaagcaaaacacaccaguguuugcauugcgaccacaagaguucgaacucaagugauuugaaacgacacauaauuucaguucacacgaaagacuacccccauaagugugacaugugugauaaaggcuuucacaggccuucagaacucaagaaacacguggcugcccacaagggcaaaaaaaugcaccaguguagacauugugacuuuaagauugcagauccauuuguucuaagucgccauauucucucaguucacacaaaggaucuuccauuuaggugcaagagauguagaaagggauuuaggcaacagagugagcuuaaaaagcauaugaagacacacaguggcaggaaaguguaucagugugaguacugugaguauagcacuacagaugccucaggcuuuaaacggcacguuauuuccauucacacgaaagacuauccucaccggugugaguacugcaagaaaggcuuccgaagaccuucagaaaagaaccagcacauaaugcgacaucauaaagaaguuggccugcccuaacaauacuucuacagaacguuuguagagauauuggccuugaagcagaaaauucauuuuaaagccaaucagucucauucacauacaauacuguauauugauuuaugcuguguacaaauagaauuauuacuucuaguugacuuuuuuuuaaauauacauuuugcucaguaguguguucugaauucuauucaguuuguuuaauaaauagggaaaacuggcaacaugcuaguuacuuuuaauaaaguaaucccugauucuauaccgaaguuuuauaucuuagaauuuuauauuuauuuaaauauuuaccuugcuuaccuugaugguacucuucuaagaccauuaacuuaagguaacuuuauauugguaacucugaaaguauucauguugacucauuuuuuuccccauacauuucucacaauaaaauugucagagacaucuacuaauauaaaugggagauuuuacagucaggucuaauuaucauaacauggaagucauuuacuugucuugcuuaauauuuucagaccacuugacagugaaaguuuccauuugagcuguugcgucccuggcuuugcugaguaaagagcaguggcuggguucguguuuacuuuucaaauauacuucuuuuggcuuucuuuggauuauuuacaucuuuugucagcguagcaaacuuuuagaaaaccuuauugaaaaacugugcuugcucauguuguauuuugauuauucugucugugcggcuucaucuuggaaugguugugugcuacaaaugacacuuacugaggacugcauuuuggaaucuccuagagguaacucauggcuuauaggaucuuuugcaacuuuauguauguaaauguacccugaauuauauauauacacauauauaucauguaccuguguguauugcuuauuuuacauauuuauacacacaaccccaaguaguaguuguuuaaaaucuauaaugaaaaguauuaaauuuacaauaacaugaaagauccagggaugcaugagagagcauuuuguaagucaugcucuucagagagacuacucaggugaagaauuagaaggaaaauaaggacacuaguauuuuuaaagaguaaagauauuuucuuuuaaauaucuuugguaauugaaacauagagguuaagauguuucuagguagaauguuuucauacaauuucaccuccaugucuuuauguuuuucugaaaagcaaaugaguauccagacaugacucccacaguucucuuugagaagccugagagggaacucugucuuaccuagugagggggauggaaaagaagugauggcucuguggaccagagaacgggugcuaauuaugacuucacacucggcaaguucaggcugaucuguuauuucucaguuacaguuagcaaacuuuaaaaacuuaacacucaaguuggcuuugauuaaaagguaaagauguguuuuaaguggauaaggaaagucugaggccuuauuuggaacaucacuaagucuuccacagguuuuuuguuuguuuguuuuuuuuuguuguuuuuuuuucuuaagacggagucuugcucuguugcccaggcuggacugcaguggugugaucacugcaaccucugcagcucacugcaaccucugcuuccuggguucaagcaauuaucugccucagccucucgaguagcugggauuacaggcgcccaccaccacgcccggcuaauuuuuuguauuuuuaauagagaugggguuucaccaucuuggccaggcuggucuugaacccugaccucgugauccaccugccucggccuuccauagugcuggguuuacaggcgugagccaccgugcccagacaccacauaggucugaaucagugucauacauucauaaaacaaacucgguuaauuagaacuugguuauguuaagacgaaucugggagaacagaaaacaguuuuuggggucccuucaguuggcuauugguccguaugcaucuagcacauuguaggagauuuagaaauugucuucccacccgauagcugccuugucaccucauuauggugcuccauccccugugugcuuagguuuuuaccuuucaucuuucucuuugccauugauguuuguauucaagaguuauauuuuuaggguuagaaaucaaaauauuugguguuuggcaaaccucugaagugcuagacugauuuagucuaguuuuaaaccaagugcuuuaggcaggugugaacuccagcccaaaugccagucaaagucaaggcauggguuuuccuagccuaucuuauaggaaauuccuguaccuucuuggcccccauaauguguuuuuuuuuuuuuuuuuuuuuuaaacuaacuuacaauuuugugauccgugauucauugcccugcgauucuugaaagcucugucuguuuuuuugugagaaccuuuaaaaucucccuuaauuuuuauuuucccagaaauaauguaaaaacacuuaaaugaaaguggaaauguauuaauuuuaaauccuauaaaauuaauacagaaaauauaaaugauugggucauuuaacuauauuuuuuuaaauaaacugaaagauaaagaacacaacacuucacacauuuuauauuucucuuacauacuccggaaucauacacaguucuuuuuaaagcacaacauuaaaaccuuuaaaagguauuuaaggguuuggucaagugaauaugauaaaacauacuugucuguauaaagagaaaaugaaauuguagucacuguuauguacugacauuaguuacaaccuaguuuuaauucuuaaaacaauuuugauuagcaaagcuaaaaaaaaauggauguuucaguuaaauguuuuaaagagguacagauuuuuacaaggacauaauauaaguuauuguucuguagaaauauccuauuaaauauuguaugucccucccucuguacacuuuguaaagaaaguaaaauacauaaaaagaaaaucauauagggaugugugacauuauuguaauuguguacuugagaauaacgugcaaaaauaaaaaucagaauauuuuccuguuauugaauguuuagucuauuugauaccaguacuaaguuaaugcuuuuucucaaggaaaaaaaauguacaguuuuuguaaaccuaauaaacaucaaaagcaguggauuauuuucauccccccauuucuuaauuucuuuuucacagcaguggaaugcaaagugcuugauugcuuugaauuuugugacucggaugcaaauacugguaauauuucaguucugugaauuugcaaguaauauuucagagaaguuaagaggugauuggugaguccuuugaugagcauguccuuggaauucauuuuuucuuuuaucuucauaaaggauuuguuuuauuagcaucuccaauuccccugagauaaauuacucaugcauaaagugguuuuugagagcacuuaaaguucauuucaguauuaauuuacagcauauuuaaucaguggggacuguuaccaccuccacaacagaaaucaugcccucgaguuaccccacugcgcccaguuuagaggacuaguagaugcuaacauacuagggaauggucauugccacaguuaaaaaucggcaguuaaguaaaugucaggagucaaaagagauagaguugugccaucuuugauuuuauagacaagauucugcaguucuuccaacuguaugaacaaacguuugccuaauaguugaaacaauaaauuaaaauuuuagguaaaugacgaagggaauguggugaaugucacuguccagagccauaaaucagacaaaaccauacauagcaugcugaaaaacuuuuguaauggaacacccaacaaaugacaccuaaccugucugugauccaacaaguccgauaacaugcugcuguauuuguauucucugggaaucucaguauuaauaauuucauuucccacaaauucuagcauucauguaaggaaaaacauggcuaaucaauaucuuaaaggggcaaucuuucagagcagugguuuucaaaguauggccggacagcauuggcagcaucuuaaucuccugggacuuuguuaaaaaugcaaauucucagccccacccuaguccuacugaauugggaaacuggcgugggacccagcagucuuuguuuuaacauguucuccaagugauucugaugccuguucaaacuugggaaacacuuuuagagcacuugaggaaccuaaaagaugacugguucagcauuuugugugguagauaagaaagaaauuaucacaaaaaaucagaaaugaacagugagagaaaaauaggaccccagacaguuuauaccuuccauuugcuguuuuaaaagugugagccugccaagucaacaaguaugccuuuagcgcacauguaaauagccugcacuuccuaaaucucguguggccucccaugguuacauucuucaaagguaaacugaguugagaggaagauucagcauuuaaaagagaaggguugaaaaagauuguguguguguguguguguguuuaauuggcccaggguuacuuaaauaaaucauaaccauuuugccacauucuguaacuguuuagcuaaggucaaauuaaguuuacccuauggauuuuguuucaucuuuuguuucguguauauacuguuugccuuuuucauaaaaaucuuggauuuguuauauauuguuccuguuauuuuugacaucuuugcuauuguaaauaaauuacuauuuuguuuuaaguuacccuaguggaguguuggcuauagacaagguauauacucgaaacgaggagacuuaaaucacacaguuaaugaauucccaacuuguuugaagcuggaggugauucgacucccuucagugguucaacacuaauaauagcaccaaggaacaugucacuggugcauauagg

SEQ ID NO: 192839 - RNA, 23863 nt, Homo sapiens
uuaguuugauuuagaauuguuuuauuuguguuccucaugcuacaacacaaccuucaaagucagcgaaguuuauaacauuaauaugcuuccucaaaacaucaauuuaggcaacccauagccagagcuucuaaacuucuacaaugcaacuucaacauucacaagagcacaauaugcuucaaaucccaucucaaugcaaauuuaagaaaagcaaagcaaauuguauuaucagucuaccaaaacucaguaagauucuguaauuuaauauaccuacuucucaacucucuaaauuuguuucucaacacuggggaguuuuuaaagauaucaaugccugaauucuacuccaagccaauuaaaucagaacaauuaaaaucagaaucucuguggggcaucuuuuuuuuuuuuaaagcuuccccagcaacgucagcaagaguugcaaaucacugcucaacagaaccucuuacgaagcaaaaacauaaagaaaaauaagccgggcagaguggcucacgccuguaaucccagcacuuuggaaggcagaggcgggcggaucaccugagguuaggaguucaagaccagccugggcaacauggugaaaccccaucucuacuaaaaauacaaaaauuagccggguaugguggcaagugccuguaauaucagcuacaugggaggcugaagcacgagaaucacuugaaucagggaggcagagguugcagcgagccaagaucgugccacuguacucuagccuaggugacggagugagccuccgucucaaaaaaaaaaaggaaaagcacacgaaguauagggacauggggaauaaguuaaaaaucaaaaggacucacucauugcuuucuaacaucuuuuacuucuugaccuuuugaaacauccaaaaauuaguaguaguauaaucuaugucacaaucauaauauaacaguuaagaaaaaacauaaaaugaaggccuaaaaagaucuuuguuacucaucuagaauuauuugguauaacaguauuuucccauggaggaagacuuggauuucaggcauuaaacaacgcagaaaaaaaucucaaggcaucacagggagagggagauaacuuuugacucugguuucccguguuucaggccaggaagagcaaggggagaaaaauauuuguccaugggaacaaguaaucaugcucuaaaggacaauuucauucgaauccauucauuuccuuuucaugcaaaauuucaaagauaaagcaacauaaaauauggggccacauaaaagggagaaggucuucaaggagaauuugugccuuuaaguuuuuacugguacaacagucuuucagccuggagguacucaaagacgaaucaugaaaaagaaaaaaaacuuuauuucaaacagguucagugauauaugugugugcuacagcaaaggcugguuguggcaaaguuucauuucaaacuguaugaugugggcugggcaagguggcucacgccuguaaucccagcacuuugugaggccgaggugggcugaucacccugaggucaggagagaccggccuagccaacaugcugaaaccccgucucuacuaauaauacaaaaauuagccaagugugguggcgcgcaccuguaaucucagcuacucgggaggcugaggcaggagaaucgcuugaacccggggggcagagguugcagaucacgccacugcacuccagccugggugacagagccagacucaaaaacaaaacaaaauaaaacaaacaaaaaaacagaacugcaugauguauaauuuugacauuaugugggaauguuuaacuucugccaaaauguagauucaauccaacauuaugccaauuuuuauauuaauuuuagucccuaaguuuucauaaccaaaaaaaaaaaaaaaaaaaaagagaauaaccuuaccguuaccuacuaagguaacgaacugugaaaucaauuccccaauauugcuuugaaaauaaaccccuugguuguuaagaggaauuccaacuuccaaauccauccgaauguauuauuuaacugguauucuucagucaucaucuacuguuggcuugauugucacuccucuucuuaucugaccccaaccaauuaaacugcaaaaugaaaauaaaagaaaucauaaaucuuacauccacuucacucucauuaccacacaaucuugugauaaauuuuaccugcuuaucuucugaauucaaauuuguucccaaagccugcuccuccauaaagaaagcccacacuauauucuuagauucuuuuuuauucuugcuuuuguguguuuuuucugagacagucucacucugucacccagucuggagugcggugguacgaucucggcucacugcaaccucuggcuccuggguucaaacaauucucaugccucagccucccgaguagcugggacuacaggcaugcgccaccaugcccggcugauuuuuugguauuuuuaguagagaugggguuucacuaugucggccaggcugguugcgaacuccuggccucaagugauccgcccaccucggccucacaaagugcugggcuuacaggcaugagccaccgugccuggacugaaaguuuauugcuuaaaucuauuucaaaauacacuggaagucgugugucuguaauagcaaaaaaauauaaucacaaaagacaguaaaaucaaaagggcauaagucaccacaaauaauuauuuacuuaagagacaacaaaaauuuaacuuucuaaauuacagggcaauaauucagauaaaucuccuggacaagugaugagaccaucgugggcacaguagcauggaagccuuaauaaaggaaacagggcugggcgggguggcucaugucuguaaucccaacacuuugagaggcugaggugggaggauggcuugaggccaggaguuugagaucaugcugggcaacacagugagaccaagugucuacaaaaaacaaaaaaauuagcugaucacgguggugugagccaauaguccuagcuacuuagacacugaggcugcagugagcuaugaucaugccacuaaacuccagccuggucaacagagagacccugccucuaaaaaauauaaaauaaauaauuaaggaaguagauaguggguaggggugaugugaauaauuauggggacaguuagggcacaaaacagucuaauuuagaggguuuauauaagacaaugcagaaggaaagcuuaaauggguugaagcagguuucuagaaaagucccaaauaucaaaaaguagugagaagacucuagaaauuauuaaacacagcaugaugaaaauguuuuaagaagacuaauuuugaccaaguuaagaggcaaacuaggagucuuucgcacuaacugugaaguguaaagugauggugguauggacugugaugaggugacgaggaauggaaagcaaggggcaaacucaauaaccugggaaagagcaaaaagucaggagccaaaaauguguguaugcuuccuggcucuaugcucucaaaagaccuagaagcaacagcacccuaagagccaugagcacaccugaacacucagcuuuucauuuauaagagaaauggccaguucuaaaacuggaacagagaagguacaagaugagucuggaagauuuugugccagaaaauaaggaaauguuccaaaaaaaagaagaaagaggucaggcgugguggcucaugccuguaaucccagcacuuugggaggccaaggagggcggaucaccugaggucggggguuaaagaccaggcuggccaacguggugaaaccccgucucuacugaaaauacaaaaauuagccgggugugguggcgugugccuguagucccagcuacucgggaggcugaggcaggagaauugcuugaaccugggaggcagagguugcagugagcugagaucaugccacugcauucuaccccggcgacaaagcaagacuccaucucaaaaaaaaaaaaaaaaaaaaagaagaagaaaaaaaaaugaugaguacaugucaaaaggacacaagagccagccugaaggaccuccacuggccaaacgucgaacaaugcacaucaaaauaaaggaagacagugauggaucauaacauguugaauaaaauaggacuccaugaguccauauuauaacuagauagggaaauaaauaauggcaaagaaagaaugccaaaugauaaauguggggugguagaguugagggaggauacugcaacccguagaggugcuaugauuuuguaaucauuauagucaaguucgauucaggcaagaaucaucaguggaugcuacauccaggggugugggauucaaugaucagcaggcuauuuguacuggcuagaaagaucucccuacagauugcuuauuaguugcaaggguagagaguaacuacacagcagagaagcuggacaacaucuugacuacauagucaaaacuaaccuuaacaaagaggagcagucagauaucaugugccucuagcugugauuccugaaaaggagacuucacgguguauuuaaguuaagaauauauaacugaaucuaauguuaggcuuccgaaugauaagaaaaacccaaauugaggaauauucuauaaaguaacuaguuuguauucuucagaacuguuaaugucaauuaagacaaaggcugaaaaagcuccagauuaaagaucaaagagacaugaaauuaaaugcaauucaagauucuaaacaggaggaacauaaaguacauuauugggacaaguaauaaaacugaaacaugcacuguagauuucaguauuuugccaauguuaaauuucuaagugguuacauaagaauauccuuuuuugaugggaaauauacacugaaguauuaagagaucaagaagcauaacauauauagccuacacucaaaugguucagaaaaaaacuuauauauguaaauaaaucuguauguguguuugucaaucuaggaaaaagcuauagaggaguuuucuguaaaacucuuacaauuuuucuauuaagugugaaaugauuuccaaagccaaugacgauagaaauaccgaacccaaauucauuugguuuugcauagguugugucuaacaggaagagaagccaaucacaguauuuggacuaaaauaugggacuauagucaagguuguaguuuuuucugagacggagucucgcucugucgcccaggcuggagugcaguggcgccaucucggcucacugcaagcuccgacucccagguucacgccauucuccugccucagccucccgaguagcugggacuacaggcgcccgccaccacgcccggcuaauuuuuuguauuuuuuaguagagacgggguuucaccauguuagccaggauggucuugaucuccugaccucaugauccacccgccuaggccucccaaagugcugggauuacaggcgugagccaccgcacccggccgaaguauaguuuucaaagucauccaaauaaauaguugagacugaaagccacaguaacuguuguccucaaggaagauugugugcuuuuuuuucuguacaagacugugucuuuuuuuaauuagacaguggcaaagacuaacaaacuuaccgccaguguuuuucaacucuucggcuaagggcaauuuuuucuccuaccucugugcacacuggauuggucaaaacaauuuuacccaaaucggccuugacagcacuaacucucccuccuguugacagggauccuauguucaccaugagcacuucauucuuagacagcuuuugaaccuagaaaaauaaauuagggaaaaauaaaccccaaaaucaagaaaaugcuuuccaaauguaaguaagaauuuaccaaauacuauugggaaauaugucaaucauaaaaaaaauucuauagaaauuucauuguaaaggaauuugaacuauauauaguauaguuuauuuggcacccacugaauuuacacaagaucuaccuuuaaaaaauaggguaguaaccguaccagaguaccucuuaaaauucugaagcaguuaccuaguacaaaugagguacaaaauuucccaaagaggggagcaugaaggacuauggcuauauaagaguuaauaugggccaggcgcaguggcacacgccuguaaucccagcacauugggaggccgaggaaggcagaucaccugaguggggggaaaaaaaagcaugauagcuuauuuuccucaaucuuugccaacacuaggugucagcaauuucccaucucugccaaccuaaucugggacauuuuuuaaaaaucaugaagcugggcgcaguggaucacaccuguuaaucccagcauuuucggaggcuggggugggcagauugcucaagcccaggaguuggagaucagccuggguaaugcggcaaaacuccgucucuacaaaaaauacaaaauuagccaggcguggugacccacaccuguagucccagcaacucaggagguuaaggugggaggauggcuugagcugggagaucgaggcugcugugagucgagaucgcaccacugcacuccagccugggcaacagagcaagacucugucucaaaauaaacaacaaaacaaaaauauggauuuuaggaauaucaugucuuugucauaaauggcuaauacuuuucccuguuuauuaaguuucuuucuuaaacuaacugccauauaguucucaauuuuggccggacgcaguggcucaugccuguaaucucagcacuuugggaggccaaggcgggcggaucacuugaggucaggaggucaaguccagccuggcuaacauauagugaaaccccaucucuacuaaaauauacaaaaauuagcugggcgugcuggugcgugccuguagucccauauacuugggaaaccgaggcaagagaauugcuugaacccaggagguggagguugccgugagccgagaucgcgccacugcacuccagccugggcaacagagcgagagacuccaucucuaaauuaaaaaaaaaaaaacccucaauuuuggggaggucaaauuuauuuaccuuuucuuuuuuucuuaauuucauguuaacuguaaaacaauaaaacucaacacugguuuaacacucccauuugucacuuuuuuagaaacaggaauuuuuaaaaaagcauuuaccuuugcugcuuucuugucuccuucagugcguacaccuagaagccgucuaagcaggaaauaggaaauuuccaauucugugaauaucucagguaaagcuccgacugcaccaaguacuugccccaccauucugucagcccggcacaaaguggggucaauuuuuguuccaacuccuauauaaaaauaagauguauauagcucaauuuuuuauuuccuaaaacaccuauaaagugaauuaguuggccaggugcaguggcucacaccuguaaucccagcacuuugggaggccgaggcagguggaugccugagcucaggaguuaaagaccagccugggcaacacggugaaacccugucucuauuaaaauacaaaaaauuagccaggcguggcggcgugcaccuguagucucagcuacuugggaggcugaggcaggagaaucacuugaacccaggaggcagagguuguagugagccgagaucgcaccacugcacuccaaccugggugacagagugagacucugucuccaaaaaaaaaaaaagugaauuagauaccccaaagccauauaagcacagcauauaccuacacacuuucauacuuuuauuuuuauacucauauaauagcuauauagguacaagaaaauaccuguuuuaucuagacaaauagaaauauacacucaugagaugacugggcaaaugagaacagaacgauucucuugauuuaaauucuaaacaaaggguuuagaaaucugauuuucuaggaaugauggcuuggcugagaacuuaaugcaggagaugguaaguauuacugaccuggucuugaaaacaauaaauucuaaacaaagggcaaauagagauaauaagugaacucaaaaugaguccgaauauccuuaacaaagaccgaaagaauacaaaauucaaaaugaguaguuugcagaauaccugcaugccauuucuccccugaaagacugauugaaaagauaguuaaagacuacauaugggccaggcgcaguggcucacacuuauaaucccagcacuuggggaggcccaaguuggaggauuaccuaaggucaggaguucaagacaagucuagccaacauggcaaaacccaaucucuacuaaaaauacaauagcugggcaugguggcagacaccuauaaucccagcuacucgagaggcuaacgcaggagaaucacuugaaccugggaggcagagguugcagugagccgagaucgugccacugcacuccagccugggcgacagagugagacucucaaaaaaaaaaaaaaaaaaaaaaacuacauaugauuccugggaucuacuucaaaauauucuagcugugucuugaggggaguaggggaaagaagauauauagauggagcaagauugauugggaaaacuuuuuuuugcugcuguuguugagacacagucucugucgcccaggcuggagugcaguggugugaucucggcucacugugaccugggauuacaggcugggauuacaggcaugugccaccacaccugacuaaauuuuuuuuuuuuuuuguauuuuuaguagagacaggguuuuucgaacuccugaccucaggugauccguccaccucggccucccgaagugcugggaauacagacaugagccaccacgcccagccaagacugguaaaacauuaauaauugcugaagcugagugauggcucuauggggguuaucauuacaguauucuauccuauguuuaaagaguuccuuaggccaagugugguggcucacgccuguaaucccaguauuuugggaggccaaggagggcagaucacuuaagaccagaaguucgagaccagccuggccaacauggcgaaaccccaucucuacuaaaaauacaaaaauuagcuggcuguggugguaugugccuauaguuccagcuacucgggaggcugaggcaggagaauuaacugaacccaggaggcaaagguugcagcgagccgagauaauacuacugcacuccagccuggguggcagaaugagacucugccucaaaaaaaaaaaaaaaaaaaaaagaaauuaaaaaaguuccuuaaguuaaauuuuuaaaaaguuuccagauuucccuuguuuaccacacacaugcacacaaaagauaaaaugauagauggaacuacaggcacacaccaccaaacccagcuaaucuuacuauuuuauuggagaaauggcaucucaugguuuccuaggcuggucucaaacuccuggucucaagcaaucuucccaccucagcuucccaaagcacuggaauuaugagcaugagccaccauacccaaccugguaaauucauuuuuucuuuucuuuucuucuuguuuuuuuuuuuuuuuugagacagagugucacucugucacccaggcuggagugcacuggugugaucucggcucacccuccgccuucuggguucaagcgauucucaugccucagccucccgaguagccgggauuacaggcgugggccaccacacccagcuaacuuuuguauuuuuaguagagacaagguuuuaccauguugcccaggcuggucucaaacuccugagcucaagcgauccacccaccucagccucccaaauugcugggaucacaggcaugagacacugcgcccagccaaccugguaaacucuuuuucauuuuuuuguuuucuuuuauuuccuuuuuaaaauuuucaaccagagacacaacuuauugggugaagaauuaacuguuucuuuaccaaacauuuucuucuuuaaucuaaagguacaacaccccuucuaauucucacugaaucuuucauuuuucuggguauugaguaauacacuaaguuguaagggacuagaaaaguuuuuaaaucacuucaguaauugcuacacaaagaaauuuacuuucuuuuauuucuaccucauuggaaauacgaccugauaucauucaacugacauuuguagguaauuuuccauuugcaaaauauacauaaaagcaaccauggccgggcauggugguucacgccuguaauccuagcacuuugaaaggccgaggcagggggacugccugagcucaggaguucaagaccagccugggcaacacggugaaaccccgucucuacuaaaauacaaaaaucuuagcugggccuggcagcaugugccuguagucccagcuacucgggaggcugaggcauaagaauugcuugaaccugggaggcagaggcugcagugagccaagauugcaccacugcacuccagccuggaggacacagcgagacuccaucucccaaaaaaaaaaaaggcaaccauuaucuagcacaaaaaucauguuaacaaaaacauaaguguagguaaauaucuuacaugauaagucaucaaauuuauuuuuuuauauugcuaaaaaggaguuacucuauauuugaucaaaauguauccuuuguguuuaaaaauaauuuuuacaaacccaugaaaccaucuuauaaccuaaaacaagagcuuaaccacaugauuguuccccacccuacucuauuauuaaaauacccaauuaaaaaucuguaauaugucccuuuugguaauccaucccccaugaaaaguaccacaaauagccacaaauuaaaagagaugagaaaaaaauccuuaccaauaagaccgccuggagcagcauauugcagaucauuaugcuccgcaaaaagugauacaauuuuggaaaagauugguuuacacaugaguuuuccuucacuaucuuuggaaacaauaccaggucuuacuucuaucuccuggcccaccuguaaacauauaauuaguaauuagaauuacuguguuacgcaaaauuaucauuuaccuaucaaaaguuccaacagggacugggugcgguggcucacauguguaauccuagcauuuugggaggccgaggcggguggaucaccugaggucaggaguucgagaccagcccagccaacauagugaaaccccgucucuacuaaaaacacaaaaauuagccaggugugguggcacgcaccuguaaucccugcuacucaggaggcugcggcagaauugcuagaaccugggaggcagagguugcagugaaccgagaucgcaccacugcacuccagccugggugacaaagagagacucugucucaaaaauaaaauaaaauaaaauaauaauaaagguccaaccggaagaccauaaaacugaaaaggcaaucauuccuguauuucaaagaucauuauucuuaaaaaaaaaaaaaaaaaaagaugugaacgagacugucaaaaccagaaccauccaacuguuguuaacuacccaccacacaagucuauuaccacaucaaaugugcuccauacuuacaagucuauaaauuuucaagucagacacauucaaaagacauaacagaaaacaaagaaauauagcugggcgugguggcuuaugccuguaaucccagcacuuugggaggcugaggcaggcagaucaccugaggucaggaguuaagagaccagccuggccaauauggcaaaaccccaucucuaccaaaaaaauuagcugggcgagguugcgagugccuguagccccagcaagucgggaggcuguggcaggagaaucaucaccugaacccaggagguggagguugcagugagucaagaucaugccacugugcucaaaaaacaaaacaaaaaaaaaacuauuaucagagcauguaaauuaguauagcuaccauggagaacaguauggagguuccuugaaaaccugaaaauacagcuaccauaugauccaucaguuucacuaguggguauacauucaccagaaagggaagcaauauuaucaaagagguaucugcacucccauguuuauuguagcacaguucacaauagccaaacauggaaucaaccuaagugcccaugaacagaugaauggauaaagaaaaugcaguauauaggccgggcaaaguggcucacgccuauaaucccaacacuuugggaggccgaggcggguggaucacuugagguaaggaguucaagaccagccuggccaacauggugaaacccugucuuuacuacaaauacaaaaauuagcugggcaugguggggggugcuuguaaucccagcuacuugggaggcuggggcagggagaaucgcuugaacccaggaggugaagguugcagugagcugagaucgcuccagcuugggcgaaacagcaagacuccgccucaagaaaaaaaaaaaaaagaaaagaaaagcaauggcagcauauauauauaugcaaugaaguauuaugcagccauaaaaaaaaauucugccauuugcagcagcacaucuagaauuggaggccauuuuguuaaguaaaauaagccaggcacaaaaagacaaauaucacacauucucacucaucuguauauguggaagcuaaaaagguggaucucaugaagguagauuguggauucagaggucuagaagggugggaggagugaaguuugaagagagaaaaaaagaauauuaaaaaagagaacucuacaucaaauaccagaaaccauggaaaaaauuuuauuuuucaauuuggauuguccauacuuuuuuuccugauuaagacaaggauaaaacaaacaaacaaacaacaaaaaaaaaaaacccaaaaucacaacaaccaaaacccauuuuaccuuuaauacuccuuuuaggauacuaccaccagcuacaccucccuuaaggucaucaacuucacagccagguuuguugacaucaaaagaucuaauaacuaaaauaaaacaaauuaaagucaguucuguuaaucuuaacuuuagaagaaauauuauuuuccauguuaauguuucuaaaauaguggccauuugagauuuauaccaaaggggugccuuuuuaacaaaaucuauuauuauuccaaugauuaagcagucuuacuuaugauggaaaaaaugaaaguaacuuaaguuuauuaauaaguggcauauaggguauaccaguauuauagagcaucacgcagcuauuaacaauguuagagcuauauguaaugaucuggaaggaugacccucacauacuguuaagaaaaguuauaaaaauuacacgcauaauauaaucccacuuccauaaagaaaaauaaaauaaucaaugucuguauauggauuuuuuuuucccucuaucauagaggcuggagugcaguggcacaaucauagcucacugcagccucaaauuccugggcucaaucuuccugccucagccuaccgaguagcucggacuacagguacacaccacugcacccagcuguaauauuuuauuuuuuguagaaauggggucuucccuuaaugcccaggaugguccugaacuccuagccucaagcaauccucucaccucagcgucagccucccaaagugcugggauuacaggugaaagccaccaugcccagccuguguauauguuuauacacgaugauaugaacaaagagaaaagugugggaauaauggacaccaaauguuaacuuugcugacuuuagggcuaaggaacuagaacuugaagacagagagauuauggacauuuucuuuauagaccucuguaacuccuguaagaacaauucagcuuuauaacuauaaaacacuaggacuacaugaccugcacuucggagacuauuuccuacuaaacaccagaagcucggaugaaagccagaggagcucaaaugucuguuucgagaaggcuacuacauccccguguaggaaccacaagccuaggugaucaaauuauaccaguaucaguucuucguuaauugaacaacaaaaucaucuguaaauguuuuagucaggaaguucuaacacccuaaaacauuaugauuccauggagaauacuguauuacuccaucuugaucauguaccauauauuaagcacagaaagguuagcaguuguuuuuggguuuuuuugagacgcaguuucacucuuguugcccaggcuggaguacaauggcgcgaucucagcucauugcaaccuccgcuucccggguucgcgccauucuccugccucagccucccgaguagcugggauuacaggcacccgccaccaugcccaguuaauuuuuuauauguuuaguagagacaggguuucaccaugcugaucaggcuggucucaaacuccugaacucaggugauccacccaccucggccccccaaaguauugggauuauaggcgugagccacugcgcccggcuuagguuaacaguucuuacuguguucaggacucugucccucauucaguaauacaaucuagcacugccaauacaaucucagaauugauuucaaaaaaauuguaugaauuaucaccucugcagaaagaggaaauauuaauaaacauccuugaagaggaaucaccaauguggaaaagaucagauuaagaguuaaaggcaaauccuaucacuuaccaauaagccggggcucugaaguaaagucucuuggggguacuggaauuuucuuuacuauguacucacaaacaacuucaauauuguauuucagcugagcugaaauuggaauaaugggagcucccucugcuacuguaccuauaugacaaaauuuagaaagaucaaaauuauacaguuuuauaaaauuuauucuauguaucuguuacauaaaacaauuaagauuacuauaauaaaauagaugccuaaaccccauauaaaugucagcaacaaguggaaaguggauaauucuguuuagaaagauggcaauauuguuuguuuuuacuccugaaaaugaauacaaaucccuguaagagaaaauuuguuacauuauauuaguagacauacuuaauauuaguacaaugauaaacuuauuuaaauaaagaaaauacuaacauuccugugaaagagcacucuacuaguugaaaaaauuucuaacaacauguaauuaaucucccaauaaaugucaagauaaaauuacagacucugcuaaucaaagacugcuggcauauauacuuuuuuuuuuuggagauagggucucgcuuugucacccaggcuagacugcaguggcauaaucacggcuuguugcaaccuccacuucccaggcccaagcgauccucccacuucagccuccuacauaauagcugggaacacaggugugugccaccaagcccagcuaauuuuuuguauugacagaguuuuaccacguggcccagguuggucuugaaccccuggacucaagugacccacccgccucagccuccuaaagucuugguauuacaagugugagcuaccacgcccaaccauauauauuugcuacguauugauuauacgucaaacaagcuagucaaagaaauagaccaaacacaauuagacuuuaaucaaauucacuuauuacuucucgugaugacagaacugaguucauaagaaauuaaccuuucuaaaaagaaaaacaagacugagagagaaaaugucaacaauaaaucacaucuccucugaaaugaaaaacauuaugcuauuagagaagggacacucuagagauuuauuauuuauuuauuugagauggaguuucgcucuuguugcccaggcuggagugcaauggcgugaucucggcucaccgcaaccuccgccccccaaguucaagcgauucuccugccucagccucccaaguagcugggauuacaggcaugugccaccacacccugcuaauuuuguauuuuuaguagagaugggguuucuccguguuggucaggcuggucucgaacuuccgaccucagaugauccaccugccucagccucccaaagugcugggauuacaggugugagccaccaugcccggccgacacucuagagauuaaauaaucacugucacuuccaaaucugaaagcuguucaguaacaaauacuguaagacaagguuuuuuaaaauuauuuuauucauuuuacugucacugagauuuuuuuuaaucugauugauaaaguuuccagaaaacaaccucaguucuaacuugcugccagcaaaaauauacuuuaguauauuaaauucagaaucacagguuucauuaguuauaucagguuacuaacaagcaaaagguagggcgauaaggcuuaagacuuguaaguuuaccuuguuuuagauaauauauuaaaaguuaauuuaacaucugguauccagaguaaaugccucucaaagugauucauagauuuauuucauauuauggcuucuuaccuuggacaaaugcaaggaucugcucguauuguucuuuagccugacuuucuuuuaccaaaucaauuuuauuuuguagaaucaaaauaugcuucaguuucaugaucucuauagcagccagguguuccgaugucugaggcugagggcaagauucauuaccagcuaguugaugaagaauaaaaaagaugcauauaagaauagcuggaaauauccagaauaggcgggcaaauccauaaagagacaaagcaaauuauggguugcaaggggcugggggaggaaaacauguggacugacgcuucaugggcaugggguuuccuuuugcggugauacaaaaguucugauacaaaaguucuggaacuagauaguggugaaaugacaaccacuauguuguagaaaauugucaaugugcuuaaugccacuaaauucuacccuguaaauacauaaaaugguacauuuuaugagucucuuuugccacccacuccccgccccaaaaaaaguuggcaucuaauaaaggagacuucugaauguucuaacccuaauaaggaagauauuauugccagguauccaccuuuuggcccugcuucauccucuguugccugcauucacuggaaccucccaauuguguggcucccaauccugguccuaagcaagaagcuuaaaaucagcaaguuuggcuuuucucagggucugcacucagcuuuugcucagguaugagguauagcccucuaacucucuccaguuuuagaaauguucuggcccaggcaagcuccugagaaguagagaguaauuaaaagggaaaagcacuuaauacugucuaugaauuuuuacuaauaucagaggcuacucuucaacugagggagggaagaaugcuauugugaagauaaccaacaguguauuauaaagaaauaggcauguuuuguugagcacucuaaugaucaaccuccucaagucgugauauucaaguguccugacuauaccaacauggcaugcuuuaaaaaaaaaauuuuuuuuuugagacugagucucacucugucucugucacccaggcuggagugcaguggcgucaccucggcucacugcaaccuccgccucccaaguucaagcgauucuccugccucagccuccugaguagcugugauuacaggugugccccaccacacccggcuaauuuucguauuuuuaauagaggcaggguuucaccauguuggccagacuggucucaaacuccugacaccucaagugauccaccugccuuggccucccaaagugcagggauuacaggugugagccaccgcacccagcuuuuuuuuuuuuuuuuuuuaagacugagucuccuucugucgcccaggcuggagugcaauggcucgaucucugcucacugcaaccucugucuccuggguucaagcgauucucgugccucagccucccaaguagcugggauuacaggcacgcaccaccaagccuggcuaauuuuuuguaguuuuagcagagacaggguuucgcccuguuggccaggcuggucuugaacuccugaccucaagugauccgccugccucggccucccaaagugcugggauuacagccaugagccaccaugcccagucgcuuuuuuuuuuuuuuuuuuuuuuugagauguaguuuuacucuuguuacccagacuggagugcaauggcgcaaucuuggcucacugcaaccucugccucccggguucaagagauucuccugaguagaugggauuacaagcaugcgccaccacacccggcuaauuuuguauuuuuaguagagaggggguuucuccauguuggucaggcuggucucaaacuccugaccucaggugauccgccgaccucagccucccaaagugcuaggauuacaggcgugagccaccgcaccagcagcuuuuaaaaaauuuuacccccuaguaaugaaaucucucaacagcuaacauaagaaacaaagcauacgcuacccuucaaaacuccacuuauuccuacacuucagcacguauuaugaauauuuguaucuuaaauacuuccacaguagacaguucagacauacacacacacaaaccauaacacaaauaguuuuacacauacauuuaaaacuaaauaaaucaccucaugugauuuaaaugagaaaaaugaacuauugacuuuuuuucuuuuucucaaaugcuaccacaagaauucucgcaagcuaucagccccaagucuaucuuuuugaguauuuugugauagcugauagguaggaaagucauccuggaugacauguuaguucccauucaugucacccuuagguaauagauaugauccuuaaaggccuuaguuccccuuuaaauauuucaucuuggauuuguuccacauugauuuguccaaaccaauugugagguauuuaccuaucaacagaagagcugcauccaucacugcugcaccguucagcauaguagccaucaaaauaucguggccaggacagucaacaaaggaaacaugucuaaugauugagaaauaacaaucagccuuaacauaaaucacuacuuacacaugcuaguuuuagauuuuuuaaaguuaaaucaacuuaggaaauaaucuuauugcuauaaaaugguuacagggcuugucguuucuagaacuuggaaauaaguucaccagcugaugaaaaccacugcagauuacaaagcaaauuaaauuaguuaugugcagaauggaagauaaacuccaaaauccaaugaaaaugaauaugguauagaauaaugguggagaguauauacugagaaugucauugauuugaaagcuaaaacuuauaaugacuuauaaaaaccacguuaacagaaugagaauuugaaaaaacaauuuucuggcugggcgcaauggcucacaccuguaaucccagcacuuugggaggccaaggcagguggaucaccugaggucaggaguuugagaccagccugaccaacguggugaaacccggucucuaauaaaaauacaaaauuagccacauguagcuggugcaugccuguaaucccagcuacuugggaggcugaggcaggagaaucgcuugaacccaggagguggagguugcaaugcgccaagauagcaccauggcauuccagccugggcaacaagagugaaacuccgucucaaaaaaaaaagagaaaaaaaaaaacaauuuuccaaaaauaccucuaacaccuugaaaaacuagaauugcccauuugaagcagagauggcagcacuuuuaacaaaacuaugguauucauucagagucacaauuguuuuuuuaaucgcaugcucacauugucaugaucuaaaacagaggucagcccuuaggccaaaucuggcccaccaccauaccuauuuacacacguauugucuacguuugcuucuguaauagaagaacagaaucaacagaaacucuauggcuugcaaagcugaaaauauuuacuaccuagcccuuuguggaaaaaguuugcugauccccuauuaaaggccaggacuacagugagacaagugcaaaauuuaagagacugccaaaaaacucaguaaucaaggaaaauggccgggcauggaggcucaugccuguaaucccagcacuuugggaggcugaggcgggcagaucacuugaggccaggaguucgagaccagccuauacaacauggcaaaagcccaccucuacuaaaaauauaaaaacuaggccgggcacaguggcucacgccuguaaucccagcacuuugggaggccgaggcggacggaucacaaggucaagagaucgagaccauccuggccaacaugguaaaaccccgucucuaccacugcacuccagucuggcgacacagaaagacuccgucucaaaaauaaauaaauaaauaaauaaaaauaaaaacuagcugggcaugggggcucacgccuguaaucccagcuacucgggaggcugaggcaggagaauugcuugaacccagaaguggaagcugcagugagccaagaucgcaccacugcacuccaaccugggcaacagagacugucucaaaaaaaaaaaaaaaaaaaagaaagaaaaaaaaauauaugcauucaguauuuuuaaaaagucgaaauuaaugcaaaaaaucaaucauaaacaaaauacaaugccaugcugagccaaagcaaaaggggaaaaaaauuuaguaauagagucugcccuuauuuaaaauucugauuuaucacauuuuuugcauuaauuuaaaaaaaacacugcauuaaaauauuuauccuaauuacugaguuuucuggcauaccugccaccgccaggcccacuuacauuuugggcuugaggugaaggccucacuugucccucccuggucccagcccugccccaaucuaaacauuccuuguagggcaucuccaauccccauaaacaucacuagacaggugucaguauccugauaaaaaaacagguaugcaaucauauucagaaaacagauggggaacaaguucaaguguuuuagagaaguaauuagaaauggcucuguuucucuccuauuuaacauacagaaacagcgcuguuuaaaagaaauucaggaagccuagaaaaagaaucccuucaauccaaugaguuguuuuucuguuuuguuuaagugauacuuuuaguuuggagaaauugcauguaaguauuuuaacuuagguuuagaugcuugacuuuucagauuucccauaaaaacauaaacaauggaaaaacaacaaaaccauuuagccauuagguucaccguuuaacaccucgauauuucaaaaagcacaaaacagaagacaauaaaauauaaaguguaguguuuguagcaaaagagaggucaccugacuaauuugaaguucccuuuggucccuggaauguccguaggaaacucgucagguguacugcucccacaagaucuauaacauucuggccgagggcaacuugggucaucaagcuuauaaaucuaaaauuucaauaaaaaaagauuuugauuuguuaucugcacaacaauuaaaguuaguuucucguuccacaguacacagcuuaccuuagcauuagcauauccaagcuugauuguaauauuucuuucuaguucauuuuugaaccugacaguaugaacuccagaaauagcuuugacgacuguggauuucccaugagcuacaugaccaauuguaccuauggacaaaguucaaaaaauuaauucauguguauuuaauuacauaccaaauauuuuuucaaauaguguuaagaguagaaaacccaaagccagcuggacacgguggcucacgccaguaaucccagcacuuugggaggccgagguggguggaucacaaggucaagagagcaagaccauccuggccaacauggugaaaccccaucucuacuaaaaauacaaaaauuagcugggcgugguggcgcaugccuguagucccagcuacuggggaggcugaggcaaaagaaucacuugaacccaggagguggaggcugcagugagccgagaucgugccacugcacuccagccuggcaacagagcgagacuccgucgcaaauaaauaaauaaauaaauaaauacaauuaaagccaaagccauaacuugcuguaaauaucaacauaaaaccaacagugacuucaauuuuuccuccuccauaccccuuccuacuagaaacguguucucauauaggacuuaagagaaacuuccauguaacuaacagcuuuacuuaaaaaauauacucugggacagacagggucuccugcugcugcccaggcuggaaugcaaugcccugaucacagcucacugcaaccucaaccaccugggcuugagcaauccuccgaccucggccuccuuaguagcugggacugcaggcaugcaccaccacgcacagcuaauuuuuuguauuuuuuguagagaugggguuuggccacguugcccagguggucuccaacuccugggcucaagcaauccaccugccuuggccucccaaagggcugggauuacaagcauaagccacugcacccggccagaacuuuauauauuaaggaaccuuccagcauuuccagauuaaacagguaugaugggcccugacacaacaaaaagggaucugugaacaaacaaggaaacaaccuaaguuuaauugcaacuuguuccguugaucaaauuauugggucaauauaugcacaguaauuugcuuuaacugguauagucuuagcauagguuguucggagguuagguuaugcuccaaggucaccucaaccaaaauuuuuaaugcaggggcaguaguucaaggccuguaggcuuauuugggcuuuguuugcauuaauaaauuaaagcuccagacuguaauacuguaacuuuaauagccucaugguggagucuuacuuuuuaacuagguuaaaaacuagucuuacuuuuuaacuuacuucuguacuuuuuaacuuacuuucguacaaacugugcuguuuguacaaacucaaaauguccaaaauuuacacucagucaacguaacuucuccucuaaaguucuaggugccaauuaagaaaaaaaaccuucuauuuaaucacagcuuguacaucaaauaaaacuuucauaaauucugcccuugaaauaauccugugugucaaguacagccacauuuuucaccucuuccuuaaacuucugcuacauaugacuacauacugccuuaugcuauuaaacuuuucuuaugucuccauuuuuucuucuuaccgagucuguaagcuacaugugggcagcauucuuugugcucccccugcaccgcaaauguagcagaugcuuuauucacaaggacucaguaucuauuucuugaauaucugaauccucauacuauucaaguaaucacacaaaaagugagguuaaaauuaauuguuggagaccaagguuaggucucuuaaguuacucuuaccuauguuaauuguggcuugucugcugauaacuucgugugaaaguggcgucaacuugguaacauccugcaaugaaauauauuuuaaaacacugcacguaaaacaaaugagaacuuuuccuuugacuuuacguuugcuaucuacaucuugccaccaucugcacagcuuuccacuacuucuaaagcuccuuuucccuaucaguaacuuuguacuccuauggcugggaagcuguuaagagcccuucaucauuacacaacagacuacaccuccacucaacuauuaggggauaucuggaagucagagauccccccaaucuugggaacauuagcacuaaaaguaaugcagacaggacacccccuucccagacguucagaggcugaaaccaugacaaucaacaucaagacuuuccagccgaacccuccagaagcuagaagucccacgaccguacacgccugcgcccagaucguggacuggccuggguacaggcggcgcgagcauggcuuagggcgcccaguuccaggucucccuccugacccaggcuccugacccaugcucccgacacugacuagucccaauaccaccgggaggcucggucaccuccacuccugagcucacucugcauccuccccaagcaaaaccucaccaagguggugagauccugacgcgaaagaugcggcugcccuagagucacuccagcuucuccgcccgccauguugccaaaagaggaaggaaa

SEQ ID NO: 192840 - RNA, 23863 nt, Homo sapiens
uuuccuuccucuuuuggcaacauggcgggcggagaagcuggagugacucuagggcagccgcaucuuucgcgucaggaucucaccaccuuggugagguuuugcuuggggaggaugcagagugagcucaggaguggaggugaccgagccucccggugguauugggacuagucagugucgggagcaugggucaggagccugggucaggagggagaccuggaacugggcgcccuaagccaugcucgcgccgccuguacccaggccaguccacgaucugggcgcaggcguguacggucgugggacuucuagcuucuggaggguucggcuggaaagucuugauguugauugucaugguuucagccucugaacgucugggaaggggguguccugucugcauuacuuuuagugcuaauguucccaagauuggggggaucucugacuuccagauauccccuaauaguugaguggagguguagucuguuguguaaugaugaagggcucuuaacagcuucccagccauaggaguacaaaguuacugauagggaaaaggagcuuuagaaguaguggaaagcugugcagaugguggcaagauguagauagcaaacguaaagucaaaggaaaaguucucauuuguuuuacgugcaguguuuuaaaauauauuucauugcaggauguuaccaaguugacgccacuuucacacgaaguuaucagcagacaagccacaauuaacauagguaagaguaacuuaagagaccuaaccuuggucuccaacaauuaauuuuaaccucacuuuuugugugauuacuugaauaguaugaggauucagauauucaagaaauagauacugaguccuugugaauaaagcaucugcuacauuugcggugcagggggagcacaaagaaugcugcccacauguagcuuacagacucgguaagaagaaaaaauggagacauaagaaaaguuuaauagcauaaggcaguauguagucauauguagcagaaguuuaaggaagaggugaaaaauguggcuguacuugacacacaggauuauuucaagggcagaauuuaugaaaguuuuauuugauguacaagcugugauuaaauagaagguuuuuuuucuuaauuggcaccuagaacuuuagaggagaaguuacguugacugaguguaaauuuuggacauuuugaguuuguacaaacagcacaguuuguacgaaaguaaguuaaaaaguacagaaguaaguuaaaaaguaagacuaguuuuuaaccuaguuaaaaaguaagacuccaccaugaggcuauuaaaguuacaguauuacagucuggagcuuuaauuuauuaaugcaaacaaagcccaaauaagccuacaggccuugaacuacugccccugcauuaaaaauuuugguugaggugaccuuggagcauaaccuaaccuccgaacaaccuaugcuaagacuauaccaguuaaagcaaauuacugugcauauauugacccaauaauuugaucaacggaacaaguugcaauuaaacuuagguuguuuccuuguuuguucacagaucccuuuuuguugugucagggcccaucauaccuguuuaaucuggaaaugcuggaagguuccuuaauauauaaaguucuggccgggugcaguggcuuaugcuuguaaucccagcccuuugggaggccaaggcagguggauugcuugagcccaggaguuggagaccaccugggcaacguggccaaaccccaucucuacaaaaaauacaaaaaauuagcugugcgugguggugcaugccugcagucccagcuacuaaggaggccgaggucggaggauugcucaagcccaggugguugagguugcagugagcugugaucagggcauugcauuccagccugggcagcagcaggagacccugucugucccagaguauauuuuuuaaguaaagcuguuaguuacauggaaguuucucuuaaguccuauaugagaacacguuucuaguaggaagggguauggaggaggaaaaauugaagucacuguugguuuuauguugauauuuacagcaaguuauggcuuuggcuuuaauuguauuuauuuauuuauuuauuuauuugcgacggagucucgcucuguugccaggcuggagugcaguggcacgaucucggcucacugcagccuccaccuccuggguucaagugauucuuuugccucagccuccccaguagcugggacuacaggcaugcgccaccacgcccagcuaauuuuuguauuuuuaguagagaugggguuucaccauguuggccaggauggucuugcucucuugaccuugugauccacccaccucggccucccaaagugcugggauuacuggcgugagccaccguguccagcuggcuuuggguuuucuacucuuaacacuauuugaaaaaauauuugguauguaauuaaauacacaugaauuaauuuuuugaacuuuguccauagguacaauuggucauguagcucaugggaaauccacagucgucaaagcuauuucuggaguucauacugucagguucaaaaaugaacuagaaagaaauauuacaaucaagcuuggauaugcuaaugcuaagguaagcuguguacuguggaacgagaaacuaacuuuaauuguugugcagauaacaaaucaaaaucuuuuuuuauugaaauuuuagauuuauaagcuugaugacccaaguugcccucggccagaauguuauagaucuugugggagcaguacaccugacgaguuuccuacggacauuccagggaccaaagggaacuucaaauuagucaggugaccucucuuuugcuacaaacacuacacuuuauauuuuauugucuucuguuuugugcuuuuugaaauaucgagguguuaaacggugaaccuaauggcuaaaugguuuuguuguuuuuccauuguuuauguuuuuaugggaaaucugaaaagucaagcaucuaaaccuaaguuaaaauacuuacaugcaauuucuccaaacuaaaaguaucacuuaaacaaaacagaaaaacaacucauuggauugaagggauucuuuuucuaggcuuccugaauuucuuuuaaacagcgcuguuucuguauguuaaauaggagagaaacagagccauuucuaauuacuucucuaaaacacuugaacuuguuccccaucuguuuucugaauaugauugcauaccuguuuuuuuaucaggauacugacaccugucuagugauguuuauggggauuggagaugcccuacaaggaauguuuagauuggggcagggcugggaccagggagggacaagugaggccuucaccucaagcccaaaauguaagugggccuggcgguggcagguaugccagaaaacucaguaauuaggauaaauauuuuaaugcaguguuuuuuuuaaauuaaugcaaaaaaugugauaaaucagaauuuuaaauaagggcagacucuauuacuaaauuuuuuuccccuuuugcuuuggcucagcauggcauuguauuuuguuuaugauugauuuuuugcauuaauuucgacuuuuuaaaaauacugaaugcauauauuuuuuuuucuuucuuuuuuuuuuuuuuuuuuuugagacagucucuguugcccagguuggagugcaguggugcgaucuuggcucacugcagcuuccacuucuggguucaagcaauucuccugccucagccucccgaguagcugggauuacaggcgugagcccccaugcccagcuaguuuuuauuuuuauuuauuuauuuauuuauuuuugagacggagucuuucugugucgccagacuggagugcagugguagagacgggguuuuaccauguuggccaggauggucucgaucucuugaccuugugauccguccgccucggccucccaaagugcugggauuacaggcgugagccacugugcccggccuaguuuuuauauuuuuaguagaggugggcuuuugccauguuguauaggcuggucucgaacuccuggccucaagugaucugcccgccucagccucccaaagugcugggauuacaggcaugagccuccaugcccggccauuuuccuugauuacugaguuuuuuggcagucucuuaaauuuugcacuugucucacuguaguccuggccuuuaauaggggaucagcaaacuuuuuccacaaagggcuagguaguaaauauuuucagcuuugcaagccauagaguuucuguugauucuguucuucuauuacagaagcaaacguagacaauacguguguaaauagguaugguggugggccagauuuggccuaagggcugaccucuguuuuagaucaugacaaugugagcaugcgauuaaaaaaacaauugugacucugaaugaauaccauaguuuuguuaaaagugcugccaucucugcuucaaaugggcaauucuaguuuuucaagguguuagagguauuuuuggaaaauuguuuuuuuuuuucucuuuuuuuuuugagacggaguuucacucuuguugcccaggcuggaaugccauggugcuaucuuggcgcauugcaaccuccaccuccuggguucaagcgauucuccugccucagccucccaaguagcugggauuacaggcaugcaccagcuacauguggcuaauuuuguauuuuuauuagagaccggguuucaccacguuggucaggcuggucucaaacuccugaccucaggugauccaccugccuuggccucccaaagugcugggauuacaggugugagccauugcgcccagccagaaaauuguuuuuucaaauucucauucuguuaacgugguuuuuauaagucauuauaaguuuuagcuuucaaaucaaugacauucucaguauauacucuccaccauuauucuauaccauauucauuuucauuggauuuuggaguuuaucuuccauucugcacauaacuaauuuaauuugcuuuguaaucugcagugguuuucaucagcuggugaacuuauuuccaaguucuagaaacgacaagcccuguaaccauuuuauagcaauaagauuauuuccuaaguugauuuaacuuuaaaaaaucuaaaacuagcauguguaaguagugauuuauguuaaggcugauuguuauuucucaaucauuagacauguuuccuuuguugacuguccuggccacgauauuuugauggcuacuaugcugaacggugcagcagugauggaugcagcucuucuguugauagguaaauaccucacaauugguuuggacaaaucaauguggaacaaauccaagaugaaauauuuaaaggggaacuaaggccuuuaaggaucauaucuauuaccuaagggugacaugaaugggaacuaacaugucauccaggaugacuuuccuaccuaucagcuaucacaaaauacucaaaaagauagacuuggggcugauagcuugcgagaauucuugugguagcauuugagaaaaagaaaaaaagucaauaguucauuuuucucauuuaaaucacaugaggugauuuauuuaguuuuaaauguauguguaaaacuauuuguguuaugguuuguguguguguaugucugaacugucuacuguggaaguauuuaagauacaaauauucauaauacgugcugaaguguaggaauaaguggaguuuugaaggguagcguaugcuuuguuucuuauguuagcuguugagagauuucauuacuaggggguaaaauuuuuuaaaagcugcuggugcgguggcucacgccuguaauccuagcacuuugggaggcugaggucggcggaucaccugaggucaggaguuugagaccagccugaccaacauggagaaacccccucucuacuaaaaauacaaaauuagccgggugugguggcgcaugcuuguaaucccaucuacucaggagaaucucuugaacccgggaggcagagguugcagugagccaagauugcgccauugcacuccagucuggguaacaagaguaaaacuacaucucaaaaaaaaaaaaaaaaaaaaaaagcgacugggcaugguggcucauggcuguaaucccagcacuuugggaggccgaggcaggcggaucacuugaggucaggaguucaagaccagccuggccaacagggcgaaacccugucucugcuaaaacuacaaaaaauuagccaggcuugguggugcgugccuguaaucccagcuacuugggaggcugaggcacgagaaucgcuugaacccaggagacagagguugcagugagcagagaucgagccauugcacuccagccugggcgacagaaggagacucagucuuaaaaaaaaaaaaaaaaaaagcugggugcgguggcucacaccuguaaucccugcacuuugggaggccaaggcagguggaucacuugaggugucaggaguuugagaccagucuggccaacauggugaaacccugccucuauuaaaaauacgaaaauuagccgggugugguggggcacaccuguaaucacagcuacucaggaggcugaggcaggagaaucgcuugaacuugggaggcggagguugcagugagccgaggugacgccacugcacuccagccugggugacagagacagagugagacucagucucaaaaaaaaaauuuuuuuuuuaaagcaugccauguugguauagucaggacacuugaauaucacgacuugaggagguugaucauuagagugcucaacaaaacaugccuauuucuuuauaauacacuguugguuaucuucacaauagcauucuucccucccucaguugaagaguagccucugauauuaguaaaaauucauagacaguauuaagugcuuuucccuuuuaauuacucucuacuucucaggagcuugccugggccagaacauuucuaaaacuggagagaguuagagggcuauaccucauaccugagcaaaagcugagugcagacccugagaaaagccaaacuugcugauuuuaagcuucuugcuuaggaccaggauugggagccacacaauugggagguuccagugaaugcaggcaacagaggaugaagcagggccaaaagguggauaccuggcaauaauaucuuccuuauuaggguuagaacauucagaagucuccuuuauuagaugccaacuuuuuuuggggcggggaguggguggcaaaagagacucauaaaauguaccauuuuauguauuuacaggguagaauuuaguggcauuaagcacauugacaauuuucuacaacauagugguugucauuucaccacuaucuaguuccagaacuuuuguaucagaacuuuuguaucaccgcaaaaggaaaccccaugcccaugaagcgucaguccacauguuuuccucccccagccccuugcaacccauaauuugcuuugucucuuuauggauuugcccgccuauucuggauauuuccagcuauucuuauaugcaucuuuuuuauucuucaucaacuagcugguaaugaaucuugcccucagccucagacaucggaacaccuggcugcuauagagaucaugaaacugaagcauauuuugauucuacaaaauaaaauugauuugguaaaagaaagucaggcuaaagaacaauacgagcagauccuugcauuuguccaagguaagaagccauaauaugaaauaaaucuaugaaucacuuugagaggcauuuacucuggauaccagauguuaaauuaacuuuuaauauauuaucuaaaacaagguaaacuuacaagucuuaagccuuaucgcccuaccuuuugcuuguuaguaaccugauauaacuaaugaaaccugugauucugaauuuaauauacuaaaguauauuuuugcuggcagcaaguuagaacugagguuguuuucuggaaacuuuaucaaucagauuaaaaaaaaucucagugacaguaaaaugaauaaaauaauuuuaaaaaaccuugucuuacaguauuuguuacugaacagcuuucagauuuggaagugacagugauuauuuaaucucuagagugucggccgggcaugguggcucacaccuguaaucccagcacuuugggaggcugaggcagguggaucaucugaggucggaaguucgagaccagccugaccaacacggagaaaccccaucucuacuaaaaauacaaaauuagcagggugugguggcacaugccuguaaucccagcuacuugggaggcugaggcaggagaaucgcuugaacuuggggggcggagguugcggugagccgagaucacgccauugcacuccagccugggcaacaagagcgaaacuccaucucaaauaaauaaauaauaaaucucuagagugucccuucucuaauagcauaauguuuuucauuucagaggagaugugauuuauuguugacauuuucucucucagucuuguuuuucuuuuuagaaagguuaauuucuuaugaacucaguucugucaucacgagaaguaauaagugaauuugauuaaagucuaauuguguuuggucuauuucuuugacuagcuuguuugacguauaaucaauacguagcaaauauauaugguugggcgugguagcucacacuuguaauaccaagacuuuaggaggcugaggcgggugggucacuugaguccagggguucaagaccaaccugggccacgugguaaaacucugucaauacaaaaaauuagcugggcuugguggcacacaccuguguucccagcuauuauguaggaggcugaagugggaggaucgcuugggccugggaaguggagguugcaacaagccgugauuaugccacugcagucuagccugggugacaaagcgagacccuaucuccaaaaaaaaaaaguauauaugccagcagucuuugauuagcagagucuguaauuuuaucuugacauuuauugggagauuaauuacauguuguuagaaauuuuuucaacuaguagagugcucuuucacaggaauguuaguauuuucuuuauuuaaauaaguuuaucauuguacuaauauuaaguaugucuacuaauauaauguaacaaauuuucucuuacagggauuuguauucauuuucaggaguaaaaacaaacaauauugccaucuuucuaaacagaauuauccacuuuccacuuguugcugacauuuauaugggguuuaggcaucuauuuuauuauaguaaucuuaauuguuuuauguaacagauacauagaauaaauuuuauaaaacuguauaauuuugaucuuucuaaauuuugucauauagguacaguagcagagggagcucccauuauuccaauuucagcucagcugaaauacaauauugaaguuguuugugaguacauaguaaagaaaauuccaguacccccaagagacuuuacuucagagccccggcuuauugguaagugauaggauuugccuuuaacucuuaaucugaucuuuuccacauuggugauuccucuucaaggauguuuauuaauauuuccucuuucugcagaggugauaauucauacaauuuuuuugaaaucaauucugagauuguauuggcagugcuagauuguauuacugaaugagggacagaguccugaacacaguaagaacuguuaaccuaagccgggcgcaguggcucacgccuauaaucccaauacuuuggggggccgagguggguggaucaccugaguucaggaguuugagaccagccugaucagcauggugaaacccugucucuacuaaacauauaaaaaauuaacugggcaugguggcgggugccuguaaucccagcuacucgggaggcugaggcaggagaauggcgcgaacccgggaagcggagguugcaaugagcugagaucgcgccauuguacuccagccugggcaacaagagugaaacugcgucucaaaaaaacccaaaaacaacugcuaaccuuucugugcuuaauauaugguacaugaucaagauggaguaauacaguauucuccauggaaucauaauguuuuaggguguuagaacuuccugacuaaaacauuuacagaugauuuuguuguucaauuaacgaagaacugauacugguauaauuugaucaccuaggcuugugguuccuacacggggauguaguagccuucucgaaacagacauuugagcuccucuggcuuucauccgagcuucugguguuuaguaggaaauagucuccgaagugcaggucauguaguccuaguguuuuauaguuauaaagcugaauuguucuuacaggaguuacagaggucuauaaagaaaauguccauaaucucucugucuucaaguucuaguuccuuagcccuaaagucagcaaaguuaacauuugguguccauuauucccacacuuuucucuuuguucauaucaucguguauaaacauauacacaggcugggcaugguggcuuucaccuguaaucccagcacuuugggaggcugacgcugaggugagaggauugcuugaggcuaggaguucaggaccauccugggcauuaagggaagaccccauuucuacaaaaaauaaaauauuacagcugggugcagugguguguaccuguaguccgagcuacucgguaggcugaggcaggaagauugagcccaggaauuugaggcugcagugagcuaugauugugccacugcacuccagccucuaugauagagggaaaaaaaaauccauauacagacauugauuauuuuauuuuucuuuauggaagugggauuauauuaugcguguaauuuuuauaacuuuucuuaacaguaugugagggucauccuuccagaucauuacauauagcucuaacauuguuaauagcugcgugaugcucuauaauacugguauacccuauaugccacuuauuaauaaacuuaaguuacuuucauuuuuuccaucauaaguaagacugcuuaaucauuggaauaauaauagauuuuguuaaaaaggcaccccuuugguauaaaucucaaauggccacuauuuuagaaacauuaacauggaaaauaauauuucuucuaaaguuaagauuaacagaacugacuuuaauuuguuuuauuuuaguuauuagaucuuuugaugucaacaaaccuggcugugaaguugaugaccuuaagggagguguagcuggugguaguauccuaaaaggaguauuaaagguaaaauggguuuugguuguugugauuuuggguuuuuuuuuuuuguuguuuguuuguuuguuuuauccuugucuuaaucaggaaaaaaaguauggacaauccaaauugaaaaauaaaauuuuuuccaugguuucugguauuugauguagaguucucuuuuuuaauauucuuuuuuucucucuucaaacuucacuccucccacccuucuagaccucugaauccacaaucuaccuucaugagauccaccuuuuuagcuuccacauauacagaugagugagaaugugugauauuugucuuuuugugccuggcuuauuuuacuuaacaaaauggccuccaauucuagaugugcugcugcaaauggcagaauuuuuuuuuauggcugcauaauacuucauugcauauauauauaugcugccauugcuuuucuuuucuuuuuuuuuuuuuucuugaggcggagucuugcuguuucgcccaagcuggagcgaucucagcucacugcaaccuucaccuccuggguucaagcgauucucccugccccagccucccaaguagcugggauuacaagcaccccccaccaugcccagcuaauuuuuguauuuguaguaaagacaggguuucaccauguuggccaggcuggucuugaacuccuuaccucaagugauccacccgccucggccucccaaaguguugggauuauaggcgugagccacuuugcccggccuauauacugcauuuucuuuauccauucaucuguucaugggcacuuagguugauuccauguuuggcuauugugaacugugcuacaauaaacaugggagugcagauaccucuuugauaauauugcuucccuuucuggugaauguauacccacuagugaaacugauggaucauaugguagcuguauuuucagguuuucaaggaaccuccauacuguucuccaugguagcuauacuaauuuacaugcucugauaauaguuuuuuuuuuguuuuguuuuuugagcacaguggcaugaucuugacucacugcaaccuccaccuccuggguucaggugaugauucuccugccacagccucccgacuugcuggggcuacaggcacucgcaaccucgcccagcuaauuuuuuugguagagaugggguuuugccauauuggccaggcuggucucuuaacuccugaccucaggugaucugccugccucagccucccaaagugcugggauuacaggcauaagccaccacgcccagcuauauuucuuuguuuucuguuaugucuuuugaaugugucugacuugaaaauuuauagacuuguaaguauggagcacauuugaugugguaauagacuugugugguggguaguuaacaacaguuggaugguucugguuuugacagucucguucacaucuuuuuuuuuuuuuuuuuuuaagaauaaugaucuuugaaauacaggaaugauugccuuuucaguuuuauggucuuccgguuggaccuuuauuauuauuuuauuuuauuuuauuuuugagacagagucucucuuugucacccaggcuggagugcaguggugcgaucucgguucacugcaaccucugccucccagguucuagcaauucugccgcagccuccugaguagcagggauuacaggugcgugccaccacaccuggcuaauuuuuguguuuuuaguagagacgggguuucacuauguuggcugggcuggucucgaacuccugaccucaggugauccacccgccucggccucccaaaaugcuaggauuacacaugugagccaccgcacccagucccuguuggaacuuuugauagguaaaugauaauuuugcguaacacaguaauucuaauuacuaauuauauguuuacaggugggccaggagauagaaguaagaccugguauuguuuccaaagauagugaaggaaaacucauguguaaaccaaucuuuuccaaaauuguaucacuuuuugcggagcauaaugaucugcaauaugcugcuccaggcggucuuauugguaaggauuuuuuucucaucucuuuuaauuuguggcuauuugugguacuuuucaugggggauggauuaccaaaagggacauauuacagauuuuuaauuggguauuuuaauaauagaguaggguggggaacaaucaugugguuaagcucuuguuuuagguuauaagaugguuucauggguuuguaaaaauuauuuuuaaacacaaaggauacauuuugaucaaauauagaguaacuccuuuuuagcaauauaaaaaaauaaauuugaugacuuaucauguaagauauuuaccuacacuuauguuuuuguuaacaugauuuuugugcuagauaaugguugccuuuuuuuuuuuugggagauggagucucgcuguguccuccaggcuggagugcaguggugcaaucuuggcucacugcagccucugccucccagguucaagcaauucuuaugccucagccucccgaguagcugggacuacaggcacaugcugccaggcccagcuaagauuuuuguauuuuaguagagacgggguuucaccguguugcccaggcuggucuugaacuccugagcucaggcagucccccugccucggccuuucaaagugcuaggauuacaggcgugaaccaccaugcccggccaugguugcuuuuauguauauuuugcaaauggaaaauuaccuacaaaugucaguugaaugauaucaggucguauuuccaaugagguagaaauaaaagaaaguaaauuucuuuguguagcaauuacugaagugauuuaaaaacuuuucuagucccuuacaacuuaguguauuacucaauacccagaaaaaugaaagauucagugagaauuagaagggguguuguaccuuuagauuaaagaagaaaauguuugguaaagaaacaguuaauucuucacccaauaaguugugucucugguugaaaauuuuaaaaaggaaauaaaagaaaacaaaaaaaugaaaaagaguuuaccagguuggcugggcgcagugucucaugccugugaucccagcaauuugggaggcugagguggguggaucgcuugagcucaggaguuugagaccagccugggcaacaugguaaaaccuugucucuacuaaaaauacaaaaguuagcugggugugguggcccacgccuguaaucccggcuacucgggaggcugaggcaugagaaucgcuugaacccagaaggcggagggugagccgagaucacaccagugcacuccagccugggugacagagugacacucugucucaaaaaaaaaaaaaaaacaagaagaaaagaaaagaaaaaaugaauuuaccagguuggguaugguggcucaugcucauaauuccagugcuuugggaagcugaggugggaagauugcuugagaccaggaguuugagaccagccuaggaaaccaugagaugccauuucuccaauaaaauaguaagauuagcuggguuugguggugugugccuguaguuccaucuaucauuuuaucuuuugugugcaugugugugguaaacaagggaaaucuggaaacuuuuuaaaaauuuaacuuaaggaacuuuuuuaauuucuuuuuuuuuuuuuuuuuuuuuugaggcagagucucauucugccacccaggcuggagugcaguaguauuaucucggcucgcugcaaccuuugccuccuggguucaguuaauucuccugccucagccucccgaguagcuggaacuauaggcacauaccaccacagccagcuaauuuuuguauuuuuaguagagaugggguuucgccauguuggccaggcuggucucgaacuucuggucuuaagugaucugcccuccuuggccucccaaaauacugggauuacaggcgugagccaccacacuuggccuaaggaacucuuuaaacauaggauagaauacuguaaugauaacccccauagagccaucacucagcuucagcaauuauuaauguuuuaccagucuuggcugggcgugguggcucaugucuguauucccagcacuucgggaggccgagguggacggaucaccugaggucaggaguucgaaaaacccugucucuacuaaaaauacaaaaaaaaaaaaaaauuuagucaggugugguggcacaugccuguaaucccagccuguaaucccaggucacagugagccgagaucacaccacugcacuccagccugggcgacagagacugugucucaacaacagcagcaaaaaaaaguuuucccaaucaaucuugcuccaucuauauaucuucuuuccccuacuccccucaagacacagcuagaauauuuugaaguagaucccaggaaucauauguaguuuuuuuuuuuuuuuuuuuuuuugagagucucacucugucgcccaggcuggagugcaguggcacgaucucggcucacugcaaccucugccucccagguucaagugauucuccugcguuagccucucgaguagcugggauuauaggugucugccaccaugcccagcuauuguauuuuuaguagagauuggguuuugccauguuggcuagacuugucuugaacuccugaccuuagguaauccuccaacuugggccuccccaagugcugggauuauaagugugagccacugcgccuggcccauauguagucuuuaacuaucuuuucaaucagucuuucaggggagaaauggcaugcagguauucugcaaacuacucauuuugaauuuuguauucuuucggucuuuguuaaggauauucggacucauuuugaguucacuuauuaucucuauuugcccuuuguuuagaauuuauuguuuucaagaccaggucaguaauacuuaccaucuccugcauuaaguucucagccaagccaucauuccuagaaaaucagauuucuaaacccuuuguuuagaauuuaaaucaagagaaucguucuguucucauuugcccagucaucucaugaguguauauuucuauuugucuagauaaaacagguauuuucuuguaccuauauagcuauuauaugaguauaaaaauaaaaguaugaaaguguguagguauaugcugugcuuauauggcuuugggguaucuaauucacuuuuuuuuuuuuuggagacagagucucacucugucacccagguuggagugcaguggugcgaucucggcucacuacaaccucugccuccuggguucaagugauucuccugccucagccucccaaguagcugagacuacaggugcacgccgccacgccuggcuaauuuuuuguauuuuaauagagacaggguuucaccguguugcccaggcuggucuuuaacuccugagcucaggcauccaccugccucggccucccaaagugcugggauuacaggugugagccacugcaccuggccaacuaauucacuuuauagguguuuuaggaaauaaaaaauugagcuauauacaucuuauuuuuauauaggaguuggaacaaaaauugaccccacuuugugccgggcugacagaaugguggggcaaguacuuggugcagucggagcuuuaccugagauauucacagaauuggaaauuuccuauuuccugcuuagacggcuucuagguguacgcacugaaggagacaagaaagcagcaaagguaaaugcuuuuuuaaaaauuccuguuucuaaaaaagugacaaaugggaguguuaaaccaguguugaguuuuauuguuuuacaguuaacaugaaauuaagaaaaaaagaaaagguaaauaaauuugaccuccccaaaauugaggguuuuuuuuuuuuuaauuuagagauggagucucucgcucuguugcccaggcuggagugcaguggcgcgaucucggcucacggcaaccuccaccuccuggguucaagcaauucucuugccucgguuucccaaguauaugggacuacaggcacgcaccagcacgcccagcuaauuuuuguauauuuuaguagagaugggguuucacuauauguuagccaggcuggacuugaccuccugaccucaagugauccgcccgccuuggccucccaaagugcugagauuacaggcaugagccacugcguccggccaaaauugagaacuauauggcaguuaguuuaagaaagaaacuuaauaaacagggaaaaguauuagccauuuaugacaaagacaugauauuccuaaaauccauauuuuuguuuuguuguuuauuuugagacagagucuugcucuguugcccaggcuggagugcaguggugcgaucucgacucacagcagccucgaucucccagcucaagccauccucccaccuuaaccuccugaguugcugggacuacaggugugggucaccacgccuggcuaauuuuguauuuuuuguagagacggaguuuugccgcauuacccaggcugaucuccaacuccugggcuugagcaaucugcccaccccagccuccgaaaaugcugggauuaacaggugugauccacugcgcccagcuucaugauuuuuaaaaaaugucccagauuagguuggcagagaugggaaauugcugacaccuaguguuggcaaagauugaggaaaauaagcuaucaugcuuuuuuuuccccccacucaggugaucugccuuccucggccucccaaugugcugggauuacaggcgugugccacugcgccuggcccauauuaacucuuauauagccauaguccuucaugcuccccucuuugggaaauuuuguaccucauuuguacuagguaacugcuucagaauuuuaagagguacucugguacgguuacuacccuauuuuuuaaagguagaucuuguguaaauucagugggugccaaauaaacuauacuauauauaguucaaauuccuuuacaaugaaauuucuauagaauuuuuuuuaugauugacauauuucccaauaguauuugguaaauucuuacuuacauuuggaaagcauuuucuugauuuugggguuuauuuuucccuaauuuauuuuucuagguucaaaagcugucuaagaaugaagugcucauggugaacauaggaucccugucaacaggagggagaguuagugcugucaaggccgauuuggguaaaauuguuuugaccaauccagugugcacagagguaggagaaaaaauugcccuuagccgaagaguugaaaaacacuggcgguaaguuuguuagucuuugccacugucuaauuaaaaaaagacacagucuuguacagaaaaaaaagcacacaaucuuccuugaggacaacaguuacuguggcuuucagucucaacuauuuauuuggaugacuuugaaaacuauacuucggccgggugcgguggcucacgccuguaaucccagcacuuugggaggccuaggcggguggaucaugaggucaggagaucaagaccauccuggcuaacauggugaaaccccgucucuacuaaaaaauacaaaaaauuagccgggcgugguggcgggcgccuguagucccagcuacucgggaggcugaggcaggagaauggcgugaaccugggagucggagcuugcagugagccgagauggcgccacugcacuccagccugggcgacagagcgagacuccgucucagaaaaaacuacaaccuugacuauagucccauauuuuaguccaaauacugugauuggcuucucuuccuguuagacacaaccuaugcaaaaccaaaugaauuuggguucgguauuucuaucgucauuggcuuuggaaaucauuucacacuuaauagaaaaauuguaagaguuuuacagaaaacuccucuauagcuuuuuccuagauugacaaacacacauacagauuuauuuacauauauaaguuuuuuucugaaccauuugaguguaggcuauauauguuaugcuucuugaucucuuaauacuucaguguauauuucccaucaaaaaaggauauucuuauguaaccacuuagaaauuuaacauuggcaaaauacugaaaucuacagugcauguuucaguuuuauuacuugucccaauaauguacuuuauguuccuccuguuuagaaucuugaauugcauuuaauuucaugucucuuugaucuuuaaucuggagcuuuuucagccuuugucuuaauugacauuaacaguucugaagaauacaaacuaguuacuuuauagaauauuccucaauuuggguuuuucuuaucauucggaagccuaacauuagauucaguuauauauucuuaacuuaaauacaccgugaagucuccuuuucaggaaucacagcuagaggcacaugauaucugacugcuccucuuuguuaagguuaguuuugacuauguagucaagauguuguccagcuucucugcuguguaguuacucucuacccuugcaacuaauaagcaaucuguagggagaucuuucuagccaguacaaauagccugcugaucauugaaucccacaccccuggauguagcauccacugaugauucuugccugaaucgaacuugacuauaaugauuacaaaaucauagcaccucuacggguugcaguauccucccucaacucuaccaccccacauuuaucauuuggcauucuuucuuugccauuauuuauuucccuaucuaguuauaauauggacucauggaguccuauuuuauucaacauguuaugauccaucacugucuuccuuuauuuugaugugcauuguucgacguuuggccaguggagguccuucaggcuggcucuuguguccuuuugacauguacucaucauuuuuuuuucuucuucuuuuuuuuuuuuuuuuuuuuugagauggagucuugcuuugucgccgggguagaaugcaguggcaugaucucagcucacugcaaccucugccucccagguucaagcaauucuccugccucagccucccgaguagcugggacuacaggcacacgccaccacacccggcuaauuuuuguauuuucaguagagacgggguuucaccacguuggccagccuggucuuuaacccccgaccucaggugauccgcccuccuuggccucccaaagugcugggauuacaggcaugagccaccacgccugaccucuuucuucuuuuuuuuggaacauuuccuuauuuucuggcacaaaaucuuccagacucaucuuguaccuucucuguuccaguuuuagaacuggccauuucucuuauaaaugaaaagcugaguguucaggugugcucauggcucuuagggugcuguugcuucuaggucuuuugagagcauagagccaggaagcauacacacauuuuuggcuccugacuuuuugcucuuucccagguuauugaguuugccccuugcuuuccauuccucgucaccucaucacaguccauaccaccaucacuuuacacuucacaguuagugcgaaagacuccuaguuugccucuuaacuuggucaaaauuagucuucuuaaaacauuuucaucaugcuguguuuaauaauuucuagagucuucucacuacuuuuugauauuugggacuuuucuagaaaccugcuucaacccauuuaagcuuuccuucugcauugucuuauauaaacccucuaaauuagacuguuuugugcccuaacuguccccauaauuauucacaucaccccuacccacuaucuacuuccuuaauuauuuauuuuauauuuuuuagaggcagggucucucuguugaccaggcuggaguuuaguggcaugaucauagcucacugcagccucagugucuaaguagcuaggacuauuggcucacaccaccgugaucagcuaauuuuuuuguuuuuuguagacacuuggucucacuguguugcccagcaugaucucaaacuccuggccucaagccauccucccaccucagccucucaaaguguugggauuacagacaugagccaccccgcccagcccuguuuccuuuauuaaggcuuccaugcuacugugcccacgauggucucaucacuuguccaggagauuuaucugaauuauugcccuguaauuuagaaaguuaaauuuuuguugucucuuaaguaaauaauuauuuguggugacuuaugcccuuuugauuuuacugucuuuugugauuauauuuuuuugcuauuacagacacacgacuuccaguguauuuugaaauagauuuaagcaauaaacuuucaguccaggcacgguggcucaugccuguaagcccagcacuuugugaggccgaggugggcggaucacuugaggccaggaguucgcaaccagccuggccgacauagugaaaccccaucucuacuaaaaauaccaaaaaaucagccgggcaugguggcgcaugccuguagucccagcuacucgggaggcugaggcaugagaauuguuugaacccaggagccagagguugcagugagccgagaucguaccaccgcacuccagacugggugacagagugagacugucucagaaaaaacacacaaaagcaagaauaaaaaagaaucuaagaauauagugugggcuuucuuuauggaggagcaggcuuugggaacaaauuugaauucagaagauaagcagguaaaauuuaucacaagauugugugguaaugagagugaaguggauguaagauuuaugauuucuuuuauuuucauuuugcaguuuaauugguuggggucagauaagaagaggagugacaaucaagccaacaguagaugaugacugaagaauaccaguuaaauaauacauucggauggauuuggaaguuggaauuccucuuaacaaccaagggguuuauuuucaaagcaauauuggggaauugauuucacaguucguuaccuuaguagguaacgguaagguuauucucuuuuuuuuuuuuuuuuuuuuugguuaugaaaacuuagggacuaaaauuaauauaaaaauuggcauaauguuggauugaaucuacauuuuggcagaaguuaaacauucccacauaaugucaaaauuauacaucaugcaguucuguuuuuuuguuuguuuuauuuuguuuuguuuuugagucuggcucugucacccaggcuggagugcaguggcgugaucugcaaccucugccccccggguucaagcgauucuccugccucagccucccgaguagcugagauuacaggugcgcgccaccacacuuggcuaauuuuuguauuauuaguagagacgggguuucagcauguuggcuaggccggucucuccugaccucagggugaucagcccaccucggccucacaaagugcugggauuacaggcgugagccaccuugcccagcccacaucauacaguuugaaaugaaacuuugccacaaccagccuuugcuguagcacacacauauaucacugaaccuguuugaaauaaaguuuuuuuucuuuuucaugauucgucuuugaguaccuccaggcugaaagacuguuguaccaguaaaaacuuaaaggcacaaauucuccuugaagaccuucucccuuuuauguggccccauauuuuauguugcuuuaucuuugaaauuuugcaugaaaaggaaaugaauggauucgaaugaaauuguccuuuagagcaugauuacuuguucccauggacaaauauuuuucuccccuugcucuuccuggccugaaacacgggaaaccagagucaaaaguuaucucccucucccugugaugccuugagauuuuuuucugcguuguuuaaugccugaaauccaagucuuccuccaugggaaaauacuguuauaccaaauaauucuagaugaguaacaaagaucuuuuuaggccuucauuuuauguuuuuucuuaacuguuauauuaugauugugacauagauuauacuacuacuaauuuuuggauguuucaaaaggucaagaaguaaaagauguuagaaagcaaugagugaguccuuuugauuuuuaacuuauuccccaugucccuauacuucgugugcuuuuccuuuuuuuuuuugagacggaggcucacuccgucaccuaggcuagaguacaguggcacgaucuuggcucgcugcaaccucugccucccugauucaagugauucucgugcuucagccucccauguagcugauauuacaggcacuugccaccauacccggcuaauuuuuguauuuuuaguagagaugggguuucaccauguugcccaggcuggucuugaacuccuaaccucaggugauccgcccgccucugccuuccaaagugcugggauuacaggcgugagccacucugcccggcuuauuuuucuuuauguuuuugcuucguaagagguucuguugagcagugauuugcaacucuugcugacguugcuggggaagcuuuaaaaaaaaaaaagaugccccacagagauucugauuuuaauuguucugauuuaauuggcuuggaguagaauucaggcauugauaucuuuaaaaacuccccaguguugagaaacaaauuuagagaguugagaaguagguauauuaaauuacagaaucuuacugaguuuugguagacugauaauacaauuugcuuugcuuuucuuaaauuugcauugagaugggauuugaagcauauugugcucuugugaauguugaaguugcauuguagaaguuuagaagcucuggcuauggguugccuaaauugauguuuugaggaagcauauuaauguuauaaacuucgcugacuuugaagguuguguuguagcaugaggaacacaaauaaaacaauucuaaaucaaacuaa

SEQ ID NO: 192841 - RNA, 22225 nt, Homo sapiens
uacaguugccuguuuauuauuuuucaaaacaaaacaaaaacaaaagacauucaaaauuccccugugguggacaacugaguugauguggcugauccaggcugucucccagguugucucagggagcaucaguuguacuagggggugggcuguugcccuggcacggcuggaugaacacuugcaccagggauggccaucagaagagcugcaggccaguuuugagcccaugcagcugccccuggcuccagagaaggcccucgaaguugcugcugcugcuguugcugcaguugccacugccgacaccacagcucaggcccaaggugcugaggagagagugggaggucagucagggaaggaggcagcuuuaggcucuggaggggccaagagugcuugacauguguguaucugugggaugggcccacucuccugccuggcuuuacaaagagacuggagcaaauccgagaaacgacuucgugugggccccaggguugacuuggcccucuccucaguugaggaagggagggaaggaggcaagaacuuuucaaaugaaguuuuaugcagagcccuaguagauaaaccagauuaaagcagagcuguuuggguugagguaggggagggggccccacauaaccugacucccaagacauugaaaguagcugccuuaacaggacauccuuucaaggccuuagagcuugggggccuggaucccucccacacccaacaccugguuaaggggcccaaggccaggcuugggcuauaagacuaggcccacgauugcaagauugcuuuagggaggguggcucugcccuccuucucccuggcccugcucauaacacucuugcuuccccugcuucccgcaagucaagguccuuccagcugggugagggugacagcugagagcaaagccaucacccuacccucaggcagauccaugguuacacuacugcagcugaaagaacccuuacggauaaucuaguuccaccaccucccaucacccacaaucuuacagacaaguuaacugaggcccagagaugggaauggacuuucccaaggccacauagccaagucagggguggagcugagacaagaagcaggggugggcaugccccuccacagcaaaggaaacgucccuacuacagugggugugggagcugggcugaaucagcuuccuucuugacugaacagcuccagcugcccacacuucacccuugcuauccaugguacucaauaagccauccuuacccagggccaggcugguugggaaggagggguaagggcaccucucucagacaugugaaucccacucccaacuacagaucuccuggcuuccccagcugccaccucucuucuccaagaggccugcuggcccauggccuuggacagaguccauggcauugccuugggucuggccugcuucuggggccccuggauucuauagcccuuucccagaaugcccagaugaagagggguucaucucccagggagugggcaggcagcaaagggaaagacuuaguuucaggggcccgcagggguuccucucuaguacucacaggauuaucuggucagaauggcccagcauucuggaauguacaggcccuuuggaugggcuccuuuguguuacuagcauagccccucagcaagggcugcuugguuccuggcucccuggugacccaagggcucccacgccugugauccagaggcgaguuuugagggagagcaugaagccccgugcaggccuugcuaccaaggugccuggacaguguggggaggccuacugauuacucuaugcaccauuagacaaaucccuuccccuuucugggccucaguuuucuccucaguaacgugaaaaagcuggaugagagcaucuauuuuugacuuuuuaggagugguggaccaguuagagaaucugcugaaagcuauggacccuucuccucccaaaaugugugugugugccugcacacacacacacacacacacacacacacacacguccauccauaagcacaaacugaaugcaaucugagagggaugccaagcccagcuguguguggcuacuucacuggcuccccacacuagggacagggagagcuggcaagggcccagccagggacuggggcuuacacuucacucauuuaggcccugacuggggacagcuaccucccccacccaccucaccuugucuucucucccucccacagguggcagagaaagggggugagaaauccuguugccaugggcacucacucagucuugcauguugaggguuccagccgcugcucuagcacaggcugguccaaaagauacauggugucauaauucuccagcaugagcucugcuggguccucggucugaccuggcauucggccuaggggaaaugugucccaucgcacgucuucuguggagcaaagggaaguggcaagacugggcugaugagcugguucuccgacuggugcacaggccugcucacccuguccauccacccaccccacuuagcacaggugggcucucucaggaucuccagcuucacugcucucgguaucacuucucaugagccccucuccaccagagugcuucaccacacauucuuuaugguccuucucccccucuaugugcuuacauauacaaguauacaacuacagacauuuuugucccucuuugcucuuuuccuacuuccccaggcauguuccacacggacacaaacaacaacuucugaccaggcuguaucacugcuucaacuuuucaucuucaccccuauuucccugucuguagacacacacacagggacacaucauggagggucuggaugucccagaauucccaaagcaccucccccucaaaccccaaacccaccaguaccucagaguagcugaaugaccuagauuuccuacaaaucuacacacacacuccccugccuguuugaauaccacauauuuucuuaaugcagagauacacacacacccccaugcccaacucaggguggacucccugagauaguauguuccccugcccccugcaguucuugccccaagaugcacaagguacaccccuuuucuagggaacggcugucucaccacacaucccaccccucacagccacccaaauauguauacagaagcacacauacacaaguccuucacucagugacuguccuguucacucccugccucccacaccccucauucacuggcauacaaccagcaaucuuccugucccuaccuccccacacauguguacacacauaaggagcaauggcaaaggagaaagggaaagaguuaauguucuagacuuuccacauucacaacucacauccccccauauacagaugcuccacuuuagaauggggaugccggacaucccccaucccucucugucguaucacugagacgccuaccacacaguauuauauuaaaugucccuccccauccuuccacaagugcauucaguguuuucaaaugaagccuucacuggugcauuccauguagauuccauuucuggccuucugcaucucccugguacucaaagaauucucccugucauaaugccccuggcauucuauaaugugucaacccuggaccagcuuuuuauguaacccagagcuccucaggaaggacuguuccucuacuuguccaucccccuccccuggcucucuuacuggaaguugugccugucuuaauguccugcauuacuccaugauacagagacaccuucgugcacaggggccacuaccuacauaggcucugucacugacccgaucaucucucugucaucacuaauaucgccaaugcugucuacaucacuaccccugccucuuuagccugauacccuuguacauguccccagugacggcgugaacauacaggccaucucuggauggcuauaucucacugccuguucccacuaccccuccauagccaccaaccucaaugcuaucacuucucucucacacagauuaccuauuagcccucauggauuucagcaacccugccuccucuucacaaagcuguacgacagccugcuuggccaugacuuaacugccccuacuuuucccuuuuuccuauacacacacacacacacacacacacacacacacacacacacacaaauucugcuuaugucaaugccccucccuuucaauauuuacaaagaacccccaacacagcccuccuugcccuaaguuauuugucacugggcuaugguuugaccagcagguacaggaacaugcccauacacacacacacagagagacagacuuuauguuuuauguuccagcccuuccacccuguccauacaaggacaaacaaaggccauaguaucuuucucuauaaacucauucacugccuccccucucacucucugccacugcacaccccacaucacgcaggcccagcuguucucccucccuccccaggcuucagcacacagacaccacacuguucugucaucccuucuguguguuccggccuccgagguuccuguucauuaaccuaagcaaggguacucaaaaggaagagcagaucccuaucacuaacccucccugcagccucuuccuagcuuuggccucacuaauuugugugcucaccuaaaaaucacagcauuccuuauucugucuugugaucucacuuccuguuucucugacuuaaugcccuagguuccuucuuucuuucuuucuuucuuuuuuuuuuuuuuugagacggagucucgcucugucacccaggcugaagugcaguggcgcgaucucggcucacugcaagcuccaccucccagguucacgccauucuccugccucagccucccgaguagcugggacuacaggcgcccgccaccacgcccagcuaauuuuuuuuuuguauuuuuaguagagacacgguuucaccauguuagccaggauggucucgaucuccugaccucgugauccgcccgccucggccucccaaagugcugggauuacaggcaugagccaccacgcccggucuccuagguuccuucuuucuaauacacacaucaaaaucuugucucaccaccagccagccucaaggcacacacacacauacacagaaagcacugucucacugcaagugaaaaacacgugcagaaccauauauguacacacucccuacuucuugcuaucuucugccucuauguuacugcccagggcucacacccaugucauccucucagaaugugcucuuaugugagguagccagcagccugacaguggucccuggcacucacaggcuccauccuaagaggugggagaagccagcugucaucuaugcaccaggcugccuuccaggcuugccucacauuggcuaccuccugcuacuuuccaucucuuccuaggguagaaggaagccucaagagccagccaaagagaaaagaaguccauguggggacaaaguaguucuuaccugagcuaaccugccaugcagagcccugcaaagcuccucuuuucugggccagaagccuagcauucucggcagugggggacucuugcccuguagagaaaggccccaccuccauucugucuuccucuucaucaucuucaucaucuucauccuccucuuccuccucuuggucaucauuuucuuccuccuccucuaccuggucuggcaagaccucuuucuccuccuucuccucuuccuugacaucauuaacacugcccugcuccuccuguugcugggccuuugcuucagacccgaagcuggagcuggcuggcuugacgcuccaauacaggcugucuaguguauauggagacuucccaaugggggaggccucagagcccuccugcaccaggcuguuuucuccacucuggguauaaauggaacagaugcgcagcagcuucuccugcuccucgucuggcaggcccugccccauggcuuugaagaugcugagcaaagggagggaugggguaggaaagauucaaaaucucaagccacuucauaccccaacacuccaggguuugaacuuggucucugaacuuccagaccugccucugaaaggcaguguaguagagcagacagaacauagaaacaacaggaccauggacccagaacaaacucugugguucaucucugugccucacuuccauucucagguaaaaugaggacaauaaugauaccuaauguauaggauuguugggaggaguaaauaagaaagcucacauagaaugccuggcacagugccuggcacauagugggcaugcaauaaaugauagcuauuagucugcacuuaaaagcuacauaaaugcacaaaacagccaacaggccugcagggcuggaaaugaacagaucccucucuucucuggccuagcugagcaaccugucuugagcuccaaggauaugccuggaaguguucugugcuccuucugcguggaacacaaacugugaucccuuuaugggagcagcuacagcccagccuggaauggaggaaaagaaaaaaaaagcagcggcugacaagacaaagcaggaugugggagggaggccagaugagcacugcgaaccuacugcaggcacugcggggcugagggagacagagagcacgaggagggcaggaaagaccaagggagggcuuugugcaggagguagggcccgggaagcccagagacaagagcaagcacacggugcugcugcgugcagugaguagcccagcuagagggcacggccugugcugaggagccgugggaggaagagagggcugggaagguaagugugugcauuggugugugugugaggguucaccugccaauucugaguacacaugaaggcuauguuucugaagaucaccaagugaccauguggaggcuggccuggacaggcagccuggaggcagggagaccagggaggagccuguuccgacaguugaggccagagucggggagggcugaccuggggcacuggcaguggagaugggagggagugaagcugugaaggacacacagacagacagagagcagggcuuggugacugauggcaggggucaggcagaguuaaagaugaugacacugugcacacaaaagacggcgccaacagcaaaaccaccaacagauacagagcugcugggaaggggagcucgaggggagaggagggugagcaccccucacagagccucucauagagccuggcaccuaacaggcacccagucacagauggaugcggaugguucacagacgggccaugagcucagcaggcuguuuucucucugggcacaugcagacuggucacauaugcagggugacuggucagugggggcagggcuggggggcugaugacuucacuggagauccugucuauggaggcaauuucauauuccaagacgauaguggcucaaauuaaauugauauuggcuggcuggagaaagugcuugaaaagcuuccagcucuaaucagaugaaaagccagagagaaacuuuguccucucauggugguccauuagugugauuaauaauaaauauucccagacacuugauacuggcaaaaugccuuaucagcccuguuuaugauuacccaccugcuaucucgaaccauuagucugaccacuaaggugcgggggugaugcgaaucuuaaaauacacccccuuccucgaguaugucuggucauagcucaggacugagaaggucacagauucaggcugaugggaugaagguagacuuugggcucacaccaccugggccaagaucccugucccaccaucaacaaauguguagcuauuagauaagucccaucacuccuuagagccucaaugucuuaucugucaaauaggguauaauauauaauacuuccaccucccaagacugcugugucaaaguaaaugaaguuaaccucuacaaaaaaacacagcaccaugccugacacuuaauuuccaauaguaucuuuuauuuuuucucuggggaaaacaaaagccaaguucuguguuuaacagaugcuuucugcaauaauacaaucuaguggaguauuacagaagagcaugggacuaaggacaggcuaucuggauucuggccccagcucugacuugcagcauaauaccugggcaaacccccucuguucuccacucuguguaacggggugauuaggacuagauucacugcuuaucugggaaaggcaggaucugugcacaagaaaucguacccaagugagccgcuguuacugccggcaugugucgcaucccucugguaugcuuggguugggagaagaucucugugguccagacuucuccgagaccagcagcuuccacucugcaggcacuuaggauuggaaaguaccuugaaggccaccuauccaaaccucuccaugcugcucuugucacucccucccucccauuauauacacaugccauguuccuucuggacuuugaaacuugcuuuauucuuucuccugcuugaauuguucaaaugccuccucuugaaacucugacucauccaggcccuuuugguucuccucccaauugcccacccauccacaucacuucuagucuggagcacacaucuggcaauguggcuguucaguuccaacuccuggaagucuugccuugacugacuuugucuacaaagccacuuuuaaaaccuuacaaauaccucugugucccaaaugccaucaggguuaaagaaagacuuuuggacucaauagggggaucagggacuaagagggucuuggcauccagacucccacuucauucauuccccaggcacugggucagcucccaccaaggacagcacugcugggaaugagagagcagagcacgguucaauucaacgacauuuacugaggccuguuuggugccuagacuuguguggugugcuagggcacggacagcugauguagaguccuugcccuugaaaagcuuagucugauagagggaaggagacacuaagggaaguagacacggcaacacaaaaccucagauuugggaaguauucgagagucaacaggacaggguagauggugccgccaccaagugagauagggaacagaggaggaagaucacuuuagaguugagauggggacugagacgaccaauucucuuuuggucacaguaaggugccugugggccauccaaggggagaugucugacauguagucgaguacaggaggcugaaucuugggggaggggccagggcuagacagauuuggguuucagcacuuuauaggaacuaguaauaagcacaggcauuuuuugaggagggggugguaaacagcaucaaugcagcagacacagagacugacaagggcccacugauuugguaauuaggaggucaaagcaacucugggggugaaugucaaauugcagcagguugaggaguaagaggguagugaggaaauggagaguguugaguguagacuacucuuuugagauguuuugaugggaagggugggaaugauaagcugaugauaacccaacagagggaugcagggucaaaggagauuuugcuuguguugcuguuauuguuguuuuguuuaagaugagaaaagcucaggcacguuccuagguugaagagcaagagccagcagagcaagguagaggcuggggugaggccccagcgaugcuggcagagguggcuccagagcacagguggaggagcaggcuuugagguggggcaaggccaccucauccugagacuggcgagaagguugagugcagccgcagaucaguucacgagggcuggaccucaggucgagggggcccugccggaugccuccaugugcucgaggaagcuagggugaaaugggagagggggaggggcuugaggugagcgguaaggguuuagaauagugaggaaaugggagagaaaguggucagaaaacaaguaaaaguucagacaagcagaacugaggccucgcccgagauuaaaaaucauaccucugcaguggcagcaauccgcagggcuaugugguuuucuccagcagagcucagcuacccgggcugaggagcaggggaagcagaauggggaggaucaauuccagcucagggguuugcaagucagauauggccaaaggaugggcaaagcugaaggugcugaugaugaguggccgaacugagcaaccacagacaggauagagaggaagcaaggucaagggaugcaggaaauggagggauggagaucuggaugcaggcaaagagcagaugucaugggaugcaagggugagaacuagaaggacgagaagugguggucaccgagugggaugcugggaugugagcuuucagagguggaauagcuccgaaugauggaaauggguugcugaguguaguggagaaugaaagucacuggaguugaggagcuguagagugucagaugagucauccaaaugaaacagauauugcucaagaaagcaagaagggaaucaggcgcuaaaggcuuccaugauuaugagggaaguggcucagggucaggaaaugacagagaaaaggaaagggagacaaccacagguauuuaccagugcaauauucaguuugaccauagaacccaggguggauaggguaaaggagacucacaggagguauggcuaccaugguaaguugggccagaaucagaaagaucuuugaaugucaggcuaagaagccuagacuuaacaggaaggcaauagggagcaacugaagguugcuaagcaacuaucagagguauacuuuggaaagauaauagaggaaacagcacugggcuuggagucagaagaccuggguucaauaauaaacagcagcuaccauuuauugugcacuuacucugugcaggccacugugcuaagcacucuagggggauugucuuauccauucccacacuggacucaguucagucaggucuuaagcuguaugaucuuagguaagaaaacccuaccccuccccucucuggacucaguugucccaucugucagugggagugagacugggcuagacuguccccaaagggcccuucuaacucagucauucuagggcaguguggcccugaggcuugaagggccucacccucuuaccggauggaauucaagagacuuacauccgaaggaguugggggcuggcccagcaaggugagcccaagcaggacucaaccauccggggccagucaagggaggcggagcaguugaacagccuccagccccuucuugcuucccacuggccugcagaaaaucggcgagcauuccguccugagagagaagagaggaucuaaggagaaggaagcagugagccccccacccaacauuucaccucagaaaguuuggcucugucccuccccauccccccagacuccccaccuauaccucccaacugcucaaagaauucagggcacuuugccccagcccaguuuaguuggcucugagaagaaaaggaaaagggagauuuguccacugcugccguggggcccucuugggcaaaccuaaaccuuuaacacgggagguguuugccuggugcuucuuagcagagagcugaggacaguggcagaggcuccugccugggcugccuuaggcccuagggcuagggcuagucucccucaccagucuugguguuggccacgaucaguucaacgguccaucugaggauguagguaggccggaucccgcugauccccaaggcuggcaguucagagagcauccucuccaauagggccugcgugaaguucugggagugcaggccccugagcaggggcugccagaacugagagaacggcuuuggcaccaggacgucauucaaguccacguuuucugguuuguaagggacacccauuugggggggcaauaggagagagagagcaggagagcacgaaagagagagcaagagacagcaagagaaaggaagugagagugagagcaagagaaugugugcgcgcgcaugagccaagccccccaccaacaacagaguugccaccgcagaacaaaggaaagaggagagcagaacaguggggagagagaaaccaguuaguaucuggcaaccaacaacugacucaaaauaaaguauaaacaaaacagagaucugguucuagcuucagcuuugucaauaacucacugugugacuuugggucaguaccuuccccucucuggaccucagucugaccaucuguaacaugaggauguuggacuagaugaccucacaaggccccuccaauucugcuguucuagcucucuagcuagcagcuaaaucacaacgaacauggcacaauaaugucauuaagacuccccgaccccaccccaucccaccccaccccauuccagagcacuuaagggcagccccacaacugucaguggggcuaccuguucugcucagccaggaaggcugagggacuuucagaggccauggaauggcaggaaacagccuucacaccccaacccagggccccccagcccaccccagcuguuuccacccaggaaucagaacccuaagggugcagugagcccccagaacccuaccuucauauucuaucugcaaagcugccaacuguucaaauguggggacaaggaagccaucauccagaaaagcauccagcacagccucccuggaacaagaggacacuaguuuagcaaagugaugcuggcagaagacccucuccuacuccuccacccaccuccaaagcagcuaaugccucuggcucaaguggcugaagcagcauagggaggaggggugguggguggguaggaguggggaggaagggaguugacaauuggaucuuaggcuucagccuccucaggcaggggcugguuagaggcugggaucaguggguuuugaacaagugcuuaccaagcacuaaugcugaucuauggcccauaacgagagcaguagugucugaauacacuucaacacacagacaggaaaaaguuccacauccacagaaggaaauaaaugccugggaucauggggucaagggcuuuuagacucaguucuugcagucuguuuaucuugaccauucuucaguacccuaccccuucucuucucccuggcuaccuucuuuuagauccuagaaguagaaaccuuggggacccaacugcuagaccaaauaugguccauaggccuuauuacuagggguucuaaaaacccagaacaaaguuagagggguugcaggaguaggcuauagggguaaucucucaucccuaucuauuaacccauuuaugccgaguguuccauuauuggaacgcuaagcuugugggaguuauuuauauccuacugcucaaggucuucaccaaggucugauuuuucaaaaaaaaaaaaaaaaaaaagaaagaaauugcaaccuccggcauaaauggguuaauagcucaaaccuacaccagcaacagcaagcugauuccuccagaguuaguggcuucccaagaggcuuucugcuacaguuuggauguuuguccccuccaaaucuuauguugaaauuugauccccaauguugaccuuggugccuguagaagggguuugggucauugggucggaucccucaugaaugacuuggugcuguucccacaguauuaaguucuuguucuauuaguuuccgcaagagcugguuguuaaaaaagagccugacaucucccccuccaccuugccauuugauaucuguacauguggacuccccuuugccuucugccaugaggggaagaagcagccugaagcucuaaccagaagcagaugcuggcaccaugcuucucauacaggauacagaagcaugagacaaacaaaccucuuuucuucaaaauuacccagccucagguauuccuuuauagcaacacuaaacagauauagacauucuccuaacugaccaagccuagacguggaaaaaagagcucccaaguuguccuaaugccuggaaaauugacauacuuagaucccucucuccagcauuaccaggcagacacuacuguguuaggggcauaguuuucccagcugcuaaugaagccaccaccaacccuuuugcugaaggguagagccaagaaaccuaggcugggcaaacacugauaaaauacuuuuggaacgaguauccuggacaugaagagaagacuccaggggcaaucccagccuacacugcaguucucacccaggguuacucugcuaccuacaccaccuaccuaaacucuccaacuucucucuagcugagguuuagcauugccuccacacguucuuagcggaaagucccccaaagcccuuccagcugaauuuagguagaaagcccccaagagcuagggaggaaagaagaauggguagacauacuaugcgccugcucuggacugagcugagcacuuuguuuuggaaacaaaggcucacagccauacuugagagacaaggaacuuagucucuaggagccagacccugagaaggucccgccucuauuccccuaaccaugacuauccaagggaugcuaauacucuccaauggcaguucaaaagaaaacaccaggacgggcgugguggcucacaucuguaaucccagcacuuugggaggccaaggcagguggaucaccugaggucaagaguuccagaccagccuggccaacauggcaaaaccccgucucuacuaaaaauacaaaaauuagccagguguggugguacgugccuguagucccagcuucucggggaggcugaggcaggagaaucccuugaacucgggaggcagagguugcagugagccaagaucgugccacugcacugcagcgugggcaauagcgaaacucugucucaaaaaaaaaaaaaaaaaaaaaaaaaaaaaaaaaaaaaagaccaggccggcugcaguggcuuauaccugugaucccagcacuuugggaggccaaggcaggacaaucucuugaaucccaaaacuugaaaccagccugggcaacauggugagaccccaucucuacaaaaaauuauaaaauuagccagacaugguagugcaugccuguugguccuagcuacuuaggaggcugaggugggaggauuucuugagugugcgagguugaggcuguaguuaacuauguucgcaccacugcacuccagccugggugacagagcaagacccuaucguaaaaaaagagaaaaggccaggcacaguggcucaugccuauaaucccagcacuuucggagguccagaagggcaggucauuugaggccaggaguuugagaccagccucgccaacauggugaaacucugucuccacugaaaauacaaaaacuagccaggugugguggcucacgucuguagucccagcuacucugguggcugaggcaugagaaucacuugaacccgggagguggagguugcagugagccgagacugcgccacugcacuccagccuggguaacagagcaagacacuuucucaaaaaaaauaaauaaaaaauaaaaaaaaaacaagacaagacuagcagugcccaccauacauauaucuuuuaccucaaacuuagacaagggcuaggcagugagugaggugguaauuaucaagggauuuuccuaguugucaagagcuccacaugccacccgacagacaggaaagcagcuggccagcagauggaugauagugggcauuccugccucuggccauucuaguauaggcaacccccaccuggaaguuggcaggguugagggcagacaguucugccaaauguagggucacuguggaggggaucaggauuaucccugggauuuuguacagcagagguuggcaagcuaggauagggaaaccgauuucaaugaggcugcuacccucuauccuagagaauacgcagcucccgguuaccuaguuacacaccuguucucgcauguaacgcccuugagcucugccaggacacauucuacacguggggacggguuauuccacgccuuaauggccuuagguaaauaccuaaauuucuccagcaccugccagcaaagagggucccaucagaaggcugguucagccaagcaacccaccuccaccccuccaggaucccuucccauaggaccucucagcacugcccugcaggggacagggcagggcaugcaggggggggcccacaacuccccuacuggccuugcaacuaaaaauagccugacucucaaaugugagacuuccuccuccuucucccucccuuccuccuccaacugaauuuccuguggguaaauacugagauguucaaugggggaauuuggcuggagauagagacucuuaggccaaagggccagagaugaggagaggcaaugaguuacagaagaaagauaacugggagauccagguacuaauccugguucuaucauuaacuguauaugugacuuugggccugucccuucacucauccauggcuucaauuucuuaaucugugaaaaggaagggcugagcuaaaugguuucugagugaccucccuaaaaacagcaccccuccagcucaccugauuuagggaagcucuugggccccaucuacuggucagcugcggaauugcagggcugcgcaacuacccauucccaguuguucccuaccacccaguggggcagauuauccgcaaacuucaucaucuguucccuuccaucgguguggaggaucagccaauuggacucugcuccucuugucuccuuccuaguuccccccucucucuuuccgagaaguucccucacgcuuugucacuuuucuuucaaauuccuucucaagacuucucucagguagcuggcaagagggaagaaauggcuggggcagaugagagcacaccaaguccagggcacuuucuuaccguaaacugcuccucuucguaugauaccagcaguucucgggcucuuucugaaaacagaauggggagacagauaggacugccagcccagaccccuucuccugaugggauucugagccucucucaccucauuucuugaguuguaauugaggaacuagaauuccuuccccaacuacuucacagggcucaagaugguuugugaggcaaaugugacagccauuauacuauggaaacuagccaggaggaugguuugugacaguaauuuuuuaagcuaagauucaccacagccccagaggaaaugcugagccagggaaauaaacagcguuaacccuaagccugagccuucugggcucaugggccgcuuucugcccuccaaaacaccuaccauauagcucuuuaugacucagggccuuuuugcaaugagaauccaccucuucgcugccuuugcugucuccaucggccuuuacaucugacuccguacuuuucccaucauccugaggcucugguuucuguucugugaugucaucaacaacaauguucuuaucuuccucuugauccucuuccucuaucccuucccugaacuccuccaacucccaggucucucucaggcuguucuccaguuggcggcaccaauaggucuucuggagccaauccaggacaaaguagcagccuagaggggggaaggcaggcagugccacaggaucaggcaggcagcuagcaggccuccagccucaucuuguggguauuauaggaaggccccaggaaaaggcuuggcuccaagguucaaaucucaaauauccagaagcagccucuuucacucuggguuaucccccuguucuuugcuuuauccugcuuaccagcacuuuuucuagaaaaaaaaaccuauuauuggacuuagagacgagaugccaaaaacaguuaaggggcuaguaaguggcagaaguaggaaucagccccauuagcuaguuacauggccuuggccaagucuccccuuuucuagaucuguuuucccaucacaaagagugaggcuaaauccaggauucuuaaucgggaugggguggauguccaaggaacccuuggguucaugacacugcugauggcucaugccuggcaaccuccccaccucaacuauggagagguaugugagacuaaugaggcacuaccugagaaacaacauuuaaggggaguggccgggcacugugguucacgccuauaaucccagcacuuugggaggccaaggugagcgggucacuugaggucaggaguuugagaccagccugugcaacaugaugaagccccagcucuacuaaaaaaauacagccaggugcaguggcucaugccuguaauccuagcacuuugggaggcugaggcgggcagaucaugaggucaggaguucgagacuagccugaccaacaugaugaaaccccaucgcuacuaaaaauacaaaaaaaaaaaauuagccaggcauggaggcgcgugccuguaaucccagcuacucaggagguggagacaggagaaucacuugaacccaggagguggagguugcagugaacugagauugcgccacugcacuccagccugggugacagagugagacucugucucaaaaaaaaaaaaaaaaaaaguuaaucagacauaguagcaugugccuauagacccagcuacucaagaggcugaggcaggaaaaucacuugaacucgagagguggagguugcagugagccaaggucgugccacugcacuccagccugggcaacagggugagacucgucucaaaacaaacaaacaaacaaaaaacaacuuaagggcaggcaaaaaaaccucuguagucaagguaucaaaauaugccaagccauguuggaagcugaaacaaaaggagaaaucaguaauacuaaucccguuuuacuuaaaguuuugauauuauguuuaucaugaauuuuuccacauuaauauguuauuuaucuugauuauggaacuuuugacuucuccccacuuuaaauguugugcccaaggcgaggccucacuucuuucacccuagucccagccuugacuccagguggagacccuccugccuaucccucuacccucagcgccaccaagcccaggccccugggcuuaacugugauagguauaaccucugaggacucaccucugcggcagucauuuauauggggcauuuucuugugggucaacucauggcgaaggucaacaauccaauccggaauauuuaccugauuacaggggagggugugaguacagaaauuggaaaauaauuauuaaagcuggaagggagccagagauuaauuauccugaccaccuccugccccauuuuacaacuagagaaacugagguccugaaagaagauuccaaucacagugacagagccaagaaaaaaaaacagcucuucuuauucuuuuuuuacugcucuauggaggagguauugaaaaucagaaaagugggucaggcacaguggcucaugccuguaaucccagcacuuugggagcccagggcagguggaucacuugaggccaggaguuggagaccagccuggccaagauggugaaaccccaucucuaccaaaaauacaaauguaaucccagcuacuuggguggcugaggcacgagaauugcuugaaccugggaggcggagauuguggugagccaagaucacgccacugcacuccagcuugggcaacagagcaaaacucugucucaaaaaaagaaaagaaaaucagaaacauaaaaggcacacaccuccccuaaccaccaaccacccuucuacaacaaagaaauaccugugaaugagcauuaacaaucacguucuccagccucccucuagccuguccuucucccugaguauccuuuaccccugcuucccuccuacaccuccuccgggaagcgcuaaugacugagagcaugccugcccucugggccucuacacaguucacauacuccucaggguaggaaugucugaguuacagaaguagagacaugggaugggaauuccugauuuacaaagugacucauaguggcugagcugucuccucucucagacugucagcuccaugagggcaggugcugugacugucaccucuuuccuguccccacccagugcuacauuugggcuccucccagcaagcugggcaggccaagcccucugagauaccagucauaugagagcaagggagcaacugugccuccuucaggcuggaagcugaggcucugggauucuugcugggcuuggcugguagugaugggaugagcuagucugacugugugcccacaauaccccaugccccauuuggugagcccucuuggagacagaauugagcaaguucacugaaucauacgcaccucuugagccagacacuugagggggaccuuggcaaacuuugucuuccucucugagauaagauucacaaaccuggaguugagggagaaauaaguggcacagcccaaggaaccauuuuauuccaaacacuuugcugaguuacugaaacccugcauuuccacuuuuccaccgacuguccuguccuauuccuacagcuggugugucagccagagcagggacaguuccauccauuccaacauuuaaugagagucugcccuauaaugaagccauacagaugaauaagacacugcucuagccuugaacaguucggucuaggauaaauaauaaugauacaauguaacauauuaggcuagaacauaauauguuauaaaugcugcaaaggacuacaucagauaauggggagcacagcuaaccaauggagaaaauaagaagagaaagggaggaucucaaggcagacaaggggaaauagauaagcaaagacuuugacagauaugaaaacucaguagcaaccuuuuuuuccgacguguauacagcuagaaccauuaugagucacuuuguaagucaggaauucccagcccaugucuccacuuccauaacucagcaaucuuucaguguucaugagggagagaaggggaaaaggguagugcuaggaauagacagggacaggguuggaaaguccacauuaaaucacaggcgaggacccugagccauucagacaaguuccucugggugaggaauucaaagguaagaaaaaauaucagaccaccaagagacccacagagaucaccuggucugaaucccuuccuccacauuccaagauagaaagaaaaauggaagagaaggcuuucaggaaaaaggaagaaaaagaggaaugcguugacgaggguaccaaaagcugauaagucaagcaauaaucacaggcugauccacagugagguacacgcaggguuuugcuucagguaacaccugaagccaaguuuugcuuaucacaugccuccccugccuccaguccccaaagccaaccuccaccccuaccccaugcaggucuuaccugaccaaugccaugccauagagcagucuaaguucaucagugcccaagccaccaguuacauccaagagcuuacagcguaucaggucagcaguagaagccacugccagagggaguucguugccugaccuaaagggucacaguccagcaccaucauaaagagcccuuacacugguccacccuccaccucagaaccuagguuguugcaggcuacacccaucauauucugguucaagagagcaugaacagacacaaaacaagaaggugggaggagacacgguaaugucugugggauccaacaguauacagggcaugaggagcugacuaggccguauacaggacaccuaacugguagacuguccaucaacaguuguguggacacaccccuuucuuucacccccaaaucaacucauugagcuagaggagccccuuaucccuuguaagucggcucccaacucaaucuuaccaacuggacugaggcgccccacucaaacacugucuugcaggcaagacuuccuccccauuggaaucggaaaucuacccuaggguacuaaucuacuccuuaagcccuggcucaggccucacuagucccuccggcauccucuccaaguugggagaaagucacuuuuuggagguaauggguaaaccucacagauauaacaagagaauuguugaggcacaaccccuuacuuuccauuccgcuaacgggauuagcgcaagagauggcugccgcguucccccaggcauuugggagagggacaacuuuaggcgacuuaggggaagacuggagaacagggccuuauagaaacucgacaaaggaagaggugcagcgccaccagcacgcaggcaaaagggccgaacccgccaccuuaccugcuccuccacaccgugaugcgguuaagcgcguaccgcugcaacuuauggucgucacagaacagauaaaccgucaccuggucccacucggcccugcugagccaggcgaccacgaugccgugggccgagaguggcaacgacccuuucccuuuaacgcacuuuccguaccacgcacuccacacgagauccauccccugggaaccuagaccuggcccggccccggauucccacgacauacugagcucaacaacaggcucugugccgcgccgcuccgcacagccuucagcucagcgugcuacccucacuccgaaccgccaccgcaccagc

SEQ ID NO: 192842 - RNA, 74283 nt, Homo sapiens
ugaagucuuccuaaauuuuauuggcacugaaauagaacauggauugagcauaaaccccuccaaaaacaauuuuuaaaaaacccaaaaaguacacaaaaaaccccugaauacaaaaucuaaccuuuucccccagccucccuaaggguaaguuacugacuuuaaggcagcuauuaauagauugccccacaauuccagguuucaauuuagccaauauaggacauaucaccaagugagcuaauucacagcaaugcacacaagacuccucaaggucaggcacagaguggggggugguggccagggggaauugagggaggcucuaagcuaggggcacugcauggugggacaggauggccccuugaggacugaacccuggggagaagacaaacaguaauaauaaaaacaaauaacaaguacuuuaagaauggauuguaugaccuauagugacagaugacaucacuaauacugaaagcuucuuauauuaauaauuuuggcaaaaugucauuuuguaauauaguauaugcuuuccaggugugggggugguaaaguaaugaggccaaaaucauccugccccaagacuaauaucuucuaauggugcauuagcaaggaaggcagaaaucaauauuuagauaucaguagaguacauaauacuguagaaagaagaagagcacacaugagacagagaaggagguggaugcuccuggguugagagcaagggguggggguguggaagggacuaggccagaauccccagcagcucucugguuuacagcuccaagggacagaacagcuggugucaagaccuggguuagagguuugucaaacagaggcagggcccagucaccucuuuggaggggagugaugagaaggggauuuuggucaccugagaggguugaguaaacuuggaucagggcacaggcuucucucaccauacucagcuuuuugcacucacucccuaguugagccuacuggcaucaagcucuagaugccaaggcugggauggcuguggagcaggagcuauggcccaaguagcucugagaggggaagagaccuaaaaccccuagcagggaaaauacugacgcuaggugugaacauauccucucuuuucacaagaguccugauggggcuggcugagcuuuuggguacucaucccuacuguuauagcuggagaggauuuggguauugaagcagggaggggcagaucccacgaagugacugcagaucuggaauaauaaguaagggguagaucugcccauagagcucacuuuagaccggccuauacuccuacaaggaauugggguaggaucuucuacucagccuugccacaauagaauggccaaugcccuucuaguauguuuggugaaggucuugaaggcaccauuucccccauccacccuggggagaaauugagucccuaaagucaacgacaaggcuuauugaggcugaguuugcaacagauccgaucugggagguagaaacaaaaaugacugaacaucuuuuuaucccccaaucguuacaaagccuaaauaacucuaaacgggaugggagggcaaauuuuaggucaguugacauccuggagaagauauccuagguccugucucauucccuagaccgcauaacacuccaaccguguaaaucucaggacccugaagaagacagugguaggggagaggaggggagcuagcuuccaaccuacuccacacuugacucccauaggacaacaguaaguguaagggcauuugcaaaaucaaguggaaaguaccucuaggcuggagaaguaggauauucuagccauacagauucaauggaacagagaagagaaaggagguuccauuggcaccauagugagccauucauuugcccagggaagugggugggggcuaaggggcuagguuuggucccauggcuacauuaaaugcuuggcaugacuccagggcugcucuaguuaguggcuccagcacaguaugaguuaggugaguuagguguaggaguguggggacaaggaaaaagggaggaggggucccuagaggcugggugcccauuacauagacucaaauucgucaaugcgcugcuugguguugcccugccggaucuggcgcagggucuuguauuugucucggcccagucgcauguucucagcauggaucaugucauuggcagucuucuuggacucaucucuggcauuggccagcuccgaagugagggccugugaggauguaugggaacacagaggucaauggcuuucucucauuuuaccuccuguuauuugaccagacuucccuucucuucuguuuccuucuuucuuccucacccuuucucucuauauauaaauauugagagucauuuccaacucuguuagaacugcaguggggcaagaauauuaaaaaaaaauaaauaaacuuaggggaccaguugauaauggguauccuuuaagaguagaacaacauacaaaagauucaggugggaauuuugucagcuagauauuuucuuaauguaagaggugaauggagugagugggagguggggcagagagaaaaucucaaaaagggaagagauagcccaaggucugauuaauaagugagaggugccuauccuuaaagcugucacuuaagaacggcuugggcucccauacaacacugggacaggaucuuauaccuaucccccaugauggucuagggaaugccaugggcuacuaaaucaaugcauauaguuuccuugccccuuggcccuacuuguauaccuucaggugcuucugcacacgcucauucuucucugccucagugguacguuccuccucacugcgguccuuggccauagcaucagcccguaggucagcacuagccucugccccauucucauccugcucauccugcucauucucagcaggcucugccacaugagguguacucauggcagucuucagcucagcacgggucuucuccaagucuuccuguaccaucugggccuguccagugacagaaggagagaaagacugucagugagaccaguuaaacuguggcauccuguauaugccuagaacggucuggcaagaggcaggcaccagguaggacaaggcacuucaucugccugauccuuaguuucuucauccauaaaacaagagcaauuguaccaacuuccuagagguauuagagaacuccaguaaguauuugacgaaaccaugagugccuucucccaugcugccugcugugggaaguaugaaagagggagggagccaaaacauaaggaaucuaaggagcuguuaccuaugcauauggcacccauuccuucaaugcuuugcuuuaggcccugugucuuaccuucugcugccacuccacagccucacucuccuucuucugucgggccaucuccagcugggagauucgagcugucagcucugccauuuccaaggccuacggauaaauuggaagccugugagagcugggccuucugguccucaggacccaggugucuucaacccaaguccccugggggacuaguaagggaccuacugcuccacuugcuugcugccucagagacucuuuuaccagacuacuucauuccagucccaucuucccugaccaccacuuccuuuuaagucagagcucccccaccuagacuguaggccucuugaagacaaacaauaugccaucucugucccuuccucauuaucucucccccugccccucuuggcaaguaugcagcugggggccucaguaaagcuuuggccaucauugggucacuuccugaaguggcagauccuuuccugauauccuagaaugcucaggauucgacuaagagucuucccaggacaaguacaggaaagacacucaagugucacaaagcuaucugaacaaggaaaaaagcuuaugcacaccuuggguaaaucucccaugacagcuuccucaugagagacaggucuugguucccucuauucccaccuccaacaguacaaaggaagaguauaugucaaggaguuuggaccacagguucuuaacuucugagucacagaacccuuggaaacugugaugaaaguauggaugccaaaugccccaaaaaugcauagacacauaguuuugcaugugauuucagggagcaaagcuuucaaacagaggcagaaauggguggguucuaauccuuauuuagcuacaauugugugaucuuuggugaaucucuucccugagcucuaauuuccuuaucugggauauuaucucauaugagguuaaucccauaggguuacugggaagaagaaauaaguaaggaaaagggaaauauucccaacacagcaacauacagcaggagcucaaauaugagucccuuuuguucuuuucuccuucccuuuccuuugccaggucaaucagcucagauacccaagaguuaagaaagugaacagaaacuaaggguuagggaagacugcaaaaauuucugggccacacuagugacuucucagcuugcuucugaacuaguuauuugcuggaggcccauggagugguagccugcucuaaaaagccagcauguaagcaaaaguagcuauaaguaaguaggcagacaaggaagaaaguucaguucccauaaucccagcccacccuacagcuuuaccagcuguuccugagucuuuuucuggucccgggaggccugcagcaaggccuccuuggccucuucagcuucuugacgcuccuuggccagcuuuucagccucgcucugggcacgcuuccguuccugcucaaguuccagagcccuacgggucuguucuuccaguucugagcagaaaaggaggggagaaggcagugaagagcacagagauaaagacgacacaauagcuucguuccuggaaaugauccaccccaagacaaagcuggcagaaaguucugagcucucuucuugcccauucuucuucuagucuguagccacaccugaacuacauugucugagucuacagcucaggcagaagguucuccagcucagaguuaggccuggaaaaauccaaucuccaaggugacuccaagccucaccuugcugagccuucuuagucuguuccucgaucugcuucagccucuccaucagcuccuccuucucccguucaaucuucucuuucuccuucucugccauuucacgcuucuucuucucauuuuccagcauagcacuagggaaggagauaaaauggauagaacaggauaacaacgcuccacaaaagccuggggaggccaggcgcgguggcucacaccuguaaucccagcacuuugggaggccgaggugggcagaucacgaggucaggagaucgagaccauccuggcuaacacagugaaaccccgucucuacuaaaaauacaaaaaaaauuggcugggcauaguggcaugcgccuguaguccuagcuacucaggaggcugaggcaggagaauugcuugaagacaggaggcggagguugcagugagcugagauugcgccacugcacuccagcgugggcaaaagagcaagacuccaucuaaaaaaaaaaaaaaaagccuggggaauuccaaggcuugcugccucugggucucucaacccaaccuucccaacacacuuagggauugugaguuugggccacccucccuuaccucuauacccuuguccucauaucauagccccacauaggccaguguacacggggcccugucaauguaccccugagucaggaauccuagcucucccaccaacccacugggugaccuuagcuaugucacugcuuugcucuuguuccccuaucuugaaaaugguccaauaagaccugcccuauccaccuuguuagggagacaaguuuuggcucugugcugggaugaagugcuucaagucuaguaaucucuacggcuagugcaucaguccucaggucuaacacugccugcccuaaagcccagcucuaggcuucuuuuucccagagucuguuacaaaucuggaauaaguauuugcuuuugcuuuuucuugcccuagcaccucuuccaggaaccuucuuaucucccuuggcuagguauucuccaucugggcccucagaauacuuggcuuacccuucuccccaucccucuucuauguuuuugucuccauagcacuucuuaaccaucuuauguaccacauaauuugcuuauuuauuauguucgucuccuccccacuagaaugcuagcuucacaaaagcagagauuuuuggucuuuucuuauucauugcucaauaaauauuuauuaagugaaugaaugacauggccuuuguaccuugaguuauguauauauuguuuucccucucucugcuacuagacugaguagacugugagguccuacagggcaguuuccugcuagauccagcucuguaaaaacugccccucaaacuugguagauuuuuucugaauaaaugugaauauuggugucuaaccucucaucuaugaaguccuagguuggccucauguccugacuuagcaugcagggcaccuuugagaagcuuccuugccccagcccuggccccccacaucagugugcagcaccuaccgcuccaucugcuucuggugcuucuccucccgggccugugccuucaucugcugcaccucaaugguaucaggcuugcgacggcgcauguauaguucaugguuccccaugcacaaggccaagauccgcuuguuaauccgcagccggggagcauagaagacgaaguccuggugggaaaucagcaaucagaaagaauuuggagggacaggugaaggugaucuucugccuucugaaaagcuaaauccaaaagcacuggaaagaauauuuaaucugaccuccugcacuacagaugggaagacuaauuaucagagugguaaagugacuugcccaggguuagacaguagacagacccaagacuagaaacccagguuucuugacucugaaacccauguucuucccauaauuucuuucaaucuuugcuuaugaaaccacaauuucuuucaaucuuugcuugugaaagcauccuaaauuacucuuaaucaaguugaaggauucaaacuuucucugcuaauuagggaacaugcuaggucucaggugaccucuuuuggaagccaaaugaccccugaauaauacccuggugggugcaguauggguggcuggacuguuucuacaaucuccuaaaagcaaauccuagacccagccccuuaaauccuuuuuggaacaaggcaggcuguaaauacauacaugaauacauaaaucuccugaucacugcuuguccugguuguuguuuuuaaaaugagcccuugaucucagcuggcuuuguuacuuaacuuuuucugauaauaguugagcacagcagcaauaaaagaaaacacacaagaaaauccagugaguuugaguuuguuacuacaaauaccacuggaccgaagucaccagcugaugggcaccaccaucuccucugccacugaccacacacugcuacugucucauauagcuuggggugcagguauaaaucccagcucuaccauuuuuagcugugugaucuugggcaaaucacuccaucucucuaaccucaguuuugucagccauaaaauuaguaugcuacuuaguaccuaccugaccauguugcugaggguuuaaggagacaacauguguaaagucccuagcaggggaaguucaggcaccucauggcuggagaagaaucacugagccuucaugaaaagggucaggcucagcauugucacugggccuuguuggacaugcaguaucccagaaaaggggacacucagcucaguuuccuaaccuacccacaaucaccagcugucuggucuugucagcugcaggcuacugaguggguaagaagcauggcgaguguguuagagaaaugaaugaacuuaaagcacuuuuuuggucuuggauugcucuggagaaaagucugagagggcagcaguaaaguucuaccaagaagucuguaggaucaucuucagauuuggacuuuggccacagcccuuucuccacaauaaaaaaaaaagaagucaagggcugggcaugguggcucacgccuauaaucccagcacuuugggaggccaaggcaggcaaaucaccugaggucaggaguucaagaccagcccggccaacauguugaagcccugucucuacuaaaacuacaaaaauuagccaggcaugguggcaugcgccuguaaucccagcuacucgggaggcugagguuguagugagccaagauugcaccacugcacuccagccugggcaacagagcgagacuccaucaaaaaaaagaaagagagagagagagagaggaaggaaggaaggaaucaaauaugugaacaguguccacuuucugggacccaggggcuuggaaauaugagaugcauucgguuuccaccccagaaccucagggcagcagaggcaauggcuaagaagcaguucuuaacacugccuguggcucucccacauccacagugagagagacagguagcagaguagaaccagguacaggaugucugcuggccauuucuuggcaucaacaucccccuccauucccaaucucuauuugugcuuccuguucgugcacaugcgcgcacacacguacacacaaacacaucagaaaaggaagagaaaaauagaauagcaugauugcucauuaugcaggccuuggcaaguaccugucuuggucagagggaggaaucacucaccggggcuuuuuugucaaugggcuugaugacaaauuucuuaucauugaaagagauguuccugauuucacuccaggggaagccuaucuugggaguuagucuguagaaauagaaaccaauaacaucaggacaagggcaagacaagaaggguguagagaacugggggcuugcccucacugucaccuccaagcuucuaugucucucucucucuuuuuuuuuuuuuaaaauaaauagagacgaggucucacuauguuacccagguuggucuugaacucuugggcuugagcaaucuucccuccucagccucccaaagugcugggauuacaggcgugagccacugagccuggccaaacaaacacuucucucuggaggagguagacucagugacagcucagccagugucaucacacgccaccaggucagcugccagcauugagaguucacuaaagaucuccugauaguacaacuaacauaugauuccuugucucaaguuuguuuuguuauguauuuguuugaggcauggaacuuguaacaguuccucaagggaauccccagcccuauuuaacugagucucuucuauccaagcuuacaaaaguuugagagaaaguaaauaaugaacuccaagauucaggaguuauauggaacaauaauuuauugcucuccauccucaccaagagcacaccaagugaaaaauauaagcaagugggauaaggcuacagugagaggauuauaggccaaaagccacuuaaccaucacaggagacuaauuacaaaugcugauaagauagucuaggccugcacgauccaauaaaaacauaaugacugucacauauauaauuuuaaguuuucuaguagccacaugaaaauaaguaaaaagaaauggauguaauaaaauuauaguaaguuuaguuaacccaauauaucuaaaauauuaucauuuaaacauguaaauaaauauuuuuuaaaauauuaagacauuuuacguucuguuuuucacacuaagucuucaaaguccaguguguaguuuacacuuacagcagcacaucucaauucaaaguagccacauuucaaguguucaauagccccauguggcugguggcuaccauaguugacagugugagucuagucaauacaggauuuaguauugacuaagggaaguugugaaaucaucugggcuggacuaaauuagguagaaaaagaacugagaugggacccaagagauauggcccugcuccuuggugaaaagugagcccuagauguuaacgugaccuaaauaaacuaaaagagaucugagauauaccugucauucugcucauagauguugagacccagggcauccacccccagccacagcucugagccuuucuuguucuugaugcugaaguaguucacaccauacaucuccagaucuugagcaaucuucagauauuccaggacagcauccucccuaaaugacacagaguugggggucacaaaguggggcuugugagucagacccaaggagauagaaagccugcuuacucuguacuucugacaaggaucuugcuaucaggagugggaaaggggacaaaaggcaagcagaugauggagaacagagcacagcaugacuuuugcaaagcaaaaucuccuaacaaaaaccuagggucuaagcucccaaggggaauaaagaugggcugacccuugcuggccucuggcauguuggcugccauagaagcaauuuucuuucucucauucauugugacagccucuuauaaaggcacauucuuagcagggcucagaauguggugauggcaaaaugaugauauuuguccuucaacuacacaacccucaaaaaugcuuugccauguguaagagcucccuccauuucuugauagucaaaacuguuugggcuaccaguuaccagcauucagcaaaacaaacaaacaagcaaacaaaaaacagccuuauaaugguccuaguuugccuucuaucgucccuguucccucuuucuccaacauccaccaaugucccuugucaucagucucuucucccuagaacgcauucucauucacccuguaagggaaguggggcccaccacugcuugggcaagcuuaccugagcaugccacgguguuccucaugccacaccuggauccgcuccucccacugguccuuguugaguuugugcuguuccaggacucuggaaagacaaugggugaugaguaguuuaaagcacaaagucccugugcaggagagaagggaagcccauuuagcuuucuaaggggcugaugcaaagaggauguagagucagccaauugaggucacacuggaagcagaccgaaauuauagcaagaagguguuaaacuagacacaaggaauugccugaaagguaagagagcuacaagaauggaugaucaaaaacaacaaggggaacaccuuccuuuguaccuucauccacaaaucaaaugaugugcuguggucccuaagcauagcaguaaugugucaggaguuugugcugacuuuaggggcuaacaguagggauggaccucauggagucagguacacucucuccuagauccucuuaggaccaacacucuauguuuauaagaauacugcucagaaaugaaaggauggccuuuggcuacagagcaaugaacugaguccuaauggcuuucagaaaaaccaacaggcccaaccuccaagaccuacuagauuauaaacaagguuugcuuuaaacaugccaucucagauaucauggcaaugacucagguagaguccccaggguacaagcacuaucccuaauaucuuauggguguguuguacauauaugccauaacuccaaugggacugaggcucccagaaugaagcaaagcuuuuccuucuaauccaaaagacuauggaaauggccauuggguauaguaggaaaaaacuuaguguuaaaauauuaaggugcuaagcuuccaggucuggcucuggcucugccucagaugagcugcaccagauggggaaagucagugugaguaccucugcaccucuauuuccuucgccaggaaauaaggauauugccugcuuuguucauuuuguguguuauugugauacaaaaacaaaaauaaugaguguuuuagagcuuuugacuuugaaguuuacaaaaggggaaagcucuguacacuagcugucaauauuaaaagacuauuugagcuccccauguccucgguuugcuuauuucucucucuccccugugaacuucugauauaagagaucuaaaucaguaaaaagaacugagaaaauggaaccagggaugggugaaagaaauuacucaaucucugguucuauauaagcaccugccuccaggguaauaaaguucuguaaccagguagacagagggaaaacaaaaaggcuuuuuauuuggaaagccagaaaaacaacaacagagucugacacuauaugcaaaugucucuugagcagcauaacacagucuucagacagaccccaauggagaagaacagaucuggcaucccugugaggcagggauuggucagcugugggcugcagccccuuauggccaaggcaaaggagggcagggaaccaccucaccucugcgggagcaacuugucuccggccagguagccagacuuaugcacuuccuuauugaagucgccauacuuagacuggacagcauacgaggccagcagcacagcggucucaggcgggcaguaaauaucaucauugagaaugcccucuuucacuugcagaaagaacaggcgcugagugauguccugaaucaauuccucggacacauccucaggguagaacuuggcacggaacuuaaagagcagggggcuuuccuuccgcacauccugggcagucaccugggaagaguaaggguuauggacucucaaaaaauagguuuuaaggguaauggaguggcuguaggguggggagaaaacacugaaagaucaucaauuugcauaaucuuagacagcuggguggcaacuccccugguaauuaagaaaaauaauacauuacuuucacuggggacugaaucccaugucuguaaucacuuucuguugggaauuucuuccugaaauuaccuuaauaccgacugaugaucagaaaucuucaaaccacuuuuaucugacuauauccaacuauccccaaauucugauaguaggcauaagcucuucuuuuaagcucgucuuauaagucuccuccaacuucauaaauuagcaaaguaaggacuaggauauaugucugaggacugagaacuggcuaaacaagagcacaaauuagaccauuuuuuaaagccugaaauggaauacuaguggcuccacacuuguccagcaaaagacucaacucuuuaggaaaacaagacucuaccagcagaaggugggguaccuacucccuagacacaaucagagaagcaaacugcaggacaguauggagacuucuaaggacaaggccagccaguuugaggauacgaagauggaaggcugccagguucccgugaagaugcugcuugggguggagagcuugcauggacucaaaccaucccauuugggguccaacugagguaaaagaucaagaaagagggaaacaucuauaugggguucagacauuaguugacugcuggagaaggugcagcauaagacuguaagaucuuucagauuuuuuuuuuucuaguucaagaaucuguggcucuuuuuaacaaauccccagccaagcucaguagcucaugccuguaaucccagcacuuugggaggccgaggcgggcggaucacaaggucaggagaucgagaccauccuggcuaaaacggugaaaccccgucucuacuaaaaauacaaaaaauuagccgggcgugguggcaggcaccuguaaucccagcuacucgagaggcugaagcaggagaauggcgugaacccaggaggcggagcuugcagugagccgagauggcaccacugcacuccagccugggcgagagugcgagacuccgucaaaaacaaaacaaaacaaaaacaaacaaacaaaaaaaacacaaauccccuaaagccauugaguuuggagagaugaaggggauaccaauccucucuugaaaagccacuaauggauuugauccaaaacaagucaaaguucaagcuaguguucccauuagaaagaaaagagucucuucuucuuugaaugcuggccauugucgcuguuagaagucaaaguagagacagagcaagagcuuugccuugcuuguguccucgguccuuauucugauccaaguggucaacagaccacccagucacaaacacagcccuagguauccaggauuugccaacuagcacaugguacccucccaggaauguucuggaaaagaaaagaauucuaaauccaacagaggaauaagcaguuaccuucuuauugaguuucagccagguggagaaaccuuuaguguccugguacugcagaccaaagaaccaaacuucccucaagccaauaguuuucaccaccuagaagagaaaaccaaaacaaccaaccauugauugaauacuuccucugugugaggcacagaggacacaaaguuugaagucaauauuauaucugcccuuaaaggguuuaaggugcucagcaucuggcaagaaaauauacuugagcagcaaucaagaacugaugucggcaucucucugcacaaaguacugcugaggcaggaaagggaucuauuacuuaugagcacugacacauaccaagaaccuuacauccaucaucuccuuuaauuuucauaauaccccuaugcuagacuuacaauuaggcccauuuuauagauaucaaaaaugagguucaaauaaaugaaauaacuugcccaaguuucagguugugagugacagaauuaggguucaaaccaggucuguuugacuccaaauccaugcauauccagugauuucugccaccuccuccuucccucuacaaugucacaccacuucccacuuccaugauggauuaaaggcugaagguggagauuguuggauuaacuccuguaucuuguucucuugggccacucccauauauuguccuucauccuuagcaacuggggguaauacccacacccuuaagacugaguuccauuuacaauaccccaaauaaagaauguuugagaagauaaaacggggauugugaaggacucugaagccaugcugugccuggguucugagaggauuuuuuccaacccugaucagagccaagucaugauuccucuuacacagguuuaggguggaaaugaggguagaaauaggguaaguaccucaguguagcagcugaggugcccccuguuguccugagccuccuggcugaacagugggcaggaaaaggaggcuugccaagagaacacagaugagcucuguucucuagucccugacauuagcauguuaauagucuggcccucagcucaaccccagcauacccaccacugucgauggcagcagugaagcugagccacauccuaaugaggucaggcuggccuuaggcagucuuuuuuauuuuguuuuuugggagaaggaugcaaguggaggguaaggguaaggugagaaagaaucauagaaauauaccuggagauggaagcagggaacaaggacccaguuuugcugauguccuucccuuaugaacaaauuaauaucucccuucaaaauacacacacacacaugcacacacacacucacucacaaagacacacauacacacacuaacacuguauccacaaaguuucuauuaugcauccaaagucaggccccacagucacacccagaguuuacaaucuagagcuucagagaccccaaagaaaaaaguagcucauauuuauuaagcaccaaucaugugucaggcgcugaacaguaaacaacccugugagauagcaauuauacccauauuauagaugaggaacuaaggcuuagagagguaaugcaucuaaaauuacagagccauauagaaccaugaugugucugacuauagagcuuguaccuuuucuucucuagcaugcuauguccuaaugccaaguacucauaugagcuuacgacuccugagcuucucaagugauuaauugccuugucucuccuuuggcccaaauuucccauccagguaauaaacuuugaucacuucugcaucgagauaugcuuccuggcauucccacuagacccaagcgacaaccacuuuggggagaagccaugucccccaagucaucgaccuucauugcucaccaggucacccuuccccuucauagcuuggaucaaguaucaggaaaccugagcaaaauguucaugucugucuccaacuagcuguaugauaucaagguagcauauuuccucucugggccucgccuuccuuaucuauccaaauuggggaguauggcuucaaugaucucuuuuuucucuuaaguucuaucauuguacuaauuacauuacaagguuauuuugcaaaugguuaauaaaaacaaucccauuucccagcuaccucuugcugauguggauaauuagaaacauguuuagaaaagaucagugggggugggagguaaugaggaaaguucaaaaggcuuccagaauucaauggccaguugauucccugacucuaagucaauaggcagcuggaacugccagaaaguuucagauggagaaaugugaaugcuuauguugaaauguaauauuggcuuuuugcagaggaugaagguagugggugggcgugaacagaaaagauuuuuuuaaagcaccuuguauaucauccuagaucuaaacagggcccaaggcccaauuaacaguucuaaucauuuuccacaggguugcagaagaauaguguguccagaugcaauuggugggaaaaggcaagauccaagaaacaauccagcugagagagagagaaaaaaaaagagagagagagagaagacccacugaagaugcugaagagaagaagauggaccaugagggccaggauauuaggucauggggggagaacagacuuggaacagaaguaguagagcagugcuaugguuuggaugugguuuguccccaccaaaacucauguugaugcuucauugccgguguggcagugcugggagguagaaucauuaagagguaguauguaaugagagguguuucagucauggggaccccugucccugugaauuacuugaccuuuugucacauuaugaaacagcacaaaggcccucaccagaggcugagcaggugcuggugccaugcucuuggacuuuacagccacuacaauuaggagacaaauaagccucuuuucuguauaaaguaacuagcuccagguauuuuauuauaagaacauaaaaugggcugggcguguuggcucacgcuuauaaucccagcacuuugggaggcugagaugggcagaucaugaggucaggagaucgagaccauccugacuaacauggugaaaccuggucucuacuaaaaauacaaaaaaauuagccgggcaugguggugcgugccuauagucccagcuacucgggaggcugaggcagaagaauagcuugaaccugggagguggaggaugcagugagcugagauugcaccacugcacuccaguaugggugacagaacaagacacugucaaaaacaaacaaacaaacaaacaaacaaaaacaaaacaaaacaaacauaaaauggacucagacaagcagcaacuggucuuugccuguacuaacagacuaauuguagaggcuaagagacuccaagacugaaaggaagugagguaggcacagacuaugcagccagucccagaaaucccaggagugagaccguuagccucuuuuugcaccacguugucuguuucacuauugggugggaguaggggugugauaagagaaggaggauuagccaggugugguggcucaugccuauaaugccagcacuuugggaggccaagacagguggaucaccugaggucaggaguucaagaccagccugaccaacauggugaaaccccgucucuacuaaaaauagaaaauuagcugggugugguggcacaugccuguaaucccagcuacuugggagacugaggcaggagaaucgcuugaacccaggaagcagagguugcagugagccgagaucgcgccauugcacuccagccugggcaacaagagugaaacucugucucaaaaaaaaaaaaaagagagagagagagagaaggaucauggugacuaaaguaguucugagauccagaguaacucaggagaaguugggcaaaguaauaccuaaagugaugucaaaaaaaaaaaaagagagaauucaggcucagugcuggggggagggagggugaucucucugagcacugucucuuccuuugugaacauaaagaaaucagaaacauaaauguuccacuuccuuaggcucuagggcuuaaagagaugaguaauaucucucagccugcacugaagucucaaagugagaaauugaggacguggcgggaaggaaauauggucugaaaucagaauugaaacugaaaaagaacaaagaacaaaaauggaugacuccugaccccaggcuacaaggaaaucucuaaggcccaugggggugcugugaaccauuuuaucaggcaacucuaaaccccuuuuccaagccaaguuuuucuugcuuccagcuuugcuuccaguugagaccuccauuccagaggaaagagaaaccuuauuuucaagugagagcuuagcaucuagcuuccaguuccaggaauaaccucuguggcuccagugacuaggguccuuaucauuccacucugagaaaugguccuaucccugaggaaaaagaaaauucuuuauuggcucccuuugacccgacagccagcuuaucggaucugagccaguauuucucaaagcucccauggaaaaaauccuuaagcagcagaaaauaaugaaugcauauacccaagggacauagggggugugguaggaugggguagggggagauaauagguagauggcuguaacccagcuauaauuucuuugaagccucagguuuaauuauuugugcaaauuuuauauucuacuccauaaauaaugaauuuuuaaaauuauugcaaguaaaauuaaugcucuagaauacuaaaccacauucaucucacagcuuuguaucccuccuggaaccugccccauacaccuaaagaaaguaggacuucaguuuuuaagacacuagcuuaagaaacuggagguuguguauucuacucagcuccaugacuguggagaguuacaggguucaagcaacauaaaauggaaaacugaggugcagugaaaagaaaagaucugccuuggaguacauccucguuaauuaucaggagcuucuggaagcaagaaaaaaaaacccuuuaccuccuuuugacauguggaggcaaccuacaucugaggucuguagaggggagcggagaucaggucagcuuaggagcccagagauucucuucuugaaucccccaugcauuuaucugaguaaacaaacuagugaugucaucagccacuucaaaagcccagaaauucucuucuugaaucccccaugcauuuaucugaguaaacaaacuagugaugucaucagccacuucaaaagcccagagcauggccgggcgcaguggcucauccuguaaucccagcauuuugggaggcuggggcggggcagaucuuuugagcucaggaguucgagaccagcccaggcaacauggugagaccccaucucuacuaaaaauacaaaaagauagcuggugugggcaccuguggucccagcuacuuggaaggcugaagugggaggaucacuugagacuguggggugcgaagguugcagugagaucacaccacugcacuccagccugggugacggagcgagaccuugucuccaaacacacacacacacacacacacacacacacacacacacgagcgugcacgccuagaggagaaugagggaguaaugcuggagccacaagagaagaacugugugagaaacaaugugcaaaacugcaucaaugcccaaacaccugagacccccaagauaccauuacagauuuggcagcaucugcaucagccacccaccugaaagcaaauuauugcaccacuggaaagcaccaagaugggcuaccacuauugcuguuucuguuauuacacauugccuguggucaaguggucaccugcucuauaacagagaacauacucagcugagguucuaaguuucuuucuuuuaucguuuuuuguuuguuuguuuagagauagggucuugcuguuaaccaagcuggagugcaguggugcaaucauagcucacuguaaccuugaacuccuggacucaagugauucuccagccccagccacccaaguagcuaggacuacaggcaugcaccaccaugcccagcuaauuuuuaaguuuuuguagagauggggucucgcuauguugcccaggcuggucugaagcuccuagccucaagugauccucucaccuuggacucccaaagcacuaggauuacaggcaugagccaccaugcccaaccuagcuaggguucuaaguuuuggaagcagguaaaguggaagaagguuccagaggacaguugaucaaaagcauuagaaaaacuggaaaugcuaugugcccugguuuaagccccagcuauaccacuuccuagcuauaugaccuuaaacagauaauuucaccucuguaagccucaguuccucaucuguaagauggagauccuccuacuauaauauauguuaguuauuuuauaaaaugaaaaaaaaaaagguuuacuguccuuauugcagaguauucaaguccuaaguacuuuacugagccagaagaacuuccugauuucauagcucccucaucugaacucucagggcaaugccaccuacuuuaguccuuaauaagaaccaccaauauuagaaugcuugguaugcaccaggcauuuuacuuauuugaggauuaaaucacaaaaucugagauuagcaugauuaucauuuuacaaaggaaaggaaaguacugagaggcuaaaugagccauccaaggucacacagcgaaguaacaggacagaauuugaacucagggcugguucuaaauccuaugcuuuauauaucaccccauggaaccugaccucaagggcguuuauuucuuucuuuguggguagagaguugcaugugccuuucuaugcuuuuauagguaaggaacuccaaguuccugaagaacagagaugguguucgacaguguagaccuucagucaauauuaaaugaaucaguaaauagaugaaugaaucgaugcuuugagauuucaccucuguccuugagcacagcccuuuaguggcaccuagguaauccaagaucaaaagcuuuagaaguugaagcaagugacaaaaucacuauagcaaaacauguucucucuccccucuagcuguagcacacucacaagaagagagguaaaugagacaaacuaugaguccuacuucccuuucccaccaggcccuagacuuccucaagcuauggcaucccauuguugccuauuauuuauugcuggugccaaggaguacuuccucucugguuggcuuccucucuggucauuggccagaugacugcugcguuccaggauggccauaaagcuuuugccaauuccugccaaggagucuagcuccuuccucccaggcccaggcucuaccaggagggccuccuugaaugaugggucccaagagccagacagaacggacuuccucccuuaugccucaucaaguuagagagagaagagcucacaucccccaaaugccuaugaacacauaacucuacugauuccugaccugaccugccuuggccucaagagggccaaaugcucaauuccuugaguucaaaucuuuuucccuguauuuucucaccugugggguccaccucugucccucugacucacagaaugugacugccccccuccuucuuaugauaguccuucagaggucugaagacagaaagcauaucuuccuugagucuucucuaaguugaauacucccaaucaccccaaacagaguagugcagugcaggaaaaguauaguuuugugaucagaguuguauucaaaauuccauaucacaacuuacuaacuacaugaccuagaguauguucuuucaccucacagaggcaggagcauugugaggauuaaagcgccuagccaggaauaggccauaguaugugcucaauaaaugauacuucucaagauaacaaugaugagaagucauggacuucuugguuuccaagucucccaaaggcuuuguuuuggaagcaguagcauucagaacuagcauaccaaucugcccaggguucccuacuaucugggguucccuacuaucuggacuucccucaaauccacacccacagcacacaaaccaaaccaacacuaacaaaaaacuaccaggcauugagguuuuuugaaguuaauaaaccucuuuguucaagaauuuuucugcccccacuaggcuccaaaucaugccuuccucauccuccacagccaucccccugcaaugcacauauacaaagcccccaguguugaggguagaggauggcgucaucugguuugggauggggaauuaguagaaucagggcucuuggaaggaguauagguaaaugucaaaggagccucuggcucccagcuggucuguaaaaucugcacugacuaaccgcuucccucucuaauagcugcuacccagaaugauacugcugucuaaagcaaagggcccaaaagccuauguguucuauggacacuuccucccuuuugucuuagagacaguaaaaagccugucaaggaagagaugaucccccugccagcuagcccuaccuccucacauaugccagcagcugaucauacucaggugaggcauuucucuccuuuuuacagaaaaggauugucugaaaucccaauacuaggaacagaaaugggagagaaagagagauggaaugcacaaauaaaugccagagauaaauuuucugagagauaaccagauuugagaaacaaguuaggcauuguacagaugagaaacugaggcccaaauaagggaaacguuuguaucacagcgaauuagugauagagccaacccuacagcccaagauucaugacuuucuauccaggcccuuuugacuucacuaggcugucccuuuaaaaguucuccaauauaaccuccaugugaagagagaaugcaaagcacaauuauaauuagaaugcauuuagucauuccagacuagcaccauaaucacuugugagcuaugugaauguaagcacaucacuuuaauuguaguaaacuuguauuuaaauauuccucagacuaauuuguauuuucaccaauuaaguaucaaugauuacacuuugccauucaaaguaaaacaaacacaaaacaaacuccagagaaguaaguuccaccuaaaucugaaguuagauauucugaggaucauuaagcccaucucccaauucucccaauucuagauuauuuuucuuuacuuuuuuuuuuuuuuuuuagagacagagucuugcucugucaccuaggcuggaguacaguggcgugaucauagcucacuguaaccuugaacuccugggcuugagcaacccuccuggcacaaucuccugaguagcugggacuauaggugugcaccaccaugccaugcuaauuuuuaaauuuuuuguagagacagggucucgcuguguuacccaggcuggucucgagccccugggcucaagcaauccucccaucucaguguuaggauuacagacaugagccaccacaucacgucaacuccagcucaauuaauaauacaagaagcacaaugguauuggaaagggagcuaucauuuauuacuucucuaccauaugcuggaugcuuucuuccagcuaacacuuucuuuccuauuuguguuuucuuaucuuucucaccuauuucgaauuuaucuuuuuggauuggacauccuuauaugccacuauaaucagauuuuugaguaacagguaagauacaaaacauaacacacucacaaaaauccugugagguaaguauuagauauuucucggggggaggggaugaagauaccaacccagagaguucaauaauuuucccagggucuaacuaggaaaaugaggauuuuguguccucaucuguaaaacaugcccauacuaauucaugcacucacagagcuuugugauagucaaaugcuuaucauaauacuuagcauacacugaguccuggauaaauguuaacucucaucuguauuagccacagacaauaauuuucccacucuauguaauaagaacucagaagguguacccaagcuguccucaaauuucuagcccucuccuaccccugucuccauucuacucuugucuuuucucucaccagucagaaguauucacaggaauagaauuagcuuauuugaacacuaccuccuucuuuuuuucuuccucucuccaacccuggggaaguucucauaugguagaaggacacagagagcaaggaagaaagggaagcaagagggccuggagaauccaucagggugauaugcagccuaacauccuggacaauaacucagaccuccacuucaucggagucugguggagaaauaggauaauggccugucuggugaggucccagccucuggaaaugggagccucauuuuugcuccuagaagucuggccacagacggcacauucccuugaaugcuaaaaaugucuguagcugccaucuguuuauuauaguauacaguacauccuuucugacaauaaugauucacaaugaagggacaccccuuggguuggagaugggaaugaccucuucacuauggcgaguaagcaauuaucuucauggcaugccuguaggagaugaagcagccuccuacugcauccaucaacucccauguuguccuaagucccaacauucuuuugagagaaaugugcauagagcuuacuaccucagggagaguaaguuaguuuccuucuacuaggaagcaaaaacaugggacagaggcaguguggugcaguggcaacaauguggagugcaaaucccagccaaauaucauuugggugcaauuaaguuauuuaacuucugagccucaucauuaaaauggagaagacaucacuuacauguuucagaguuaaaaggaaggcuccauaugcuaagauuuuuaaagcaucuagcauagaauauacaccauuuucuuuucucccuuauucaggaccaaagauaaaauuaaucaggaccauagggugcaggcugccaaaguuuaacuuugccuccuuucauauuaagucuggaaucagccuucauuuugaucuaucuuggagugaacaggaagagagauucuuugacaagaggcaaaagucauggauuguuggcauugugguggaagcuauucagagaaggagaggaggcuaaggagucuccgccuuaccuggucaaauagcugcuucccggugguguugggcuggauggcaaacuccagcucugcauccaugguggucacacgcacacugaucuaggaugagaucaaaggaagcagguuagucaucuggcucuguguucaacagagccugagacaagugucucugcucaaccacagaggaaggaguuaggaugcuaagagccugggcaacuuagauacugauggggaugaagggagaauauugacccaaacacaaccccugcucccaagcagcuuauugaagacaaacaacacagccacagagcaauacuuaccaaagaacagacaagcaugaaggccgggugcaaugccucaugccuguaaucccagcacuuugggaggccgagguggguggauugcuugaggccaggaguucgagaccagccuggguaacauggcaaaaccccaucucuacuaaaaauacaaaaauuauccgggcaugguggugcacaccuguaguucaagcuacuugggaggcugggguaugagaaucacuggaacccagaagguagagguugcagugagccgagaucacaccacugcacuccaaccugggcaacagagcgagacuuugucucaaaaaaauuuuuaaaaaagaaugcagaucagccuacaacuaagagcaggcaaaugauaacuguacuucuuccaggaaggccuuuccaucuauacuagacagcuucaucucacaggguucucuucucaccucugaucuaccuggauuaucuauagcacugguaaacaauugcagaggcaaauuaauaucaggacaaagagcacuggguuccacaugauaaucuaaagggcagaaaaagcuuucaauaaaaucuaacaccccuucauguuaaaaguucucaauaaacuagguauugaaggagcauaccucaaaauaauaagagccaucugauaaagccacaaccaacaucauacugaaugcgccaaagcuggaagcauucccuuuuaaaaccgacacaagacaagaaugcccucucucaccacucauauucaacauaguauuagaaguccuggccagagcaaucagaccagagaaagaaauagagggcaaccaagcaagaggagaggaagucaaacuauccuuguuugcagaugacaugauccuauaucuagaaaauccaauagucucggcccaaaagcuccuuaaucugauaaauaacuucagcaaagucucaguguacaaaaaucaacauacaaaagucacuagcauucguauacaccaacaacagucaagccaagagccaaaucaggaaggcaaucccauucagaacugccacaaaagaauaaauaucuaggaauacuguuaacuagggaagcgaaagaucucuacaagaagaacuacaaaucacugcucaaagaaaucagauaugacacaaacaaauggagaaacaguccaugcucaugaauaggaagaaucaauauuguuaaaauggugauacugcccaaagcaauucauagaauagacucaaugcuauuccuaucaaacuaccaaugacauucuucacagaacuaggaaaaacuauuuuaaaauucauauggaaacaaaaaaacagccugaauaaccauggcaauccuaagcaaaaagaacaaagcuggaggcaucaugcuacccaacuucaaaugauacuagagggcuccaguaaccaaaacagcauuguacugguacaaaaacagacacagagaccaauggagcagaauagagagcccagaaauaaggccacacaccuacaaccaucugaucuuugacaaagucgacaaaaacaagcaauggaaaaaggacucccaauucaauaaacagugcugggauaacugguuagccauauguagaagauugaaacuggaccccauccuuaucucacauauaaaaaucaacucuauauguauuaaagacuuaaauguaaaaguaauguaaaacucaaaauuauaaaaacccucaaagaaaaccuacguaauaccauucugaacauaggaauggacaaagauuucauaacaaagacgccaaaagcaauugcaacaaaagcaaaaauugacaaaugagaucuaacuaaacuaaagagcuucugcacagcaaaagaaacuaucgaguuaacaggcaaccuacggaaccagagaaaauauuugcaaacuaugcaacuuacaaaggucuaauauccagcaucuauaaggaacuuuaacaaauuuacaagaaaaaaaacaaccccauuaaaaugugagcaaaggauaugaagagacacuuuucaaaagaagacauacauguggccaagaagcauauauaaaaaauuuacaucauuagagaaaugcaaaucaaaaccacaaugagauaccaucucacacaagucagaauagcuauuauuaaaaaaucaaaaaaaaauaauaacagaugcuagugagauugcaaagaaaagggaaccuuuauacacuguuggugggaguguaaauuaguucaaccaugguagaaaacaguguggcaauuucucaaagaccugaaaacaaaacuaccauucaacccagcaauaucauuaugggguauauauccaaaggaauauaaaucauucuaucauaaaaauacauaaacgcgcaugugcauugaagcacuauucacaauagcaaugacauggaaucaaccuaaaugccagucaaugguagacuggauaaagaaaauguauguuaguaugcagccauaaaaaacaacaagaucauguccuuugcaggaacaugaauggaguggaggucauuauccuuagcaaacuaaugcaggaacagaaaaucaaaugccagacugggcaugguagcucacaccuguaaucccagcacuuugggaggccaagauggacgcaucccuugaggccaggaguucaagaccagccuggacaauauagcgaaaccccaucucuacuaaaaacacaaaaauuagccaggcaagguggugcacaccuguaaucccagcuacuuugguggcugaggcacgagaaucgcuuuaacccgggaggcagagguuguagaauaccacauguucucacuuauaagugggaauuaaaugaugagaacacacagacacauagaagguggagggugggaggagggagaugaucaggaaaaaauauuuuaauaacuaauggguacuaggcuuaauaccugggugauaaaaugaucuguacaaugaacccccaugacaugaguuuaccuuaugacaaaccugcacauguaccccugaacuuaaaauaaaaauuaaaaacaaagaagaacacuggauuccaagccuagcauguagcuggucaaaucuacaaccuuggauaacuccuguccuuuuccugggccuuaguuucccuuaccugugcaaaggcaggaaugggauggagggcagccaauuaaacuagauaaaugguccaaagaccauuucagugcugaugucggugguucuauauacugccuugcauugcuaaugcuuccuauauuuaugucucauuggcuuccuuaggcucaagaggggaagggggccucaguagagguggguauggguggcauagaggggcuaccaaagccaacucagugggaggacaaaggugcagaaacaggcccagaccaaaauaagagacagccacacacaugauuucacgggcacuagaaaaaauaccaccuuuacaaauagauccucgaagcuaggucaaugauagcugaaauuucauaauuagagauuuaguccuuuggcugaaaacucaguaguaaugguagcaguaguaauaguaacaggcagcagcuuuccuguaucaagacuugcuacucaccaggcacuucauauguacuaccucauuuaauaucaauaaucacccugugaaguagaguauuaucuccacauuggagauaaagaaauagguauuugucuaaagucacauugcuauuaagcaggggagacaggguuugaauccaggucuaaauccaaaccucacaauguaaaccaauaugcuaaauuccucuuacagaguacaaaagucucccauuaaaagaaaaaaaagauugauuuuuaguuguuagauauuuugcuuaaauaauguauauaguacagccacaaaauggcuucuuauauggucauacaaaaucuuuaugaagacuauuucaugcucacggaagacacuuuaguaauauugaggaaauguaaacaguauuucauagaguccgugagcucaacuuuguaaaauguauacauagaaggaugauuggaaucuuguccaaguauuagucaggcuugguuuugggguggugaucuuaugggugcuuucuccuuucuuuaaacuaaaaaaaaaaaaaaaaaaucuaaucuacauuuucuaaguuggucacauacugcuuauaguauugagggaaagcacuagauauaguauugccaaagaugcaaauuuccauggagugaguaagacauuaaaccuuaucagucuuugaaccucuaggacuuuccugaacacacgggucaggagcagggaagagggggccaggcagcuauuuugccagauaaacaauuacgaugaggaucaggcccagaaaacaacuuuguaaauaaaucucgcuagggagccaaggaggaaaucuauuuuaggauugacaaugggacaggaaaggcccugaaggcaggaacaaguaaggcaaguaccccagugggaguaaggcaagguuagccacuuugauuugguccuacccuaggcuuccugccaagucagugaccccuacagaaugggccgucauaaaguaggauggggccauuggacuggaauuugaggggcaccauacuauauccagccucaaaucacccuugagcugggucaagggugaccucaaaacaccaaugacugaagggacaggagagaauagaaagggggcagugggcuuuuuagaauaauagacuucauucucaacucaaaguuuacgucuuacuuagaauuaccuuuccaguacucaagauucaauggguacucaugcaagauguuggcuaaaugaauggguaccaaacaagggauauuggagauagauacagcauaauauacacauacaaagauggggaaauuugacaucuugacuuuuuugugccacgaaucauucuugccugucuagugaagccuauggaccccuucuuagaauauuuguaaaugcaugaaauaaaguagauacaauauaacaaaauuauaucgaaauauuugaaauauaaaucaaaauuuaauaauaugugcuuauuaucauauuaaguaauuaccgagcacuaggucuuauuaguuaguuauugccacuguaauuucaaacguguauugagcauaaauaauauuuugagaaauauacaauaacuaauugugauauaaaaauauguauguuaggggccggguauggugucucacgccuguaaucccagcacuuugggaggccaaggcgggcgaauuacuugaggucaggaguucgagaccagccuggccaacauggugaaaccccaucucuacuaaaaauacaaaaauuaggccaggcgcgguggcucacgccuguaaucccagcacuuugggaggccgaggcagguggaucaccugaugucuggaguucaagaccagcugaccaacauggugaaaccccaccucuacuaaaaauacaaaaaaauuagcugggcgugguggagcaugccuauaaucccagcuacuugggaggcugaggucggagaaucccuugaaccugggaggcggagguugcagcaaguugacaucgcgucauugcacuccagccugggcaaaaagagcaaaacuccaucucaaaaaaauaauaauaauacaaaaauuagccgggcaugguggugcacgccuguagucccagcuacucuggaggcugaggcaggagaaucgcuugaacccaggaggcagaggcugcagugagccaagaucacgucacugcacuccagccugggcaaaaagagcaaaacuccaucucaaaaaaauaauaauaauacaaaaauuagccaggcaugguggugcacgccuguagucccagcuacucuggaggcugaggcaggagaaucgcuugaacccaggaggcagaggcugcagugagccgagaucacgucacugcacuccagccugggugacagagcaagacuucaucuaaaaaaaaaaguacauuagauaguuucuguauaaacuucuauuauuaagaaaccuuaaaaaaaggguagaauccaggaaaacacuccacagccuaagaguugguaacaaggucauggguacugcuauuauugcugccuuuauuuuauuuuuauuuuuauuuuuauuugccuacauuauaauugaacaaauggcuaaauuacaaaggagagguugguaaaaaacaaauaaguaauuuuccuccauccaaguucauauauccuucccacuucaaauucuguccauggaccccauagaggucugaggaccccagguuaaggagcuuccuauaaauucauuucaauucacccaauauuaauggaacacaauguuuaaggaacuaugguuggaacagaccaguagaaccggucccugaucucaaggcacuuacugaaaaacacaaaaacuaaaauguacaagggagacccugaaaagugccauaauagaagaacagagaaaaccuuucguggaaauuaggaaccacaguucaaaguaguguuugcacugauuuccaaagaauaagcuggauuguggaaaagaaagacugugaggguaggcacaagagcacucaaaugucccagguagagaaaacaacauguaugauggcccagaaggaggcaaggaugcagauggucccuuuagaagucaguccuacuccagggugaaugaggccugcaaagugaagagagggcagagucuaggaagauaaguggagggcauugaaggcuaugcuagaagguugggccuuaauccuguuggcaguggccagccagucuagagguucugggcaggguggggcacaaucagaaccaggcuuuuuggaagaaaacacccaggaaggaaacuaagggggggugggauuccagggacauauccuaaagccuaggaguucccuuuaauucacaauauuggaaauaauuuucaaaggaagcaagccagugucucgaacagaucaugucaauuguaggucaugccaauccagcgucuucagggcacugaucaagggugaagcccagugcuggcccaaaguacguaaucaaauauucguuaaacaaauauuuauuaaauaaaucaauugguaaagaagggcccauccugagugaugaauaagcaugucagagaggcuaggguuggccaugcuuccucccucguagaggaucacccugguaaaagggcucuacuaaaaucagaaggugugagcugaaacccaaccagaaccuguuuuuucugaaucucuacucaggguuucugccauuccacuauggcuucuuccccagggauagcagccugagguuuccugaacuucaauguggagauaaauaauuuuggguuuuuaaaaaguuggaaagaaaaacaaacacaaaagaauucccauuccugucuccacuuaacucagaagcaaaugugaguccuguuagcagcacuguaaaccaguacaaccacuguggacaacaguauggagguuucucagaaaacuaaaaauaggacuaccauaugauccagcaaucccacuacuagccauuuauuuauccaaaggaaaaaaaaucaguauauccaagagauaucugcacccucguguuuacugcaucacuacaucacaauagccaagauauggaaucaacccaaguguccaaaaccagaugaauggauaaggaaaauguggcauauauacauaauggaauauuauucagccauaaaaaaugaaauccuggccaggcacaguggcucaugccuguaaucccaacacuuuggguggcugagaugggcagaucaccugaagucaggaguucaagaccagccuggccaacacagcaaaaccccgucucuacuaaaacuacaaaaauuagccaggugugauggcgugugccuguaaucccagcuacucaggaggcugaggcaggagaaucucuugaacccgagaggcggagguugcagugagccaagaucaugccacugcacuccagccugggcaacagagcaagacuccgucucaaaauaaauaaauaaauaaauaaaaauccugucauuugcagcaacauggaugagccugaaggacauuauguuaagugaaauaagccaggcacagaaaguuaaacaccccgccaagcacgguggcucacaccuguaauccccgcacuuugagaggccaaugugggcggaucaccugaggucaggaguucaagaccagcuuggccaacauggcaaaaccccaucucuacuaaaaauacaaaaauuagcugggcaugguggcacacaccuguaaucccagcuacucgggaggcugaagcaggagaaucgcuuaaaccugggaggcagagguugcagugagccaagaucaugccacugcacuccagccugggcaacauagugagacccugucucacaaaaagaaaugauaaauguuugagauggugaguaugcuaauuacucugaucugaucacuauauauuguauauaucaaaacacugcuauguaccccauaaauauguacaauuuauguaugcauuuauuaugaugugucagguuaaaaaaaucaaaauuaggcuggguacagcagcucacaccuguaaaucccaacacuuugggagaccaaggugggaggacagcuugaagccagaagcuagagaucauccugggcaauauagcaagaccaucucuauuuaaaaaaaaaaaucaaguuaaaaaauaauaaaaauuuuaaaauuaaaaauuagaaaaaaacuaagucaugaggacaaggccauuggucuaugcucuccuguuuucuguguacgugucagagguagcagggaguaaggguaguaacagcuggggccugaaagugauagauaggauagaaguccugaucaaagaaggucccuuuguucucucuuagauuaaucagggauucaagagugcaagaugggcugcaggcccagacccacugccacagagggcccacuggaugcucacccuuaguaggcacccauggucuucuuuucgggccuagacgcugcucucucccuaaagagaagacaguggucuuguuugggaggaaagaaccuaaaaaugaaguuuccaaaguuggcagaaaauucccagccaguccuucaguuugacaggaauacaggagcugacccggaugggguagcauuucaagauguaguccccagaagagaacuguuuauaugccuagaucccugccuaagccaggcccugaggaucuaggcacagcaugagguuaaagacugugucucagaagaacauuaagguuugaaggaacaauaacaaaaugucugcauguguguuuggggaaggaggagugucauccucucacaugcacuggcccucccaccuguugcccaagaacaauaagcccacuguuauuuacugagcaauucaacauagacgcuucccacaccaagcacuucacuaagcacaaacaaacucaucucggugguacacuguccaaagccuucaacaaacuggguucucucucaugucuccaguuagcugggcugagacacaaaaguaaccaggccagaugcuaccucugucuuggcaccagcagcugagagguacuuuggugucugggccugccaguuucaaauaagcaacccucucuuugccuaucaucagaagcacccaggugagcuguagcccagcuacagcaaaagggauuagcaaugguuuccccucaccuaccccaugucacugaacuauaagauggcucuuuccuggagagaaguuuggaagagucagagagaaaagcagagaguaagucaaauaauuacaaguaacuugccuggagcauggaccuccgagcugaggggaugaacauuaccauccccacuucauagaugagaaaacugaagugcauagaggcaggugacagaaggauggaaaugaacacuuacugaaugccaacaaugugucggccucaucacacacagucucacuuaacaucacugaggucacauuuacucagccaacaaguaguggaggcgggucuucuggacauuccuggagcuccuuccacaacuccacccaccucuccugucauguugucuucagacacuggcuuggcaacuauuuuggcuaagacucaaacauucuggcauaggaagccugggcacaucugggaagcacugcuugggaagguccccuugucucacuggggcagagguugugagucagcccaguugggucugagcucaaugaccucauuuccaccugccaccuccccagggggccaccccugcugggcuuucaguggggcugcugguguagagaagaaggcaaguauaaguggggcaggggagccagaagaaggaugugcccuaccaacgcaaucccagaguucuaguaucuuccuuggccagagaauagucaucacagcgucacucacacugccuucaucaggucggaagcuaaacuccauuguuuaggcuccaguucccaccauuuccugcuacuaagaguggggccaaggcagggcagggcagguccuggucuguuuugccucucuggaugacagcacugucucaacuagcuuuuuuccauaagagggaaaacaagguuugcuuugaaucuuuagccuaggggccauucugcuccuccuccucuuccuucacugacuaacucacuucucagcaagucagccucuucccuguugacuuggaagugguaacugguacaguuaucugcuaggaccucuuccagacucucaauacagcccauaaaaccugacugggguuaaccuuuccuaugccugugccuuuucccaguagcuucuagaaaggagaacaacacccaaccucacucacaccuuaauggguuagcaguauuucuucaaccacuccaacugcuccagagggcgucagagacaaggguccccuuucauuuguuuugacccagcccugucauccgaagcuccucaagaagcauuucaacuggaagacaagggcacacuggaaacugagaguuacuccuccaauuaccauaugugugaggguuagcaauggaaauauaaccaccuugucccugugggagcagaguucaggucagaggugaaaauugaaagaaaaaaaucagaaacagugaugucacuuuagcaaguuaguuucuucguuaauccagccguaauugcauggccuuuuguucaaccucaggcccagguaaaccccucuuguuuuucucuccacacgugaaagucaggaagaaaaccaucugcuuagugucugaaccuaacuucaguucuuacuuucaaaaucaccuuagccaaaccauacccccagggcaaauacucuccagccccaacucaucucuccuucuuaggcacaugggcugacacaccagcuccuuagcauggccauuccucuuuuuacauuuucucauuauuucaacccaugcauccuagaaucucauauggcuucucccuucugaacuucaacuuguccucuaagaaaauaaacaguccagaaucccaaacugucagaccugaaaaagacgucagagaucacucgauucgaaccuugcaacauacagcuggggaaacugagguccaaagaaagguaggcacuggcccagagccacacagcugcuaggcagugugggaggaggggcuaaaaaccuggcuuuugaggcugggcgcgguggcucacacuuguaaucccagcacuuugggaggccaaggugggaggaucaccugaggucaggaguucgagaccagccugaccaauauggugacauccuguuucuccuaaaaauacaaaaaauuagccaggcaugguguugugugccuguugucccagcuacuagggcggcugagacaggaaaauugcuugaacccgggaagcggagauugcagugagccaagauugcgccacugcacuccagccugggugacggagcaagacuccaucucaaaaaaaaaaaaaaaaccuggcuuuugauccacuagccuauuuaguaagccauagugccagccugacauuuagaaaacaguagauacuucaagcauacuauuauugaucuaaaaaaaaaacuauguggaggaggcuggaucaauuuguuuccgugaaaaacuccaagcuggcacugcuuggaaguuuagcuuucaacagagggcaggccuaacuuucaggaucugagacaaucaccaccacccauucuagggagacuaaauauuuuauaacaccauggaaggagaacucagagagcccuguuuccagaacuguuuucuuuggaaaaacuugaauagcaacugguugggaaggcccccaguaauaggcauagccaagacucaagcuggggauugaggagggcacagagcagagaaagaggaagggaauuugaguaauggguucauauccaggcagccaagaacaacagauuccuucaacucccauaaaacuucaaagcugcugaaauaaaagaagugcagacccaucauuaauaaaguaagucuccagaugggcaaagccccuauccggggccacaccuagcugggcuucacucuuuagcgucacuuuccugcuugacccagcuuccugccagcaaguuuuacaggaaguauuuguagacuggaaacugaccauuuuuggcugccugaauaugccagcucugcccagggugccagaagagggcucuauucccucugcuuaggaacagacuccagcaaccuccagcaucauacuucugaagcacacuggagcugauccaaacccaaacuuggguuccaucuauugcucaugggaauguuaaaacugcugaagccaggauuagucaaauaugcaguugcagggggacgcuucuggcccuaaucaaaaagcucuguuuccagcugagcgugguggcucaugccuguaaucccagcacuuugggagggugaggcaagcagaccgcuugagcccaguuaaagaccagccugggcaaaauggcgaaauucugucucuacaaaaaguacaaaaauuagcugggcaugguggcgcacgccuguagucccagcuacuaauacuuacuuaggaggcugaggcaugagaaucgcuugcuucaacacaggaggcagagguugcagugagccaaaaucuugccacugcacucuauccugugcaacagagagagauccugucaaaaaaaaacaaaaaacaaaaaaccucuguuuucaaccccagggguaggcuaagguuggcuuccuaccuaccuugcugguaagcuaagaaccaaaucuaguaucugggaaacccacagaaaacccaggagcccuuguccuggaaauaauggucucagcauuuugagcuuuggagccuuuuugaccuuccucuuucuaaaauucaguuuccuaaucuauaaaacgggucuaauaauaucgaccucaguacaggguuauugggagauuuaaguuaacauaacagacauguuugacacuggaggaagaaaauaauugaacaguaauaaaaauaaaaauaauaauaauaauagacaugaaaguacuugacacaucauaaguagaaugugaugauuacuaaucccuccccuuuuagccauauuaugacgaauauccuaccugucaggaauaauuuaaaacaaaaaccuguuucacuacagagggcuaggggcugcccaagaagaccucuaaagagcccuucuagcauaaaggacucucacuuucagggaaaacuaaaaggugauuacauuucuaguuggcaagacaaugugaaaccaugcacaacaguuaaauacacauguauuccagcauuauuuuaaauauuuuaucucuugagagagauggggauuuccuccccaagaagcagaauccuauggaaaggcagagcacaacacagcaccuaugcugccuuauuauuuucaaaggcugccugaucuuccuuccuuauucuggacucugccuugccauuuucuccaguuaugucccauuaacacacacaagucugcaacccucaacacaacccacugggaccuccaaacucccucagaugguauccagaagaucacaaacuguuuuuguuuuguuuuguuuuguuuuguuuuagacagagucucacucugucacccaggcuggagugcaauggcgugaucuuggcucacugcaacccccgucucccggguucaagcaauuccccugcuucagccucccaaguagcugcaauuacaggcacccaccacuaugucuggcuaauuuuuguauuuuuaguagagaagggguuucacccuguuguccaggcuggucuugaacuccuggccuuaagugauucgaccgccuuugccucccaaagugcugcgauuacaggcgugagccaccacgccuggccugggaugguguuaauaugacuagagggaugucugauagaagggaaacacagcaaguaaagagcaacugaaaggccgggugcgguggcucacgccuguaaucccaacacuuugggaggccaaggcgggcagaucacuugaggccaggaguucaagaccagccuggccaacauggugaaaccccgucucuacuaaaaauacaaaaauuagccagguguagcggugcauucuuguagucccagcuacuugggaggcugaggaaggagaaucgcuugaacccgggaggcagagguugcagugagccgagauugcaccacuguccugcagcaugggcgacaggcgacagaggaagacuccgucucaaaaaaaaaaaaaaaagccaauugaauacgguccacauccacaaaagaucaaggaugcaaggaugcagucaguucugcuacugcccucaaaucccucugcaccuuggccucccuauuuguaaaguagugcagggauuaucccugcuccucccuaccuaaaaucaucacuacacaccaucacauacaccacugugcacuaaaguaaugucucuguaguaagaggaacauagcuuuguauucugaaaaccugaucucaagauccaggucuaccaauaauaaaccaugaacucuuaaauuucaacuuguaacgugggcauaaugaugccaccauggcaggaguguugugcagugcuuaaugagguauaucccaaacuuagcuuaccauaagaauuuggcacuggucaaaaaguccagacuucuggacaccaccccaagcuuacugaaauggacucuccagagaagacgcuggggaauuagcauuuuaacaaaugccucaggugauucuuuccaucugaaaaguucaaagaaacaacacauggccuugaugcuguugaaaugagagaacaggaccagggaucucuggucauccaaaaugcuuucuggcccagagauccccaugacaggaaccuugagguuagcacccagcaaaguaaggucugcaggcaggaagaggaggagacuuugaaauuacaaucagaacgcuaagugcaccagacccucagaccauuguccaggaucuucaaccauccucccaucuagcuaagaaucaaacagugggagaaaacagacaguucagauacuucagcagccaaagcaugaugaucacaaugcuauaauuagggccccacucaaagcccucuugaguucucugcgucuuaaacacuccacauucacucuuuccuggaagaacuuucaggcaaggagcagaccuuaaaugaagcucucucuuuccuugaugcucuuggaacuugaggaaaagaagaggcaugguugagaggaugcugcauuugcauacagaugugaguauguuggagggugaggguaggagucuaaaauaggugugacuagcaauggugcacuagaaccagcuugcacuagagcugaucaugcacaucucuucccaacuccuccaucaaggacugcauauugguaaccugaaaucagccauggugggaguauuuauaccaugggaauuggcaaacaguaaaaaucauggauuugccgaagaguugauuguuaaacauuuaccagcacacuggacaagagacacaugcaaguuaagcauuauuaaacccauuuuaugaaugaggaaacugagucucaaagaaaggaaccaacugcuauuuucuagcugcaugaccuugaccaagagccaagucugucuggcuagcuauaaaucccuggcucuccuuaccagcaccccaggguagcaggacauccuuacuaucagccaaaagguggcugacccaaagggcuccccaucagcuaaaggccaaacaagggcaccuaauugugcccagugcacuccaaggaaaucugaggauaaagaguucaggacugagacaugaagccaacaagagacagucucauccccaccagaggagagaggcuggagugaggcagggagugggcuagaaaaccccaauagaaaccauaggacauucuuaagaucucuucacaaauaccugacagaaacccugggcucuagagguagucucuggaacauuacaagucccuagaccucuuaaagccucaguuuuccuacagguaaaaugggaguaauaaugccuaccucaccggaguguugcaaggcugacauuuuauccuuuacaaacagaaaagcaccuggcuugguaccuggcauguaguagauguuucauaaauuuuaguuccuuucuccugcaaugccauuauccaacccagauucuuccagggucucuggcucacuuguauacaacaauaauccuagccccaugcgcacagugcucuacaauuuaaaagauacuugcccauaugcauucucucacugaauuaaacccuguaagaaaaagacaagcccgagacaaguaccauuuuaaagaagggagaaauggagguucaguaagguaaaaagcaacaugcucaagugugaaagaaauagaacuagaacccugaucuccccaacuacuaguauucuguucuuuaccuuuccaaguuuaucuuauuuaaggcuacacaaagguccuuccaaaggcuugccuauuaucauuugucuuuuuuuuuuuuuuuuuuuuuuugaaacagauucucgcucuguugcccaggcuggagugcaguggcaccaucucggcucacugcaagcuccgccuccuggguucacgccauucuccugccucagccuuccgaguagcugggacuacaggcgcccaccaccacacccagcuauuuuuuuuuauuuuuaguagagacgguguuucacuguguuagccaggauggucucgaucucccgaccucgugauccacccgccucggccucccaaagugcugggauuacaggcgugagccaccgcuccuggcuuaucauuuguuucauccaagaaauugagcagccucuggacuucaggucugucuuaggaugcuacaaaagaggcugucuuugggaaaggagaauagcauugguaacacagggugggaacagcccuugugguagaaggagccacaucuuuagcucggagcaaccagccaugaauggugguucagagauugggucucugaguccaaucccaguaaacuucggauauuuacuucccccuguaggucugaguguucccaacuguaauggcuggguuuugcucagugguuuugacuuuauuacauuucuaacagcuuccugccuccucaaucucccaaacagaaaaucacacaaaacuucaaaauaugaaguacguaaaaguagagcuguucugguugaagggaggcuguagcucaccagguagcccagccaaacaguuuguaacccacuggauuagcagcuugacgggagggagagagcccuaggucugaccuucuagaauucuacucauccuagcuuugccacugauuccuuauaggacuuauaugacuuucugggcuucaguuuccccaucuguaaugugaagugguuggucuaguuggccucuaaagguccuuucagcauugcgauuucaggaaaaaaguguccagcuauucccacaguagaaaacuguggagagagaccagcaugagcaaaggucaaucucuacucugaagaaagcccuucaggcucuggugacucugaacugaacucuucaggcaauuccucaagcacugggugggugggcagacaggcaggaaggccggcgccccacccucuuuugcacaggaagcuagcuacauccucuuuuccccaccccaggcagaacaucaccacagguccccagcagaagcaguggggggcagggagaagagaaggauggggccugaaaggaaguugaacaugcaaaucaccucagcuaaggagccauuuguggggagggaaacaacuggggcccugagaaagagcagcaaagcugcccauuaucuacuggggcccagcuccccaauaaagcuuagcaaaaguggccugaagccacaggcugucauaaagaaucacaaggcauggguugguacagugagcagccugggcccacucacuccaccucacugaguuucugcaagccaaacagcuggggcucuuacacaagguguuucucagguacagucuuucuuaggguaagaacacagacaugccaugugcgagggugggguguacacaugagugaacaaucaagaauacaggagcucuucaugccucucaaagccaagaaggcaagcacuaauccucauggccuuaccaccagcccauuuuccggugcccacccccauacccugugacuggggcccagcccuccccacauccuguucucagagaacacgcggcugccuaaggaaagauaaugucauuaccauaccuccccuccauagaggaggcuuugguugacuggggagggagcugcaguuuucugucugaccagacugaauaaucuacaguaaaucucccaguuucacagaauggaacaggaaggguaacuagguaacacuaggagcaacuucuaaauuggaggauccaugccuacagauagaugaucaugauucaaagcacuucuggaaaaagaaauuuucuggaaaaacacaaauugacaauuuaacuuacauuuggagacuggaagaugacaugccaauguucuuccuugauuaacaaaccaggaaaugcaaaaauacaauaaaauuacaguuuuaaaaaggucccaaaugucaaucaagucucacuacacauggguuuuagaugccagcauugguauuucugcuaaagcacccugauuuaaaugugccuacaguggcuuuggccacuuugaaaaagaaaaugaucucaggccauaggaagguccccugacaaacucaaagaggaaggggcagugaggaggaaccacagccugaaccuacccauuguugaaacuuccuucucuccucucuaaacagcucggacucccuggcucccccuugucuucccuccccacccuauaaauauagcaaagaauguggcugaacauccaucugaauauucagggagagccuccuuacucacguaagaaguuggaaggcagaugucauuccacagcacugccucacuacugugcagaccuucaauguggcaugauccuugguugggcuuguaugggggacuuuggcuggcuaccccuaagcaggauguccccaaccccccacccagccugcuguuccccuaggcuaaucuuacagccuaauccaauucucauccccauuagggaacaagguuuaucacguaggccuuaagaaaaaauuuuuugagaguagucucaaaaauaccuaccuccaguggaugugcugaagguugaaagguggccucauaaccugcugcaaguguauuuguuuacagccauuagcucacagccuucauuuuuguaugaccgccuuccuggaagcagagguucagagagcccaaagaaugcucuugggcuguauggaucuaugauuguuuuggaagagucucuugguggcaaggauaagauaagagaccacauggcauccagcuuauuaguuuuggucccuauguagcuugagguaacuucucuaaaagcuggcuuuguuuuuucgaguugauaaagccacaucuuucccuccaaaccacaagcucagcuaacaauuuacugagacuaguaaaaacuauuuaaccuauccugcaauaauacaaggguuuuuagcaccccuaccaccacaaacauauaaccuucacaccccucaaugcugaggugagcgagcaugaaccuaucuagccccccacacacauauucauaucaguucuuuggagagaauaagaauccuacccccagccccgaauguuuggucuaguuuuuucagacaacaguaaagaggccaaccagaaucucuauggaaauuacccagaagccucccuaauggucaaggcaacauacauuguuccauaauccaaagcaaacccuaaaaaucuacuauucuagcaagaucuggaaaaacaaguaaggcuaccucuuaccuaccucagguguuucagaaagaacccacaucauugacacagacauauguauacacauacagguucuacauaccaccacuuuaucagacacccaauauggaucggaucaggcuuugaaauaauucgugugugugugugugugugugugugugaaugagcaagcacgugagggcauuuuuuugucagauggaggaaauaugcagauaaauggaugagaaauuaccauucuauacagcaagggcagagauagagguaauuaaaguggacuguggaaacacaagcaagaggcauccaggccauaauggggaaggugaggagacaaggggaggugagaaggcagaagguugcuugagauagagcugaccucuccugaaggacaaaggagacugucacaagaaaaagauuaaagggaaaaggaaccucaugguauucuggguagagagacagcauguacagggauacagagguaagaaacacaaaguaugccuuucucucaaaggcaugaaguuaaauaucagugucuccuuucccagcuuccugacccucuucccagaauuuaucagaagaaaaugaauuaaagaucuucccaccacuuuggcauuaggugccagcucauagauuugggggagaugggccacaaucagagacagaaaucccugaagacaaagccaggcaagauagacuaauguauaaaauaaagauaagaagcugauuauguucccacagccccacugaggcaccagcuuagcuuaaugagcacuccccacccuagcucacacagaccucagaggaaucacucuucaggacuugagggagcccaugacaacauacuuucuuucuuuguuuuuuuuuuuuuuuuuuuuuuuuuuugagacagaguuuugucuuguagcccagccuggagugcaauggcacgaucucaugaucucggcuaacugcaacuuccaccucccagguucaagcuauucucaugccucagcaacccaaguagcugggaucacaggcaugugccaccacgcauggcuaauuuuguauuuuuaguagagacgggguuucaccauguugaucaggcuggucucgaacuccugaccucagguuauccacccaccucagccucccaaagugcugggauuacaggcgugagccaacacgcccggcccgacaacauacuuucaauacacauggauaaccugccuaccuacagauagaccuggaaaggcaaccaaacuaagaucccucugcaucuauacuccaccaccaccaccaccacacacacacacacacacacacacacacgcagacacacacacacacaaagaagaagugaaagcuaccagcauaacaagggccugaggugggccccagccaaggcugccuggcuucugcaaagggguggagauccauugauuucacaaacuguuuugccuucuuaaguaaggauuccucuaaucauuuucuccuuccuacauccuccauucuucacaccccauaaccauccuuucuacccugggucucaugucccucuucuccuuuucuacuacucccucauccugggacuuuuaaggcuucccagagcuggaguuccucuuuacaaagugauagauacacccacauggauucucagacaaccguucccuccaacagauugcagcagaaggcacgauggguuucaccacaaacuaggccagucauuggcaucacuguuugaaguaucaguuuccucaucuauuaaaacaaaaccguaaagagugccgggcgugguggcucacgccuguaaucccagcacuuuuggaggcugaggcggguggauuacuugaggccaggaguuccagaacuagccuggacaacauggugaaaccccaucucuacuaaaauacaaaaauuagccgggcgugguggugcaugccucuagucccagcuccucgggaggcugagacagggaaucgcuggaaccugggaggcaaaggcugcagugagcggagaucgugccacugcauuccagccugggcgacagacagagacuccgucucaaaaaaaaaaaaaaaucuuaaagagauaauguaguauaggaggcacacucacaaauuaaaagcagacuucaggguucuaaaauuauuugaucucaaauccuuaaagagggcaaaguaugauggaaaagacuuagggaacucagccauuuaucaagcacuuucaauaugccagguacucuccuagauauacucauacucuugagcucuuuuaacucucauaaaucucagugaaguagguaucaguacuauccuccguuuuguuuuuuuuuuuuguuuuuuguuuguguguuuguuugagauggagucuugcucugucacccaggcuguagugcaguggugcgaucuuggcucacugcaaccuccgccuccuggguucaagcgauucuccugccucagccucccgaauagcugggaauacaggcacaugccaccaugcccggcuaauuuuuuguauuuuuaguagagacgggguuucaccguguuagccaggauggucuggaucuccugaccucgugaucugcccgccucggccucccaaagugcugggauuacaggcgugagccacugcgcccggcccacuauccuccauuuuaaagauggggaaacuaagguugagagacauuaaauacauuacccaaagucaugcagcaauaaauaaugguuaaaaugauucuaauauuuggucugucauuuaucuuauaacuaccacccuccuuucucuugaaucaacuugagcaauguugaugagacucuaggccccccaaaaaaaucgcaggaagaccugaggcaacucuacuuaggaugcucaccauuaauuaucaccugaaaaccauuuaagccaaccucacucauugacuacucauaaauauucuuuagucccuaaagggaaauuuauagcacuaaaugcccacaagagaaagcaggaaagaucuaaaauugacacccuaacaucacaauuaaaagaacuagagaagcaagagcaaacacaucaaaagcuagcagaaggcaagaaauaacuaagaucagugcagaacugaaggagauagagacacaaaaaacccuucaaaaaaucaaugaacccaggagcugauuuuuugaaaaguacaauuuuaauucuaacccuaggugaccacagaccccauguauacauggaaggagacacaaugguuugguuaguuaguaaccaacauggaagguauuuaugauuggcuacaagaagcaggauucaaaggccugcagugugucuggaucaggaaagaggugacuauaaagaagccaugaguauauaagaaauagguauacaauaaauuggcagucuaaagcacagacuagcagagauuggcaaacugucucuguaagccacuuauagucuugguuacauauucuuuuuucuuuuuuaaaaaaacaacgcuggccgaggugggaggaucaccugaggccaggaguucgagaccagccuagccaauauggcgaaaccucguaucuacuaaaaauacaaaaauuagcuaggagugguggugggcgccuguaaucccagcuauucaggaggcugaggcaggagaaucgcuugaaccugggaggcagaaguugcagugagccgagaucaugccacugcacuccagccugggcaacaagagcaaaacuccgucugaaaacaaaacaaaacaaacaaaaaccaacaaacaaacaaaaaauguuuuuaaaaugguaaaacuuauuuuuaugauacauacaaaaacugguccaacaggcaaguucaccaauuccuagacuuaaccaaauacugauaacuccacugacuaucugcaaggccucaaaccuggauaaauaucucuuuucacauucuacuuuccaaaaaagauggacagcaaagguuuuaucugaaaguuagccaaagauaacuggcccacauaccaauugaucauacauagcagccuacucccuuccuaugcaaaggcacuggcagaaaaaauagauaauaagcuuagaccacuaaccaucuuccacaaaagcucauuccauucucauacuaggaaggcccugggccaagcugauccccacaauaggaggccccaggccaggggcugagccauaaaguaccugacucccaggccucuggcucaaaucccugaccuuagagagcaacaggcaugcaugaagaagaaagaagcaagaaggggaucccucccagcuggccaauuaagggcucaagaagcaaaggaacaugugugccuugcuucucucccuauucccucagaaaagguuuggagaauaaaaggaaaucaagcuaaggaugccaaacucaaugggagugagaggcuaagaaugaaagaaggccaccacagagcuccacggcuaaugaccuccauuaguggccaacacuacacuaaggccuuucuccucuggacuaagucuaggauguucaugaucugcuuggcccuucucucaaaaguggugggaagaaacaaccauucaggagugccuaccuucuaaccucccacccuggcucuucacaauuguuccuccucuagaaaaagaaaagagccgggaacaguggcucacgccuguaaucccaacacuuugggaggcugagguggguggauuaccuaaggccagguguucaagaccagccuggccaacauggugaaaccccaucucuacuaaaaauacaaaaaauuaaccaggcguggaggcgggcaccuggaaucccagcuacucgggaggcugaggcagcauaaucacuugaacccaggaggcgaaaguugcaguaagucgagauugcaccauugcacuccagccugggcaacaagagcaaaacuccaucucaaaaaaaaaggaaaagaaacaaaaagaaauaaaaaacaucuacaugugaaaguauauacaccugaaaaguuaacuacugcuaagaauuauagguggauuucuggauccaagaggugccagacagccaacuguggaugcagcccuuccuuuccuccccuguuagcuuccauagucuucagccaggagauagggggcuucuggggaaucuaaucugacucaagggagaggauaagacaaaaaaugcccuuaaaccaauucagcagcuauugaaccccugcaaagugugggguauuuuacucugcacugggaauacagagacuaugccaaguacuacuucaagggguuccccaccuaguaggaaaaagacauaauucuuggaccccagagaaugaaguguguacuauauccacccuaaagcucccaguuaccuuucucuccuaagaaaaguuccuuuugauacuggcgagagaaaagaaacccaaaguguccuacucaugcugcuugcuucucuccauuaagcaccuucccaugccccuaggaaggacuuggaacaaagcccccuuuccuaccauagaaggagcuuauucucuacucgggauacuacauguaaaacaguggaaaaauaaucaaagaccacacugugauacagugugccccaauaugcgcgagagcuugauccacucugaaaggauaguagcaguaggggcuggggccaaggagaggcugcucuauggcugggcucacucccuaaucaagcguaaaggccauccagcugaagcaggaagcagagaacaagcaguccucaguucccaggcacaagacacacgucuuggacacugagacagggcuccagcccugcaaguccacauggaucugaggagugaagucaccagguccuugagcucaccagcucccuauaauguucccacuaacugaaugucuugaugcccacagcauuacucaccuccuauccuguucuauccuuccccuuucccccaaccacuggucugcucacgcccagacggugaacucacucucuaaaaagggcugcucaccucccuugggugcaauuaguuaaccccaccccuuccuccagcacuuuuggguugggggccauaacuacuaucuccuucuggaccucugaccaaguuuagaggauguccaauugaacuguuagaagaguccaaagagcccuggaaaaagcauuagcucagugcucagaucagcuguauccaugccauauugacaugggcacaggccucccuccccuuucucugguucaguuuugucacauguagcaaggagaggcuucuauuagagaugcaguaaucaaccuuugcccaauguuagaauucccugugggagugcucagaaaauauugauucccaaagccuuaacccaaaccaauuaaucagagucuacacgugcuccuacaaacuggucaagaucaauuacacaggcaagcuggacuuccccagguacacccuggccaagguagaucagaaggcagggagccuagauggcuccaugcaaaacucagcccccuacuauaagaagggcagcucuaacagucaacauuaagcuucauucugguuuccaaaggucaugaguucaaauuucccccuuuuuccaaaccuugcuucaaguccacaagaaaaaaaauuaaaauguauuggaacuagcaaauccaaccccacaugcuuugacaucaggcaagcauuacaacuuuuccuuucucuaaaggaccaguccuaucugccauugugaauuguuuuuuucauuugccacauauggucucuauggcccaauuuuaagaaucucccacccuucacagagggaauggugacaagagagagcugcucuuccugcauccacagccuuuuggcugcucuagugacacauucccaugugaugguaucacauuccugagggcguaccaacugcuugugaccaggaacuaccuggccacagacugggauaaaccaucuaccucaugaugucagcuuaucaccuguuucugguggguucucuaugaacuaccucuccagggcacuucuucccuccucauccacauccggccucuaaugaugccuguucaccccuccacccaguuaugcucccuuacaaaauucagacacagcugaccacuuccaacuuuuuggagcugguagaguuguccauuuggcucaguuccgcacagaacaaaaccauuucugagaugugugccaccauucccguacccaugggagggcagaccagccuccauuguuaggggaguauaacauuucugaauaaaucagaguuucagagcaggaaauagcccucagagguuagccaaaccaaccucuuguggaacaggcuauggcccaaaaacgagcaaggacuuggucaagauugcucuggaaagcuaacagcaaggcccagcauaaacaacagcucuucaacuaaaaaagagugccuuuuccaugauucuccaauaccucuuccucucaacaaaaaguuggauugaugcucuugcucccaccaagguacaaacaagacucuacauuagcuaggucuaagcagcccccaaacaauucucaccuacuaauaagcaacucccauauguccaggagcauggcaaaacaaaauaaguuauuggcucaaccagguggaaagcacaauuagccuugaaggcaguggucugacacuaccaagaauggguuacacaggaagccaguugcaaaaccagagucaggccaggccccaaguaggcaggacacaaauauaacagguggccauccccacacagcccccaagugcucucucucuaaacauuagucuugacuuacaauauuuagaagagagacugaaaagagguugggcaaccacuggaacgggggaagggccaaauguuuaaagcugaaacuuccuuucuagcuucagaacucugaccuaaccaugaccagagcuuaaguccaggccuuuaugaaacaacacugccuucccuucccacacuccaccccgugcauagucgaaaaccaaagucuucugucucccaaucaagccuugucuccauuacucauuagcugaguaauuuuugcagccacuuaaagucuaugagccccaguuuucccuuauguaaaaguaaagauaauaauuccuggcuggguguguuggcucacaccuguaaucccagcacuuugagaggccgaagugggcggaucucuugagcccaggaguucgcgacuaggcuggccaacacagugaaacccugucucuauuuuaaaaaauaauuuuaaaaaagauaauaauuccuaaccugccaacuguagagaguugaugaauaucaaaugacauaguaauaacaauaaaaaagaguuuuacaacuaugaaacuuguuacaaauauagagaauuaucauuacuuggacacuggaaaaaaauuacagggcaaugccagccaaccugucaagagauuccuucaauucgcaucugacuuggcuauuuuaaacagaaaacuauuuggaaaaugggcagcuauccccuaaaauuauaaauccuuuccagcuuccuaacccuagaauuucuuuuucugggauguuaagcagcuagagguuccagaagaacuugccccaagagguuccuaauggcucuuuuaagauuuucuuuaagcuugguucuucuugccaaaggacaaucucaguagagugugaugaagggagaacuacucgacucucccuggaauaaaaguccaugcagggcacacucaaacaugucuucucaaccuccgaucuuugaaggauugccuccuuucuaauccgauucucauaaauaugcugccucuaccugaguucacagcuggagggauggucagugaaggcacaaaugaccugagaaguagaagccuaucacuuuccuugcuccagagugcaaaguucaccauuuuccuuauaguuaaggucaguuacccacaucaacauaagaguaauacucuauggauuacucagcaacagcaaccuaaccacuucacccuggaaacuuuuaggacacguuugcauaacuaauuauguguuauuuggauuaucagaagagccuguauucccugagcucacauuauuuagaacaggcaguccacagguagcugagaagagaggggauuuuuuuguuuguuuguuuguguguuuguuuguuuuuugagagagucucgcucugucacccaggcuggagugcaguggcucaaucucagcucacugcaaccucugccucccagauucaagcgauucuccugccucagccuccugaguagcugggauuauaagcacucgccaccacacccagcuaauuuuuuuaguauuuuuaguagagacgggguuucaccauguuggucaggcuggucucaaacuccugaccucgugauccacccgccucagccucccaaagugcugggauuauaggcaugagccaccacgccuggccgagaagagaguuuuauuauggaugguugagagaugauuauauggcaaugccucauugguccuaaauggucuauaaaugagcuguaucacagaagugaacauuuucugauaacugaggcucacccguuuaaggaucauaacuauucuuaguggugagcugaaagucuuucaucuacugauauacucuacugcuuuugucaacagagacuauuaaaacaugauuuaaacuucucugagcaccugaauccugaacacuugauuuucuacgagcuaacauuucagagccuuccacugcuaacuuauccaaguuucccaccaauucugagguuaacacauaaucauucccacuuuaccaacgggagaaguggaggcucagggagguuaagggauuucuccaaggucaaacagcaaguaaguauggaaacacagauauuccugcaagccuggccuacaauaaaugccuggagauacuuuggauccacaccuucucaaguagcccaaaaaauuauuuaaaaugucauuuccuuuuccuuuuggaaccugaucucaaacucccugccucacaaagcuccugaaagugccaaucacuaagagugugcaggcagcuuccuguuugucugaaggggaagggaauaaugccugcaguggccugugggccuagcccagucagggucaaccucugguagcagagguuccaggauuaaaggcugggcaagcagaacucugccccaccaacuguggaagucugggaauaaaaaggcaagagaaagguggggccugccaugagugggcagaauagagccagcauuucugguaauucugcuucuccucuaguggccugguuccuucaacauaaucaauacucucaaguuagaaagcuucuaagaccaggaccagugaccacuaggcuagaauuuuucuuucaaaauauuuguauuucacaaaucacuaucuuccucaauuauucaacugguggcucaccuacagcugagugcucugcaaaauuccacuuuccuaccaccuggacaagauuccugauguguauguuguuaggaaggggauucuaaucuagcuucucugauaauugacaggcccuuccacagcucuucuuuguuuguuuguuuguuuguuuuuaagccagucaaauuuagcagugggggguuguacacccacuucaguggcugaggcgugguggcucacgccugcaaucccaacacuuugggaggucaaggcaggaagauugcuugaagccaacaguucaagaccagccuggccaacacggcaaaaaccugucucuacuaaaaauauuaaaauuggccaggcacaguggugcacgccuauacuugggaggcugaggcaugagaacugcuugaaccuggaagguggaggcuaccgugagccaagaucauaccacugcacuccaaccugggugacagagcaagacucugucucaaaaaaacaaaaacaaaaacaaaaacuucagugaugcuaauguuaacaaguucugacaacccaguaccaucgguaacccacuaccaucggaccagccuccacugcucuucuguggagaacauuggaaaagcaugugccuaucacaaacacacacauauguacacucacaaaguuucuuuccuucaccucagacagcuccaacagccagaggucuucugaggugcaggauucucagucagguacugucuggaaucaaaccaccccaagcuggcaaaaccacaaaacaggaaggggaccaugcuaagcauagaaaauaaguuuauccuaccacuaaucacuccacugagcucauuuagacacaggaucuaaagcaaucucuauagguggggccuacugagcauagaaaggggagcagcuaccaucaucuuucaucgcaacagaaggguucacauaucacaucuucagaaaaccuucccucucagacagacaaauccucauuacaacuucuuuauuuuccacuuaaugaagaguauggccccuuuauuuguguagauuuuaaguguuccaccaauucauccaggcauugguggcucacgccuuuaaucccaacacuuugggaggcugaggugauaggauugcuugagcccaggagcucaagacuagccugggcaacauagcuaguacccuguccauacaaaaaauagaaaaauaacugggcaugguagaaugcaccuguagucuuagccacucagggggcugagacaggaggacugcuuaagcccaagaguuggagguuacagugugcuaugaucacaccacugcacuccggccuggguaacagagugagacgcugucucuauauaaaaaagcuuuuuuggccaggcacaguggcuuacgcuuauaaucccagcacuuugggaggccgaggcggguggauuacuggaggucaggaguucgagaccagccugaccaacaugaugaaaccccaucucuacuaaaaauacaaaauuagucuggcgugguggcaugugccuguaaucccaguuacucgggaggccgaggcaggagaauagcuugaacccgggaggcagagguugcagugagccgagaucgcgccauugcacuccagccugggcaaaaagagcaaaacucugccucaaaaaaaaaaaagaaaaaaaagauuuuaauguuuaaaaaguguucuaccuauuugcugauuugcuuauuaaugagccccuguagacuuuaaaaucggauuugacauuaaaagauggccagcacauacuaaguuaaaaaagcagaacaauacggauuuguacuaucugugcauuuaaaggcauauauauacaaaugcaugaaaaaagagucuaugggcugggcgcaguggcucaugccuguaauccccgcacuuugggaggccgaggcagguggaucaccugaggucaggaguucaagaccaggcuggccaacauggcaagaccacauuucuacuaaaaauagaaaaaauuagcuggacaugguggcaggcaccuauaaccccagcuacucgggagacugaggcaugagaaucacuugaaccugggaggcggagguugcagugagccaagaucgcaucacugcacuccagccugggcaacagagcaagacuccaucucaaaaaaaaaaaaaaaagaaaaagaaagaaagaaaaaaaagaguuuauguucacauaacuaacugguuaaugaugguugucucuggagaauacagucaggggcagaagacaggaggcuuuauauuuuucaaugcuguuucauuucuuacaacaaacauguuuaguuucauaaugaaaaauuaauccaaaauuguaaaacaaagucuguauuuauuuaaaucuguuccaccacacagcagagauugugucuguuaacuuuccuuauauggcucaggacuaaaaaaacagaugggaaaaguccuuuaaagacuaggugaacuucagaagcucucucuauuuuaggacagucaaccuuaccuaguaagcauaaaccuacaccucucaaaugcuggcccuacccuuuucucaggaguggaugggaggaaaauaucuccuacugcccccaaaauuagucuaccuuggccaaaaaauaccaagucugcaaagauaagcagcucugggcccuaaagcagccugggugguggugguggugguggugguggugguggugguggugguggugguggcggcggcggcaacaguagcaauagcaagaguggauauccacuggaugccccaacauuaugaucgccaggacuuccuugcuauccucccuggucuaugccugucucuuccuaggccucagcacaggggccaaccaaaucccuaaaccucaggugcacaaaccucucaggauuaaauuaugcaaugcagcccugccugcuggccaugccauaaugagcagcacaaacacaaaaaaauuaaaaauugaguaaugucucaaauauguacuguacagccaaacuuugggcuacuucacaaagguggacagaaauguuugcauggcugccuguuagaauccacaaaaaguuuugauuugaauauucccacuugacacgaacacuacuguauuaugugaagauaugggaaaagggagcagaaauggcuaugaacaugcuggccacucacagauaaacagucucuccaaggugcacaagagagacaaugccuucccauuccccggugcuacccuguuccauucugccagggcccagcuggguccacauuagguaguuuccaguggaucaauggaauuguuguuuggcuaucugguagaucuagcuaaaggaaucuaaagaagacaguuccaacaugaaaauaguagcuauuaacauaucuauucaauaaauauuuguugagaaucuacuuuaugccaggcaucauuguguuggguaccggggauauaauggguggugagaaaccaucucuguucucaugaagcuuacacacuagugggcuagacugacauaauggaaagaacacacuccugagagucuugccuucaauaccaguuucugcuucugccucaauacaugaccuugagcaagucccuucuucguguugauuuauaggugaccaguagaucuuccacuggcucagguaauuugcuuccuuacaaaacauaaaguccugggguggaauggggguaugcaaauggccaaggcagcagcaagaagccaagggucccaacaacaacaauaaaaacaacaaaagaagccauggguaguauguggugaaaacaaaaagcaauuaauugagauucuccacucaaagaccuugaauuuggcuuagaugguucuucaugaacuguuuuccuaagacagaugagaugggcaggccucuaaagaguauacaguuagugacagacaugaagaucuguccuucccacaguacauggcaggcuucagaccagaagaccugaaaggugcucaguuucacugcagcuucuacacuucuaccuauagcuaaagggauguuaagaaacccucuacucuaaaccacuuauuuuauacuaaagagcuaaggugaugguggccccucccuccccaggcacuuguggucauucuugaguagggcugugcuagggccaguuggagucaggcugcucaaaugagugaggagaugguacuucccugcauacuuccuacuuaaaaaaaaaauaaaaaacuggcuguaggggcaccuaugugggguucagagaaacuguagcaucuggcauucuggguucagaggcuugauuggaaucacauauagcacagaacuuuaaaaggccaacuggaacaaacauacuggaguguccugggccuaccuuccuuccuuugugccucacaccucacagaccacuugcagaugcauuagugcacugaaugaauccucagcauaacccuaaaaaguagguugcuauuacucuuuccauuccacagauggggaacuaaaaucuggaaugguuucagaauuugcacuggugacucaaggccagcuaggcuuucucuguacuuacacucaggccucucuuccccauaggugcuaauacaccugucccuucuccaagguguauuuucucuauuacuagugguuaguaugcccuaccaggugcucauccaacacuguuggauccccugcauucauugcuacugcuucucccucaccauguauauuacugaccaaaugcuccucaaagguuuguccauuccuaaccaccuccaccuggagaauggccccuucuugagacaggaagagcuagaagcuuccaaaugcacacguuuaaugaaagagcaagccuaggagcccagauggcugcaauucugcaugguaaauaacauaacagaaguucuuacaaaguacagugggcacauagaagauaguacaauacuaucugggaguaauaaagaaaguuuccaauggaagugacauggagugggggggagaugaagaagaggcaccugaaauuucaagcugaaggaaagaacauaggcuaaagcagaaagaagagguauggcauugcuuuccacaguuaaaaaaaaaaucauggccaggugcaguggcucauaccuguaaucccagcacuuugggaggcugagguggguggaucacuuuaggccaggaguucaagaccagccuggccaacaugguaaaacccugucucuacuaaaaaaauacaaaaauuagccagguuugguggcacaucccuguaaucccagcugcuagggaggcugaggcacaagaaucgcuugaacccaggagguggagguugcagugagccaagauuggaccacugcacuccagccugggcaacagagugagacucugucucaaaaaaacaaaacaaaacaaaacaaauucaaccugaaaaagcuggaugaaaaaaagaaaaaggacggguauagcuuacuuggacuugggaaaccuugggcccacaaagcuaccacauagcauacaugugggaauaaaugggagcugaguugggagaggaagcuagaauggggugagguaccaaagggaccucccuauaugcuaugcuaagagguuucaauuuucucuuuucacauucaugggaauguaucuauacuagcaaaugcugggaguaaucuaaaugcucccccaaaggagaaugguuuuaaauuauggcauagccuuugaauagaauuuuacauggccauuagaauguucauuucuuaaaauuaaauagcauuuaucuaaguuuuuagugauguguuaaguagggggaaagaaggagaacuuuuuuauguacacuaugauugcaccaccaaaaacuaagguacauauaugagauacgacaagaaauacaaauaauuauugccauguuaaaaugaugaauuuauacacaauuucucucucuauuugcuaaacuuugucauaugccaugcugaguuuuaaaaaaaggggaaauauaaaaaaagaaccacucuucuuccauuugacucuacauuccuucuuccuccaccugcuugccuaccuucccaaaccaacagccauuuugauccaccaccuacaacuggcaucgcuaacaacccaugugagguaccuaggaagaaugagaagcuuccagcaaggcagcugcuuccagcagcaagcuccugcauagcccacaggccauuccagcucaaugcuggagaagaaucuucccccuaacagcacugcccagcacuacccaacuaaggcuucucugguuaaacugcccaaggaugcccaaggaacuuguuucuaaaggaaggaaaacagaugccaagacuucuugugcuuucuccagggggcucagagcagguaagguuuauguucauggccaacucuuagguggcugagauccaaugugggauccuuguuucacaagcaagcacuggauaaagugucagugagaaggacgaaaaggaggaagaaguagaggauggguaaaaacagauccagugaaggguacaccuuucccauaaacuugcuuauucccuaucagccuuguaggcccucacagaaaauucagaagucccucuccuuugaucuccaggacuaauaccaaaggaaaccauauuuacaaaauacaggaucaguugaaagcccaacacuagguguguggcaaucuuccugacuagaaauucucccuuuugcuccacccaagcccauaucaccuagcucuccccguccaagggcaacauagucaacaaugauucagauagaggaaggggaaagggagcuuagcaauuuaagacucagucaaaagcaauuucauagcccuacaaaaagggauguugugggggagggaguaaaggaagugaaaucucauauguccucaguuuuagcuuguuucuuugucuucccuuucccugauggaacaaugaccaauccaagggucuucuauucuuccugagucacagaugaccaaaaauagccagcaacuguagucugcaggcuggacuccaagaccccacccaaggcauguagucaacaguugucucuccaagccagaaucuccacagugagcucucugguagguagauucaguauaucccagagcagagcucacugaaauagagggggcugcuuacauguugauagccagaggagaaaaugacacacucaaugccauucuaaaugggaaaaggaagcuucuccgaaaagucaccacucugcucugcuacacgcuuuccaagaccccuuuccuagccucuuaaagacugggcacaaauaaucagaaugucagaaaaagccaaugucucuauuuuguagauaagaaaauuaagccucauaaaagugacuugcccaaggucacacaggcagagauuaaaaaccaaauaucucacucuucuuuccauuguaccauuuuuuacuaaaagguauuuuuaaagacacccagacaagugccccaagcuguaagugucaaaagcucagcucuucuaaccuaaaguuagacagcucaggacugggaaggggagguagagggaacuuagacucagcccacccaggaaagccaagugagaaggcuaggcauacaacaggcauacuuaaagaacuagacuuaccaacuggaaggcuuuaccugcuccaaagaaauaguuucaaaugcugaaagcccuagccccaucccacccccacacucugaaccucuuuaggccaaucgagaccacuccuaggcugucagagaucuagguaagaagcuguagaggagugaccaggcagugccaagaggauaaagggagauaagaaagcaggguggagaaaucacagucauuccagagcucucccaucuuccucucuccuuccccacuccuccccuauauuaggacucuaaacaagaagaaaagaaguuugcaggugguauuguauaaacuugaagaaggcauucccuguacuaaaggagaacagaggacuaguugaggugggguggcaaggagagggaguaacuugaggggggagaaaauagccaaauaaggcagacuugacugguaggaaucaucaggaaagguuccagaaguugacguugcagggaggaagccuuuagucaucgguuuccucuggcaacuggccuaagaccagaaggaaaaaaacucccaaccuuaggaaaaugcccaggcuauggcagacagaaaggcaacuaggcuagauuuucaccaggcccacaucaggcccugcuggagcaacucuucaagcacucaaaguagaaagauguaguguaacccuaaagcaaauggcagauguccccaccaagcauaugcuagaucuacaauggcccaggcaccaaggggaauaaggaaccugggagggggguuuguucuuuuccauuuacauauuucuuuuuuuuuuucuuuuuuuuuagacagagucuugcuuugucacccaggcuggagugcaauggcgugaucucagcucacuguaaccuccaccucccagguucaagugauucuccugccucagccucccaaguagcugggauuacaggcucccgccaacacgcccggcuauuuuuucuauuuuuaguagagacaagguuucaccauauuggccaggcuggucucaaauuccugaccucaaaugauccaccugccucagccucucaaagugcugggauuacaggcaugagccaccacacgcaaacuccaugugccucuuucuaauauugcugauauuuucauguuggagaaaaagaaaauuaaaaggcaaagaaguuaugugacuuuucuucuuuguaaaggaauuagucagucucccacaaguaucuacaaggauguuuggagaggaguuuagcucacuuaaaacccuugaaaauagcaaagauuuguacgacuuaacuaaugaugcccagauugacuguuaccuugacccucacccuccaacucuauaccauagauuagucaaccucaguuaaaaauuacaacagauaaaagaggcucuuggugagcuucaucaaacauccaggcugagaaucugaaaaaauaaauggaucagccaggcgcagugccucacgcuuguaaucccagcacuuugggaggcugaagcaggcagaucacccgaggucaggaguucaagaccagccuggccaacauggugaaaccucaucucuacuaaaaaaaauauaaaaauuagccgggcguggcggcgcacaccuguagucccagcuacuuggguggcugaggcaggagaaucucuugaacccaggagauggagguugcagugagccaaagucaugccacugcacuccagccugggcaacagagcaagacuccgucucaaaaaaaaaagaaaagaaaaaaaaggaaauggaucauggguuggagggaaggcagauuagaucacgaaaguaagaucaggaaccuuaucuaaacacacaacuugagaaaaauaagacuugauccuucucagguauuuaauggaggccaaggcuaaagagagggaaagaaauacugaucaagccugacagguaugccuuguucccccuccuaggccuuggccccagucacuucccaaauauauacccaggaaaaaaauuuucaggauuauaucuuguuuuguacaaccaaauugucauaucucaacucuucucucauuaggcccugaucacuacccuggaugcacaaaguaucuaucaaauucccacaagguagaaggguugccaggaaugggaagaaacuucaauauucgaagucaccaaucacagaagauaacuggcaaaacaguucuacuaagcaagcacagagccauuugccauauuaguggccuaagagcuaugucaacacuuaccuuaugccacaacaagccgauugaaaggagcaucagaucugguaucugugucauuaggcacagacaaagggcugugcuuugaaagucgcccaaaaggccuuuucuccaaauucaagacccagaugcugcagcugugcccuggccagaaaacgucauacuccuccaccucuaacaaccacacacugagaaauccucccugccaucuccacccuuucccaaauaccugauuuuauagcaaagucaaugagagaauuaaaagcuguuucuaggcugcugacauaaaguuauugccaagcucuauucuuugguuuaguucauguguaagcaugaagaaaagacccucucacauaccuacuuaggcaacaaaagcaacauuuuuaaaaauuaauuugcccaggcugggcgugguggcucacaccuguaaucccaccacuuugggaggcugaggcggguggaucaccugaggucagaaguucaagaccagccuggccaacauggugaaaccccaucucuacuaaaaauacaaaaauuggcugggcgugguggcgcaugccuguaaucccagcuauuugggaggcugaggaacgagaaucgcuugaacccaggaggcggagguugcagugagccaagauugcaccauugcacuccagccugggcaacagagcuagacuccaucucaaaaaaaaaaaaauuaauuugcccaauucuggaaaaccaaagguauggucucccccacaggcccuuguuugccaauuaagaaaggauuguuggauccaaauuacccuagaaagaguagcuucaucuaugcuuauaucuguggcuccccuugaaucagucagcagcucaagccucccuucacuucagauaaaguaacuuucaagagagcauuggucuagggccauugguuuacacccacauaccaaaaacacaucacuuucccacccagaacggccacugcucccaaguguacacacccuuuaaggcccuguucaugucccaguaaacccuuucuccucaaaaaguuguagaaaaugcaaugcaaaguauauauuuuucucaagccguuuuuaagugaauuagcccuaaauccccaauuaaauaggagauaggagaucuuugaaggcagcaguuguaucaucccuucauuuauuucuaucccuuaugguaaauaguacauaguaaccacucauuaaaugguaagaauucaacuaccugucuucuuucuuauccaucccaucuagcacaaaguuaggcauauaguaaaauucaguaaauaaucauaacauuuguauaucacuuguuagauucuaggcacaguucuaagcccuuuacauaaauuaccucauguaauccucacagcaacucuguaaguacuauuauuauuuaugguuaaggaaaaugaggugcagaaguuaaauaacuuguccaaggcuauauaacuaguuggucgcagagcuagauuugaguccaggcagucuaguuccagagucuguuuuucaacacuacucuaugcuuccuuuccacggaggcuugaaaggucuuuuuuuagcuuccugccccaggcuuggccuauaagcaccuagaggugaguggugaacuuugaggccaggagauucuagucugcauucaaacaauuugcuacagcagcaaauacugucacuaaauugaaaaagugccauacuguucuccuaacucaagggacagaucaagcuggagcgcugagucagaauucagaauucaaaaaggucagagcucaaaauuaaacagggcaaagagaaagcagggaacuggggugagggguagacaggaagagaagacagucaucggagaucccagaaaaacuugcuauagcaaaaccauuuuaggggaacuccauuguacccaucuuguuaauguaaucaccacagagccaguucucuggaagucugugcucucuggguggagucauccuucuaagacagccaaguccagugggagaccacuaacuugggaauuaggaaauccaaguucuccuuucaauacuguuaccaacuauaugugaccucgaacaagcugccuaaccccucuggcuaugaauacgaugaagaaauuacucucuaaaguuucuuaggacagcaaggccuagucucaagcaggaaaaugugacuaguguccucucucuaccucccuucagccuacacauaugccuuccaccacccgucacaagccaaagcaaaacacuuaccuuccugggaagugcuacaaagaguuccugagacaaggucagagccugagccauuuccaaauaaagaaacccaugagaucagcucuacacacucagaggaacuugcucuucccauggccauaacuccacggucaugucaccaccagcacagagggagaagacacugagcaccucacagugagugccauuuagaagguaggcauucaccaucccuccccuacacuggagccaagcaaguuagguuuuaguccuggcacuaucaccaguucacucaaauccuuucccuuuucuggacuuuagugcccccaucaagaagauaaaggcugaggcagaagauuuaaggccagcucaguuguuccaugguucaaaacacuccugugagaaacccugcccauccagaacaaccagcuaaaggaaagcuuaaggcuagggaagcucuggguugcccuagaugcaaaugccuuuaaaaugcuguaccccauacaaaauuagcugggcaugguggcgcaugccuguaaucccagcuacucgggagccugaggcaggagaaucgcuugaacccgggagguggagguugcagugagcugagaucgugccauugcacuccagccugaacaacagcaaaacuccguaucaaaaaaaaaaaaaaagcuguaccccacaauagccaguccucagcucacuggugguagauacuuuaugagguuuguuuaggagcccuuaggaaggccucaauaucuaccaauauaucuaacuaccacacucaccauguuagaagaaaaucugaaacauaaucuaguagcuuccgggccuuccuuucagcagaaauaaaaaggacuauucuacuaucaggcaggcggucacugaaaaaugugggaagaauggcaggaaaaucuaugaggcuuuuaguguuuguccaaagcuuuucagucaacccacagucuucauaauauacucucacuugguuuauuucuuuccacaguaaggaaagacacagcccuuucucucccaugacucgggaagaaauggccaagaguacucaagccaguauucuucuuggaucuacuaaugaaacaaaccaacucccaugugagaaacaguccauucugaacucagcacuuaagaagaaacagcacucaagaaguauaaugggacaagaggauacauuuuaauaagcgcuguucaauuuuguauuuccaauacugccuggcacauagaagguacccaaauguugaagaaagaaugucugaaggaaugaacauacauauaagagacucaaugcucuuauaccaucaagauucucaaaaacaucaguacuggagggauuccuagaguuuacccaucacugguacagcucccucaugacaagcuggagagacagagggccugaagaaaggacuugccuaaagucccacuucauuuggcucacuuuacugaggacaggagagaaguucuucuuauauggaaagagaagaaaaauucucaguucagugaugcuuuccauuucccagcacccaccuuccaaauucauggaauccugagcuaauccuccaaagugacaacuucuauaccacagauuagaaccuggaauugaaaaguuuuucagcucucucaagcaugaaauggaaggagggauggacagcaaagccagucagucaugaaaagaccacccccuucacuugaaccaacagacuaucccaaaggagaccacaucuguacccuguuuuuuccuuuuugcaagcaaaguaauagagcagguggcagggaaagaagauucugaguuaggaaagaggcacaugauaaauucaauucuaucuuugaaagauuagagacagacuauuagcaaucuguaacaaugccaaauuuccagcagcuaugguuaugaaaggccuaacucugguaguguugguagccagauauucuccccucuggggacccugagucuagaaauuccagugggggaaacucccagaaagauacaaagggaccuaagacaggcuguugccaugcaacacuagaacagaguucagaauaauuguagcugucauauuaucucauccagagagaauuagauuuggaggcaggggaaauagacuagaugacuuccaaauguccuuuccagcuccaucauucgguaaaguaguuucaugggaggaggagguaagagaaaaguaagaacaacacccuaaaacaagcuacuguugcaggcagcuagagaauggaaaguuagaagauuagugaucaauacuacuucuaucacugacucacagagcaaccuuucccucuccaagccuaacacgagagagcauagauuaguuggugugggucccacaaaggccuuccugccccaccagcccccucccuacccagagggcuguuaaaagaaaagcguaaaggaaauucccaagaugguuccugcucugucucuaucaucuacacuuucacaaagggccaagugaacugaagaacccaaguggagagaugcaggauccucucucauaugaccucucuuccugauccuuuuccccccacuuaagucuguaggcagggcugguucaaggguuaaaagacuaagaaucuggcuccuauuuaccaaguaccacuuuagugccacucgaguggcucaaguaaugcuaggaauggcaggagaauaaacaguccacauagucccuguuaaaguuuagcugaaugccgacccaaacaccuucaaauacuucaaggaucuaggcucuaugucugcucacauugauggucccaucaaaugaccacucgauugccuuuccccugaucuguugaucuauggcuaaaaccccagcagaucaaagagguguuucaccaagacugacccucuaacuaagaccuagauucaaguccuaguuuugcaacuggcauacugcaucacucuagguuagucucccccuaacaugaguuucaguuucaucaucuauacaaugagaggaauuggacuuuauaguuguggagagccuuuucaauacuaacaucuaauaaaucccaaggaaggaaaccagaaacucaagaacaucucgaaaauucaaaacacucuuuuuuuaggaaauccaagaaagccucaaagccuuugugauccuaaaagaaaaaaauuaaagaagguagggagggggaaaggccuuuuuaaauauauauauauauauauauauauauauauauauauauauauauauauauauaacugucaucaucaccaaaaaauguagauggcaauuaauaagcuuuuccauucuggcuacuaaagcagacucaggaaacuggcaaccagaagcagaguccaaggaauggcaagaaggcaaggguggcgguggguagugaggcauguuuuuuuguuuuuuugcuuuuuuuguuuuugagauggagucucacucugucacccaggcuggagugcaguggcgugaucucggcucacugcaaccuccgccucccagguucaagcgauucuccugccucagcuucccgaguagcugggauuacaggcgcacaccaccacgcccagcuaauuuuuguaauuuuaguagagacaggguuucaccauguuggucaggcuggucucgaacuccugacuucaugaucugccugccucggccucccaaagugcugggauuacuggcuggagccaccacgcccggcuggcguguuuuaacaaauguaggggagguugggcugacuaggagggacaauuagcuauaaaagugaaaccgacccuagauagguuguagacaugcugcaauaugaaugaacgaguuugauuuuccacuaccuuucuccaucugucacacgcuagaaauagccuaaagcacauaaaugaaaauggagcagagaaagggaaauuuuuuccccuuuuaauuaaaauuacugguugguauucagugaacuagggugugccccugaacaccuuggccuugguaugaggaauaagaaaaguaacagaaggcaccuggugacacuaccgaaccuuaccaggagaccacacaaaugucaaccuuggccacuuugcucaaauuacucauuuccuuuuaucugaggaccauaaaggucugagaacagugggcaauuuguuuggagcaagaaagggaacucaaaugucaagaacucaaucauugggucagaauaaagggucaaugagaugagcaucagaaagccuggaccccaaucuuggcucagucaccaugugcccuuagguaggucuuucccuguaggucucaauagccucauuagauuuuuguuuuaguuuuaguuuuuuuuuuuaagagaguuguacuaaauagucuccaaggucccuuucagguuaagauucuaugaucuuaacagacauaauauaguugcuuuuccuaaaaguugaccauuccuugagucaaaguauagaaaauucucuaauacuuccagucuaucaaaauucagcccucuccuuccaauuugauucagguuucagucaaucugcauaaaaaugccuucaguauuuagguacccucauuacuccaggccugacuacaaacagcuuauacuccauucucucuccauucccaggaaaacaauaaacacgcugucuugucuucuuugccacuuugacucagaugagacgguuaaugcaaguuugaagcaacuuccaggcccaugaagcuguguuucaaagugggcuaucucagaacugaggaugagauaugccacuacagaagaaagaccguggagcaaugucuauucccagagauccacccaacuguucaggcaaagccgcaccuuaagaggagucaggagucaaccacagagagagacccaaagagccgcuccugacaggaucuuuauaaucuuguuuuggcagacaaugggauauuuuccccucucuccaaaaccauuacucucucucuuugggggcggggacuagggaacaaaguguguaaaagccucauguccuaaaaccacaagcaauuuaaaggagauagacagugaaagcacauacuuuuugaaaacuugguguuucugaaggacaagguucuggaaaggcaagaacgacuuggcagugaggcugguauacaguaacguggcaaccaaagcucaucacaaacccaaaaggcugggcccccaacucuccuccucucaucccaggggaccuucagcccuuuucaaggcuacuagucacuaucucaccucuacaaggcucaagcaguccuggggagacauguuugggagcacugcauugccuaggccagcucaacaagcuguuuggccuaagggacucaagccaggguggucaccaggccuuucugagcaagggaagggccucagcagccauuuggcaugacuugcacaaaagcaagcagagcucauuagucaggcacaccccuccuccccucucccuccugggcauccggccccccuauccccacucccaggaggcuucuguuccucucguaacagccagugggguggagacgcauccccaaaucaaccaccacucuagaaagguguggccccacgagaaaacccacaccacacaaaauaguccggaggggauaggaggagauagagaggcauuaagcaauaggaggggcagggauuuggagguggagaggagggagaaaccgguccucucucccaggagaugggguaggccucuccucagacuggugccuaaauaaguguuggugcucucgggugcagccucgaugacgauuuccucacaucucucuccucaccuccuaguggaaaacagcuggagccacccggugaggcugugggaaagaugagugggggugccggauccgccccgagcggcucccuccuuucucccugcuucucuguucccauguccccucuuggacauuggcagccuugccccagaaaggugccaauuccuggguuggggaaaguguugucuucuggaccagaauccucuccucugugcccauggcccaucagggaaaaggggaaaccccaggccccaacgaagccguccugacuguugcaucucagacacagggaacuggaaccugagaaagaggcaggccucgccccguccaaacuuccagccuggacacccccucaaccccugagggcgcaccagaccaggaucccacuccgguccccucccuacccuuggcuauggcggagggcgcggcgucccaggcgggccgguggcuggccaagcccucagccaucagcaaagggcuaugaggcucagccagagccauuggggucgacagcgcccaccuccggcacucaccguuuugggcaugguggcggcaaaggcagcggaguuggcgaaguuuagcuaggacugucgggcagugcugagcacgcaguacacacggcuuggauucggcuggccggggacucagauugggucccucacuagcgucggggcgacuguuaggcuuccugcuaacgggccacgacuucacaaaccccacccaggaaagagccgccccugucg

SEQ ID NO: 192843 - RNA, 27274 nt, Homo sapiens
ucuggccucgcgccugccuguucccuccagcccggaccccccugaaauauguucaggggcgcuuggauguggcccgggaaagacgccgccgcgcugacuaucugcugcugcugcugcugcugggcucccaggccgagcgacaaaccuugcgccgacuccgagcgggcgcagcgauggcgacugucccuggcgucccugcucuucuucaccgugcugcucgcugaccaucuguggcugugcgcgggggcccggccccgggccagggagcugagcagcgccaugcggcccccauggggggccggccgggagcggcagccggugccuccucgcgcggugcugccgcugccgccgccgccgcccggcgagcccagcgcgcccccaggcaccugcggccccagauacagcaaccugaccaaagccgcccccgccgccggcucucggccggucugcggcggcgucccagagcccacggggcuggacgcagcuugcaccaaauugcaaucuuugcagagacuuuucgaaccgacuacuccggcccccccucugcggcccccugacucccuuucccgugccccggccgaguuccccuccgccaaaaaaaacuugcucaaaggccacuuucggaacuucacucucuccuuuugcgacaccuacacggucugggacuugcugcugggcauggaccgccccgacagccuggacuguagccuggacacccugaugggggaccugcuggccgugguggccagcccgggcuccggggccugggaggcguguagcaacuguaucgaggcguaccagcggcuggaccgacacgcucaggaaaaauaugacgaguucgaccucgugcugcauaaauacuuacaggcggaagaguacucaauccgguccugcacgaaaggcuguaagguaaggacuggcuuccgcagccacagcagccgcccugggcagcggcagcggccgcagugggaccgggagaaaaaaggaagucucccuuucuacccaccccaccacucccaccgugcccagugcagcacuaccagugccacccugggaccuucccuagugaagaggccucagggauucaggucagguaaccaccuggcuaacuucuauuaauuccggguuugggcaccuuaggccuggggcuuccuggcgcccugcucccucaugaguggggaggggccgcagggcccugggcugacaaugagguggcaggagggauugugcuccccccagccuccauccucagccagccaugccccucuccuuucagaggcuggaacugaacguccugggacuggcuggugcagggggaaggccaaagaugggaggaagaauauuuggcaaccaaacccucacccuuuggcuucugccagugggugagaggacgagcacuccuggugguggggcacaccacacacuugaccuuaugugaccugaggugacuggccagagccgaggcaggucgagcccaggggcugccugucuucucccaaggaagucaccugcaggcucuucuccccugacaaaggaaggagcugggaacagggaacagcgacuggugggaaggccacugaagguuagugcauucucauacaaaacucccagugccuucccagcaccccauggugacaguggggggaacacuggcuuucuagcugcuggggauagguauccagaggagaggugaggcagcugcagaccggcccgccuagggaagagcugaguguuaagaaacuucuugacccucggcgggguugcucuggacaguuaggugggugagggcugcaaacauuugggacuugaugguacugcccugcucgcccagccuggccaggugaccugccuuugggaggaaagagaacagcaaggucaaagggucagaugacaaggagaccaggaggggugguggccucacacauccucgagcuggggccaagagcuggagagugagacaguugcuuucuagccuagcucgugucccuccaagacuuuggggaggggcagaaagugccauuuuccauccagcauggcccuuguggacuucugcagggcuuccaugcuuuuagcggguucccuagggauuggggcagaggguugggaaggaaaaggguaguuccucgcuccugacuucacuuucuccuucuccuuuuuccugcucucguaaccuagcagucucccucccgccucccucagccucagcugacucacugccucacucacacuaccaaaugagauauuccacuucuuaaagguauacagacagauagacacacacacugccauacaccaucaccaccaccccgggcaaagucacauaggcaugcagagaggucgucacacccacaaacagugucauuagaagcagaugccgugucacacacacgcacaucuccccaugguaucagagacacgcaggcagaaguacugucacaugaagaagggcacauuuugucuuacagagacacauacccucgaugucagccacggacacauacacucagugggagcagagagacaggguccacaagcagauggaaucaaggaugucuguuuuuuguggcccucccuucaaccccauggcccuguuuuuuguuuguuuguuuuguuuuuuuccucaaucaccaguaugaaugagaggcaugccacaacuuccccaugggguuuucuccguguuguaguugacuccgauuucugucuggaccugaacuaaauacaaaucucucauguugauuguuuuuaccaagcagugugacguaggagaaauacaucugaucucuccaguucaggaggccuuaucaccucuacuucuuguuagugguaugaccuugggcaagucacuucacuucuguaagcuuucauuuccucauuuguaaaacagggaucaucauccuugcucugcccacauccugggucuuuugugggaagaaggugcagauguauuuuguaauaagaauauaacaucugacauuaauguaaugcuuaagguuuuuccgccccucucguguguguuaugagaucaaggaggcuggugauacuagcaccacuacucccauuuuacagaugaggaaacucaggugcaaggggaucaaaugguuugcccuaaggucacucagcuaaugagcaggagugccaggacuccagcccacguguuuuggugccaaccucgugcuuuugccauggccucacaucaaguuccugauggcccucccuccucuccuuugucuucuugucugucucucuccagcaaaccagcgaacuccuccugugcucucgcugccugcugugccggcagaagggcagugccagcuccauagcucucuuccggccuuucccacccuuguccaaugcucucucccucaacugaggccagacccaccuggcucucgaauccagcuguaugaugggcacgaagggaaaagacagcccugcuacccuacuuggacuguaggcuccucucuccucagucccucaccccaccucccuggcaggccuuacuugccauucccaaaccccguuccugggcuccaagcccuccugucugguccccaccccaaaugggaucccugcgagaugacgccccacccucagagcuucuccugaguggagagaccacagccccaggccaagaugaagaggcuuucuuacuucuagaaaccaagcugggaaccucuguuucagagccaggugacccccuguccccaggacccuguacugagugcaucaguuagcucuucccuggguggccccagaaacccuguucucugccuuugcaauaucugcccccguuucaggccacacagggccccacgaaucauaccuguccucgcugcugccugugacaccucccaauuuaguaccagcugcaacauuuccuuaaugugcaacugacuuccucucacacagcagggcaauguaacuuagguaggccgaugcccuuccccgcccuggccucucccaacucccagggucaugccucaccucucucuuagcuuccugugcauccccacaagcccuauuuccuccaacccccaccccacucucuuggccauagcuaggguuacuggacaaccaccacacucccccauggcucuccauccucccaguucugccacacuccugccuuucugauugccucuucccccaccucugucucuuuccuacucucucuucagaacauucagacuagggggagugauggagaugggggcaaaauccuggcuucuucucucauagcuguugaucugaggggaaauagaggcccaagggaggggcaguucuuagcucucucaccagccauaggguugcauuaguaaagaugagugccagggaaggaugugauaguucugcucuauuccagacugacccaaacccaccuggcagacaguguguuugauuuugggucucacacugacugggcugagaaggaggcaggaacccauguucuucuggagagaguugaaggagguguuucaccuggagaagaggugacucgggcagauaugcugucugacuucacaccucagaauaguugacaugguauaaaugaaaaagcaugaccugcguggccccaaagggcuuuuauaguuagaaaguucuagguuaaaaccuaguucuuuuauuuauuaccuguguaaccuugagcuaaggacgucaacucucugagccucacuuuucucaccuguaaaauggggcuaauucaucguaacaguccugugaggucauuauuaaugagaagagucuuuacaguacccagaccugccauaucagaguugcucaguuucuuccuuucaaaaaaggaacagacugccuuaggaggaagugagcuccugcucccaggaagugucuggcccgauacagguggacccuuggggaaaaugccguggaggcaauucuaacaccagauuaugagcagaguuggaccaggugaccuuugagguauauuucagccuggauuuuaggccugugagcaaagcuugcucauugaacagcagcacuggauggggagggcuggggaaggagguugguccuaacgcccacacaaagagaggggguggggggcugccagagccagcgccuugccuucugcccguacccgcuggggcccugcucuuccuccacuccggcuggcagcuguuucugccucacugccuuccucucuccucccaccugccacagcuuuccugccaagcaggacuccuugcuaacacuggguaugaggggugcugagagcagggagcucagggcacuggguaaaggacaggagccccaaguuggccaguggugucuguuuucaucacacagcuugcagucaggaagcagugccccacaggcagccucccugacccagggcucuuagagccagagagguacccuggucccuguuuggggguagaggaaggggcaggcugucuauaaacagccucccgggagccauggcaaagccugcccuuggggaggggccuccagauccacagaagcucaucucuucaccaaggaaugugagcaugggguucugggaaggagcaggagccaggaauccuggagcaggcagagagaggaggcaauguuuauagugaggacaagugaggacccaccaacauccuuuguucagugucccagucucuuguccuuggacccagugacaaucacuguuaccuuccuggaauagcacacagugaauuaagacugggagugggaaaguggucacucccacccugaccugcccccacuccaaccuccauguucuucccacguuagcucacacccaacaugccuauccacuuuccaaugacccuacaaccuucccaaucuucuacuuaucacccuacgcucuuccuaagccacacccacaccuuacucccucuaccuacaguccuccaaccccugccccuccugacaguuaucuccacccccuuccaccucaacucuggaccucacuccccaccucuuuccucucaacagucagccccucacauuccacauuacucccccuauucccaucucccaccugacaccccucccaaaccuuuacuccaagaucccacacccucuucuggccugcaugccccuugggccuugcaucacucacaccccacucacacuuuaccucccuucuccccauccuuuuucuugcucucuuucaucuucugguccucucuuccacccucuuuccuccugccucccccucucccucucugcucucuuucucccacuucccuucucucguuaccauucaggguagacauguacaugugugcaugcacacacagacacacauucauacagacacacaucccccggucuucuucauggcuacuucccauccuucccgcaggcuggugccugacuacuacagucaccauagcaacgggaaccuccaggaaggauacacugguaucuccugaagguggggguugggggaguuagguggagaaagggagccuaacagccucccacccaauaccauggucuggcaggaagagucugcugaacauggugaaggugggagugaggaaagggaagacaguggguggaaccaagaucaaaggagggucaagaaucucccaacacaucguaagcaugcgagggugcuucuaagccaugcggaugcauguugguccccucuggaugugucaguacccuaaggaaaggguauacucacuuuuuuacauguggguagggacauaggcugaaccucagacucaggggcgggagugugccuuagaaaaacuccuuuggggcaguuauucugugcccccacccucugaggcaguuuaccuucugugugcccauacagacugggcaucaaaccugcccuccccagcucauuucucagccacauguggauuccagcugccaguguuagcugaaagccagggguggccccugcuucuggggaucuggacaaaucuggaccccuacaagcaccauucuccgaugcuggccugguaggucucuggggaauggguauguuugcguuuugugugauuacaggcacacagaccagagugugugcaagaggccagggaugcuggaccagccuuuucucccugggcauaaaagugggcucaguaacgccugaauuuuugauacuguuagccagauaggugcuuagaggggagggcaagggcaccaggcgagcugcagcuggcucuggagagggaaggaguuacuauggagugacagggacugccagggccaaagcuccugcucgaaugcauucuggagaaaggagcuggaaccugagccacaagucugugcaccagaagaugaggccaacuggcugcaaagacgaaagggcuaagaaaggggaaggaaagaagaaaauugcgagucuuugagugccuaggagaugccaggggcuuuauauauguucaugaacucauuuaauccuggcagucauccuagcaggcaggcacuaucaugauucccauuuuacacaugagacaacugaggcucagugaggugaaaugaccuacccaggccacauagcaaaaggacuggcauacaaaccuaggucugucuguucuuucuccagugcacagaugcaugaagaaaaugcuaauaaucuccuccaacugucagagguagugcccagcuggcuacugagaggcugggcugagaagcugggccgacuggaagggaggcccaacagagccuauugguagcuuagagguccucuggaguggcccagauccaaaacgaggacccaccaacauccucuuuguucaacgucccagucucuuguccuuggacccagugacaaucacuguuaccuuccuggaauagcaacaagagaaugggcacagggaaggaacugcaaaggagaugggaggaccugggcuccucucgccuggagggaagguaucucuguuauauucucagccccaaucugcuggagggaucaagcagagcacgaggggagaaggugcagaacauuaaccuaaguuagucccuaagcaggccuaaugcagaccugagacccuggccuccacauccacuacaccucaacaugugcaguuucuccauauccuugcacaugcugguagagcuggaagggaaaacgacugcaguaagacuuuguugccccagaguccgcugaggccuggccugggcuuuggaugcccaguucccaugcaaggguuuuggugagccccuaaacuugaacaccuaggcuuuucuuggggauugaaggaagugccaguccaccaaguucugccagaagaggggcauuugguggugauggguguuaccaauguucccugucuuauuugguuuuaagaagauagcauggcuaccuggcugaucugugaaaggugagcuugucuguuuaguguugaacucauuaaaacuuccaacuaaguuaaucucuuagaauuauuauagucucagaaucuuauaauaucuuuuuuuccaguuaaccaaaaaggccuuugagaaauuuuggaaaguagaaguauaaaaggaaaaaagucccagagcacuuagucuuuuuuuuuucccgugguaaaauguacauaacauaaaauauaccauuucaacuauuuuuaaguguacaauucaguggaauuaagcacauuugcaguauuguacaauuaucaccacuauccauuucuaaaacguuuucauccucccaaacagaaacucugugcccauuaaacaagaacucccagccgggcgcgguggcucacaccuguaaucccagcacuuuuggaggucgagcugagcagaucaccugaggucaggaguucaagaccagccuggccaacauggcgaaaccccagcucuacuaaaaauacaaaacuuagccgggcauggcggugcacaccuguaaucccagcuacucggggugagacaggagaaucacuugaaccugggagguggagguugccgugagcugagaucgcgucacugcacuccagccugggugacagaguaagacucugucucaaaaaauuaaaaaaaaaaaaaacuccccauucuucccuccuuccagccccugguaagcauuauucuacuuucugucucuaggaauuugaguagguacuucauauaaguggagucauacacuauuuguccuuuuguguccagcuuauuucauuuagcaugaacauuuaguguucaagguucauccauguugcaguauacaucaguacuucauuccuuuuuauggcugaguaauaguccauuguauaucuaugccacauuuuguuuauccauuaauuuguuggugggcguuuggauuaucuccacuuuuuggcuauuauaaauaaugcugcuaugaacauugguguacagguauccuuugagucccugcuuucauuucuuuuggguuuauauuaauaccuaggaguagaauugccagaucauauggcaauucuauguuuaacuuuuuguggaacugccauccuguuuuccacaauggcugaaccauuuuacauuauauuacauuuuauguuauacauucugcaccauuuuacauacauaacagcaguaugcaagaauuccaguuucuccacauccuugucaacacuuguuauuuucugaaguguuuucgauaauagccaucuugauaugugugacuauauauuuuuacauaguugaaaucauacuguuuuuuacccugcucuuuuaaacuuguuacacuaucucuucauguaauuaaauauucauaaacaucauucuugaugaguguacaauauuccaucacaugaauguaauguaauuuauuuaacuaguccccuauugacauuuauguuacuuccaacauuuugcuauuauaaauaauacugugaugauauucuuuguucauaagucuguuucagaacgauucuuuuuuacgaauaaaugcuaucucagucauuuuuucuuauuuaucuacuuugcugaguuuuuaaaaucacaaaauaaugcaugcuguuuguaccaaaucuaacaauacagcgguuuauaaagaaaacauuaauguuccuccuauuagcuccccucccaaucccacugccugaggucccugauguuaacaauauguaguguguucuccugccccucugugcaggcuuacauaaacgucuacacacaaaaugacuuuuucuuuccuuuugcauacaaaugggagcauagacauuaauucugcaaggugaaguuucagagcuagauguacagaaucaaagaguauuaaccuuuuugaggcucuugacauacauuaccaacuuucuuucaaauuacuggguuauucuaguuuauacccucaccaaaagugugagacuaauaugcagcacacuuuuccaguauuggcuaucacaucuuuaaagcuuuacuaauuugguaguugaaaaaugguacaacauuggcuuuucauuuucauuccuuaggucagacauuuguuuuucuuguuuauaggccauuugucuugccugcuuugugaauuaucuuuucauguuuuguguuuuccuuacugacucguacaugcuuuuuuguauguauuaaugauauuaaccuuuuucuaaucacauuuguggcagauuuuuuucauuuguuauuugcaccauagagcugaaaggagggaauggaaaggaagagaacuauuccacacacuuuguguccuuuaucuuacuuaauucuugcaucuuccuuaugaaguacaugauauuauucccauuuuacagaggagaagacuggcucagagagguuaaauggcuagcuuaagcucauccagcuaguaagaguuggagcugggauuugaauggcagcagacaaugguaccacccagucuuugcugguguaauuauacuaucgguaaagcuuugugugguaaagcuuugugcuaguugcuuaacaggcauaauuuacugaaaaguaaggguagguacuuuuauuaucuccauuuuacagaugaggaaaguguggaucagggaaguccaguaacuugccugggguuuuauaaccaguaugagcaaaccuaggguuuggacugcaugacugaguuuaaagauguuugacccugucuucccacuguauuugauuacucccuaggcaucaacuucuuggauccaaauugaggcccaggaaggaaaagugccuuucucacagucaccagaaaguuaguggcugagucccugucucccuacagguggugacuuguccaaauucacacaguugguggcagagccagaaucugaagccagcucuaacucucuaucuaacuggagcaggggcuucucgaugaagagaauuuguggaauaugcuggggagaaggaguuggggagaaaguggagugcauagauacccugagacuuuucugaaggaauggacucuggcauuggagucuuccagggcaaggcuacucuagaagcccccagaugguaggaccugggacaggagaacucauguucugaggcaagaaaaucuuucuucuggagacauuugccuucccuucaccaacugcuaaagauuaaaacaggaauagugagccuuuggcccuggguaggaagcugaugggcgcagaagaagcaaagcaguguuugccucuuuuuaacaccuccaucucucagggugugugugugugcguuuguguguguguugaggagagagagaaaggaauacuuugauuguggaauggaaaugaucauuuguagcaccuaauauccaaaugcuauucccccacaucuacuuacaaagaaaacuuuacucauguggagaauggacuacguagacugauuuuagagucacgccucccauccagacauacaaaucucucccuaauuugaugugaaauuaugucagaaugagauuugaguccacuggcuucagugguuguagugaauugaagggaccaucccaagggcaauaugaguauaagaguuuagacaccgaaguccagauuaaccugacuucaaauuucaguucgaaaucugucuucucuguggaauagcuguugagaacuugaacauauucuuuaaucucuauuggcaucucauuuuccucaccuuuggaacuaaaaaauagggucauuaugaggcuuaaauaacaugaagcaugcuaaucucuuaagagcacagugccugcgagauggaaagugcucaagacaugcuagcccccauuguuauuauuauuauuggcuguggaccuuggacaaguuauuuaaacucuuugguccucccuguccucaucuguaaagaucugucucuaccucaagggauaguugugaggucucagugaguuaauaaaugucugggucaggugauuagaacagagccuggcauauaguaagcacuuaauaaaugguagcuauuauuauucucuccuuaauuagguguguuuaauccaaaugacugcuuaauaucuaauugauguugacaacacuggggugggauacuuaggaguagggaaagguaauuugugaacaggaggugaaguaucuaugguaggggaugaggagccagaaggcaaguggagggauucuagugagggaaggcacaaggauauacuuagaugggggaggaaagaggcagagagggagauggaaagacuccaaagcccuugauuuaccucaucacuaaagaccaagcacagcugacagucaucuuugaucacaucucuguucucuccagccucucaucuuucuggcaaggcacagcauuuggaggaggagguaaggaucugucuuuggugaucccuggagaaggcuggagauugcuuccugggccugggcccagguauagcuguauguggcaaacaagugugccugggaaggggaagugugugcagcugaagggaaccuguggcugucacugucacacuggcaccauuccugugguacucugcacaaccauugugcacagaagcucccgaagcucccaaagcuccccucgucucaucuuaguccucuguguggcuaugggaccccucauuagcucuguuguccugauaaauuuaccaugguccagacagugaugauggaguagaugauccagggcagggcagugcagggccuggggcucugcagcagggcagugugggcugagucuagcgagguuggucaggucaggucuuggagauuuuguuuuguuguuuucgagguucguggcugcaaagcaguuuguuuuuauuuaaaauucacuuuaucaaaguacuguauuuucauaauuuuaaaaggcauguacaagcuauauauauauauacacacacauauauauguguauacacacacacacaccccaagccucacucuucagagucaaacacuugagacacucuugacuguuucuucugauauuuaccucaauauuucuaaaugguaugcuaauauugcuauuucuuguuuuuuucuguuuuaaauauuuguguauacacacauguauagauagauauucacacauauacauauauacaccuguguguauauaucucauuuauauguauccuuguagcuuauaaagcuuuuaaauucuaaauauaaaauaucuguuaaaugacauauauagaucucaaugcuuaucauuaaaacaguagcccucuacuccaccccugagccucacucuucagaauuaaauacuuccaacucucuuagcuguuuucuucugauauuuaccuccacauuucuaaaugccaugucaauauucuauuucccaauuuuucucuuuuaaauaucuguugacuuuuaaaaugugauuaaaggaagauuuagcucuuuuacucccagcagcacuuaagauacacacaugcuuccccuccccucauacauucaauauuggcaaaucaaaauuccugauuuuaacaauauuccauguuuauauuacuagaauuauaaauauuguucacagcugaguuauguagaauacugugauuauauuuccuuccuuggucaucuuguuugcauggaguuaauaauugccucuuguuuucuguuugcuuaguuuucucauuuuuugcugauaacauucccaauuucuuuaucagaacuauaaaaucucacacaaacacuuucauaacccauuauuuucacuuuuuuccuuggagcucuccaccuugcucuaguugcuagagguuugguuuucaaguacuugucaaguaccucuguguguauaccuccuccacuuguauacccagcuccaugugaggcccugaggacaguggacagaugaguaagauacaaucuguccuuggugaaucuacagucucaugaguguauaauuuauagaaaugucuuaccagaaggcuguguguuaagacuuugaucuaagcugucccuuuggucccacacucaggcaggccuccucuucuucguuucccaugaguuaccagaaugugauacaguccuccaaagagcaaaugugaucuuaggcugcauuaacaaaaaguuucuaggacaggagggcugaugccucuacuucacuuuguguugauaaauccuauccggggauuguguguaguugcaaaggacauggaaauacagggacucaucugaaugugaacaaccaggcuaacagaggacuggaaaccacaucuuuugaaauaguugaaaaaaaauuggggauguuuggcuucuugaaagaguagucuacacauagcuaucuucaauuuuauucccucacauuuccuuuucaauuuucuacaggcugguuucugcccccacugcuccacugaaacugcucucaccauaaugagacugccucuuaauuccccaaaccaguguguucccaucuaaauccuuaucugcuggccacucccuauucuuugaaauucucuccucccuuaauuggcagaaugccucucuucuguuucuccuccaaucucuugagccacuccuccaucuucaucugauucuuuuccuccaucugccccuuaaguguuaguuuuucuagggaucuacuguugauccuaggcaaugccauccacuuucuaggcuuccacaauugcugaagcagccagggugagcuagguuaugcucugguaacaaacaacccccaaauaucugagguuuagcacaacaaaugguuacuucuuucucaugauacgugucugaaacaggucaucagggaacaucugcucaugauagucaccaaagacccaggaugguagaggauccaacauaacacugcuuccacagucagcaucagagggaggagaauguggcaaaucauacauuugcucuuaaagcuucugcccagaagugacucaugucaccucaacucacacuucauuguccaaagcaagucauauggccgugccuaacuucagagggugugggaaaguguaguccuacuaugucccugaugacuaagucccuaaccccugauggcuuccaagccuuuaugcagacccuccuucugagcugacugcuguguccaacugccuccucaacauuuccaccuggcugacucacauauaccucaaagucaacaugaccccaaacugaauuuaucgucuucacccccaacucuaugccuccuauuuucccugacuuaauaaaugaaacuauucauccagcuacccaacccagaagcuuggucaucauccuggaucucucccucucucucauuccccacauccuuaaauaauccuggugauucuaccucuuuaacaucucacauccaccccuuccucccuauuucucaauucugccacuguugccuuagucggggcccucacaaccucucacucagacuguuggaauugucuuguaacugaucucugugccuccggucuugaugccuauacuccaucaaccacacuuucagacagaaguccgaaaaguuagucaugggaguggcaagccaucuuuaaguaggcaauuauuugaaaccuauuaaaggcucuccauugccuauaggaugaagcccagcuccuugucagcuuccagagcauaucauaaccauggccauggccuuccucugcaaccucaucucccauuguaucccacuuugcgcccucuaacuaugcugaacuaccuacagucucuaaacucagcacuauuucacacuuccaggccuuuaugccugcucauuucuuugcuugaagugcacuuauucuuuccauauuccaccuaguuaccuucuacucauuuuuuuuucaaucccuaacucaacccucucccacauggagauguuuuccuguccuucagcccucaaaacacaguugaucacuccucucuuaaugcuacuacuguaccaaggagauacagugcuucuugacuuacaaugggguuacaccuugauaaacccauuguaaguugagaguaucuuaaguugaaaaugcauuuaauacaccuaaccuaccaaacaucagagcuuagccuagccuaccucaaacgugcucagaacacuuacauuagccuacaauuaggcaaaaucauccaacacaaaguguauuuuauaauaaaguguugaauaugucauguaauucauugaauacuguacuaaaagugaaaaacagaacgguuguauggguacuugaaguaucauuuccacugaauauauauugcuuucucacuuugguaaaguugaaaaaguguaaguugagccaucauaaguuggggacugucugugcuaccuaucacagugacuuaaaaugauugauucauauaguugucuccccugcucccugaagacaggaaucuugucuuacucaucucuauuaucuguaguucccaguacagugccaggcacucagaagauguucaagaaauguuugcauggacaaauaaugagaaaaacagacucagagaagucuaaaaauaccugcaggguuggcacaggggacaggaagguagcuguuccauauggcaccaguagagcuaguaagagcugcgagugaagccacaaggaggaauuaguucaaaauaaggaagaacuucuguaacugcuagaguuaucugaagauaugggcugcccuaggacagcaugacccccugugacaaggcuuacaaucagaaacuggauaagcacuuggcagugauguuggaguggaaauuccaacagcagauagggcaguguugugaugguucucauggucccuucuauucuggaacagucaugacccugacuccucugcucaccugauugacagggauuaucuaggccccuucagagcugcuccuacauuaggaacacuguuucuccacuggaccaacccuguccaggcugggcccauccagccacuggccuuugagcagauggcccaagaggcuugguggugggagagcuuucuggaacugcacuggcucuagguucucacccuccucucuggccaucuccccugccuuuccuucaggccaugccacuuugacucaugacugcucaguuugagaagcaggacagcuguugcuuauuuuuacagccacuuaaguagaacccuauuauccaccuggauuugcccuuuaaugcaucuaaucccagucugauucuaccaaucccagugaacuacuguccccagaguuauguccaugaucuccuuccucugguugaggagacugauuuugaccuaacccuguucugauccaacuuuugaaagcccagagucgggacuaggagcacuuggcucuuuucagacccugcccgaggggguuccucacacacuucucugugugcugauggaugcaguacaaagaggcaucagguuagcagucagguugccucccuucuaaucauggcuuauaguugauuucuugcaugccucugacuuggcuaagccaacccucuucuuugggucucaguuucccuauggguaaaaucugggagcggaguguaccguggugucuguggacaguggauuucauccccauguguagcucacauugcugcuuugccuccacaggcucugcggcugcagcuccagcugcuggccaagggccccaaggguacauuaggaagacaagcagcccuggagagaaggccuauagggaggauuuggauggggaaacaggccccagggauggaagcaaguuagaauccaugaaggaaacugcuuacuuccugguuggcaagaacuaaagcucuccucccuggagggcuuuucagccccagaaccaaggagcucgguauggccuccgcuuucuaaacuuucuggcccugaguccuggcuuugggauguaaaagucuucuuucuagaggagaguggggaugaugaugcccuggccagggcugcaagcgccagagccagaggguaaggcucucuggguccucccuagauuggcaacugcagagcccaggagggguggugacaccucucaucuugccccucccauuucuggagugcucugcagcccagcugggaggagggaugggacagccuucgcagcuuccuuuuuggguuaauugguguucccucuaguuauuuccugcucccuuccccucccaguucccauagcaacugggcuguagcagccagaacuugauugagcccagcaguggcccgacugagguggggaaaggagggcacugccaggucaaugcuucccaccccacccaucccccgcugccaucucaaggguucaggaugguuaagcccagaggacagggcauaauuggaaagccuuuuaugccagggcuagaguuugaagagucuaacaugccagagcaggccugguucuccucagcucuccuccccuccccaugcccuguguccugccucuuaaauuuugaauucacuguugcugguaggauuguucaguaggaagaacccuggaguuggaggugggaaaccagguuuccaguuccucccaaaccgaugguucucaaccguggcugcauacuaaaauugccugagguauuuugaaaaacuacagauguguaggcuccacccacaaggauucugacuuaguuggucuggaugugaugugagccagacaggaguauuuuuuuucuuuuuuuuuuuuuuuuagacagggucucacuguguugcccagguuggagugcaauggugugaucucagcucacugcaaccuccucccccugggcaaaggugacccucccaccucagcauccuaaauaagugggauccaaggugugcaccaccacacccagcuauguuuuuauguagagacaggguuucaccauguuguccaggcuggucuaggacuccuggacucaagcaauccaccagcuucagccucccaaagugcugggauuaccaucaugagccaccgcauccagcccaagacaggaguauuuuuuggaagcucuuugagugauugugauaugcagccagaguugagauccuggagaacaaaagagcuccguaguucacccagaacugacuguuaucuuguucugagacauuucuucccuuucccugcaucccuugccuccagcaagccccacaacucuccuaagccgggcccuccuggcuuuccuccauccuuguagacaagugcccaggaaccugugaaugcccaaacaaccucccccgucaaccccuggcucaguccuaacacuagugaaacagggcaagcuaccuagguccaucuaagaaacagggcugcagagucuaaggcaggcuuguugcccaagcuguaacaaacacugagagccagaucuuucaccugagaaggaccccaggcuaccucugaggcaugagggauagcaauggccuccgcuggccggcuguggggcugaggaauuggauuaccucugagccccacaucacucuucuuccuccauuccccucauuagcuccuugccuguuccugccucgccacccacaggccugguguccuccccaagcaaucugcucacccacuuguugucauggugacucuggcuggggguguggggacugaguggggaggucgucuaauuaaggagaaaggccacacucccaaugucaggccaccccucccccuuccccaaccuacccuggcuggcucccuccauuccucccuccaggagcagaugacgggagcgcccagccaccauagccuguuacugggcuaauugcaguugccugggaggagggcaggaacuccacuggggccuccucaccuaggagcuggaacacugaacuagaagagcccagagagaauuccacagggaccucugagucacacugauggaugcaggguugggagggggccgauugcacacauuuuggggugagggugaggcaggcucuggguccaggcuacagacauugaggcagagccuauggacagagacucaucuuggcacucuggggcucaaaagauggagggaagucucuaagguacugggacccuuaguucuuguaauuucauguucuuuccugccuuacuucuguuucuuucuccuccccuucuugcgcucucuuauuccucuuucuuagcuuugcuuucuuacagccccaucucucuuagccacucuuauuccaucuuauucacccccgcuuguucuuacccaucuuucuuacucccucuuucuuaccgcuuccucuuaacagcuccgcuuaccccuaucucacccucuguuaugucccuaccuuucaacuucuuucacccucaccccacucuuaacccuucaccucccuuacacccuccaccucuaauucccuggcucuuucuccccaaccccguuguuuccuacccccacuauuccuaccauuccuuacccucucuuugcuauacaccuccugucuuccaccccuuaccccaacugccacucucucauaccccucaaaccccucucuuccugcccuccuuuaacccuccagcucucuuacccugccuccuauuuucaccuguuuuuucacccuccuuucacucuuuucccguuccuuuucacauacucuuuuagcccaguaauuucauauuuaggaauuuauauaaauaaaauuuaacacaagugugugagagauguguguauaaagacagucacuggagcguuguucauaauagugaaaauguggaaauaaguguccaugagcaagagaucaccaaugcccuuuucauuccauucauacaaaaccauucucuguucucuuaacacaccauggauuuguuugccgacauaccuuugcuuaagcuauugucucagccuggaaugcccauuuaccucaucucuacccaucccaucuaacauccugauuugaguccaagcucaacuguucucccaccacugaaaucuuucccugcuucucuacuugcuucccuccagugguccaugguuugaacucuccuuucuauagaucauaugccauagauucaaauuagaugugucuacccaugaaacuggaauuuucaugagcguagggacauguccucauuuacuuguccuguucauucauucaacagauuuuuuaaaguguauauugugccgaguauacaacaguuaauaaagcaaacccaugucugcuuacgugcaacucacauuuuaguggggcugacaggaacaaaacaagagugcagagaaaguaauacuuguggugaagaaacaaggaaaagagaauaaugagggcagcauccuuuggugagagggguaagggagauccucucugaggagaggacauuuaaacugagaccugaaaagugagaaugacccagacaugucaagaguagggggaagagcauucugggccaaaagaauagcaugugccaaggcccugaggugggaacaaguagggcauguucaaggaaaagaaagaaaaugaaguuggagagaaagacaggagcaaaguuauacgagggcuagaagucuguggucagaagcuuaauucuaaaugcaucaaaggguuuggagcaaaggaguaacaugagucaauugcguuuugagaccacucuuccuccuguguggacaguggauuggaaagagcaagggugcagguggagaggccagaugggagacugucauccaggugagagaugaugauggcuugcccaaaggcauagauguggagcuacaauuggcaugccuugcugauggacuagauguggggauacagagaaacggaaaugaaggcugacaucuagguuucauggcacucacugaaauggucaagacuugaggaggacaguggauuggggauuaaaaaaauaagaucuacauuuuaaaauuuauaacauguuaaauuugagaugccugugagauaccgaagucccaagcaaugcuuugcucuuugggggacugguuagcaacacaaccuaccccaucacccacuaguaccucccugcuuuggaaaaggccagugugggauugcauugccaaaguccauguucacagcaguuauuuguaguuuagugaaaauguuugaaguaaguauaagaaacugacagugcuucugaaaccauguugcucagaauaugguagaagagccuccuguggcacagugaccuggaccuggcucagaaaugcagauucugagcccaccuccguccucuugaagcugaaacagagggagacaucugcauauuuuaacaaaugcuucaggggguucugaggcacucugaagucugagaaccauugcugugaggaacaacaaugaaccuagaaagcaccccuaaagauacaggacuggauguggguggcaagacaggaacaggcaaggugcaugagagccaucugggcaucuguuaaaaugcagaugcugacuuggcaggucggggguggagccugagauucugcaucucucacaagcuccuaggugauggugaugcugcugguccagguccacacuuugaagagcaaggaccuagaucaguggaucagugguugacaacuggagacaauaccccuaccccaggggaacauuugacaauggcuggagacauuuuuuuugguuuuuuuuuguuguuguuuuuuuuuuugguuuucacaagaggugaggggagagaaugcuacuacuguguaauggguagaggccagagauguugugcaguauccugcaguguacaggacagcccccacaacaaagaauuaucugacccauaaugucaguaguaucacuguuaagaaacccugggcuugaugauaaccaaagaguauggagcagggaaucuuccuuagcuaggacccagugccugguaggaguggacuagaugagggacaggaagcauacccaugaagugaaacugcaaagcagagguuccaaaugaaacguagcaguguguuugaugucugcuccaugccagagcggaagccaauagggcagagcauggaucaaguagagcucaaaggcacauguguugccugguaaggcagguuccugguuuuuuuuuuauuauuaaaaauaaccccucacauuuacauuacacuucagaguuuacaaaacauuuucauauaugccauauuauuucauccauacaacacccuaaugagguaaagcaaggauuauucuuucucuuucuugaauuuagaaacucaauaccaucagccaaagaaauguuugcugaauugaacagaacugacauuugccucauuauauauagguagucucagacaagucagauacuuccuuggaccaaguguaaaaugacaggguugcauggaaugauuggcaaggcuccuuccaguucugaccuuccaguaauuuugugaucuuugccaacacacaaauuuugagucuuggaugacugcagacuggggugcuugggaguacuggcuaugaaaucggagaucuuagguaagaugcaguggccuugauccaagcccuucuuccucucuacccccuggaucuugggguuagguuggugaggcccccuugagagaccacaaguaaguccucccaucccucuccucugaggugggaaggggcuggcacaugggcugaugcucuuuccucuccccacaggcugucuacaaggccuggcugugcucagaauacuucagcgugacccagcaggaaugccagcgcugggugcccugcaagcaauacugccuggaggugcagacccggugccccuuuauacuccccgacaaugaggaaaugguguacggagggcucccuggcuuuaucuguacagguaaaggcagggcacuggggaagagggaggaggccgggggcccagggcaggcaucaggucagaggaguugggagcagggauaacaacaggggagucaggugagaagaaggccaguggcuggacgaaugggcagugacguccccagguugggauagggccaaguggaauagggaaaaagaccagaguguccuucucugcccaaaacauguccagggagucaucccaaagaaacuggcugggguccccaggaaagaagggcucagaaagggcaagugucgagggcuguggggagggagccuuagaugaggcuacuugagcagccccagcucuggaaacuugcucccuagguaaggcauagcuaucagcuccccgagcaccccaccacaccuuccuuauccauuggcaggguugcuggauacuucaccaaagcgucuggaaaccaagugcugugacgugcagugggucuccugugaggcgaagaagaagaaguucaaggagucugaggcccccaaaacccaccagcagcaauuccaccacuccuauuuccaccacuaccaccaacaguaccaucacuaccacccccaucaugaucccccaggccgugucagcaacaagcccgcccugcugccggucucugggggcucccgccucagcccuagcaggauccggcucugcguccuuguucucaugcuccuccauaccgugguguccuucuccagcaaccaggguggugggggauuggggcuggagacacugccugcccuagaggagggccugacacgggaagagugacaguagggagggaggacagaccuccaccacacugacaucagcuccagcucccccagguugggggggagggggcuccucccaugggagguguaggauaaggugggggcgggggaaaugggggaaugacacaucccccccaaccuacccccaccccaaaagcagcuccaacagaauggccagagggccucagggagcugcaaaacucauccaggagaaaaaggcaggagcagcaagugaccccucccaagcucccaucuauggggcuuagcaaaaaaagggaggaagugggggcuggauaugcccaccccugccaaaagcccugaccccagggaaggaggcugcucacccagccuuggcccugcagggaauguuggggggcacagaggggagaagcucuuucccccacuccacauuccuuuuguugccaagauccuuaauucccuccugcccauaucccuacaggcgacggcagacagugcaauggcccuccugccacuucagcacaccuugccccaccugggaccaucacacgugaagcaccaggcugggagaugaggugcacacaguugcagcuaggucggggccccaguuaagcugugccccaccacccuaggcaaugaggggcaggaaagggguacagaaugaauggugaaagagaguggagauacggaagggggagaggagaggagaaauguggacagagggcuugaagacauggccgaauaggcuacugccacccggcuuuggggagaugggcgauaaguguugagguaggcucgagaacugcuccccaaaucagugagaauugcauuaggagcccucuggggaaagagcacaggaacugaguugcugggccucaaaacaaaaggcugcaggcacaugguuagacugccgcugucugaaggaccauaucuuacagaaggugcacauacucccaagggccacucuugcccuggagaucuuggccuuggggccaaagacauuuccauuuccgaucuccauggggaggagggacuuaagcccaagugggucaggccuggcccagguccuuauacuccccuaucuuguccuagcccaggccuccaugaaggagaaccugguggcauugccccagagcucuccagagaugagccuccccuauccccacccuguccccguccccagccuaccaaagaguauucacaccuuuccaucccugacucuauggguuacugucccaauugcgaaacacccauacuccucuucacccuguagcagggucuucugcuccagucaccccggccucuugcaagagaaaguccagggacuggcaagaagacccuuugacuaaagauaaugugcugucauaucuuggcugagaaacuguugagucaggcuagaggacuggacaagagaagaggcauugagagcccccuugggagccauuagccuugcucuggucugcugugugggguuggggaguaggggggaucccacauugccugggacaucugaaugcugauacgaauggacaggaaagggagccagagcuguauaccugggacaggccagggagccuuuagugccagcagggccuguguccugggaugugaugcuagugagugaaugggagggcgggccuggagcugcgugagagugaaaccaagaagcggauggggaagggagagcuggccuuggucagcuuagggaugaauggagaaggaaucauucaugggccucggcuaggucccagacugauuacaugagacuggggaguccuucccugccaguuuucucauuuauuacagccuaucccccaacccuaccccugugcccugccuacacacucccguuuggcccucagcacuuugggccuggucacauaccccaucccuagagugcucuuuucagcuggggaggggaagaggugcuggcuccuuuccagacaugcuuauguauaaguaaaggggcaggugcuugggcuccagagagacccuagguacugccuucuaacuccugcauccucagaaggggaaaagggacugggaaguaaagggaaaccauauggccccagggaauggacccuuggagacucccauccucucuucccccucaccaagugcccaggagaccccuggcucagaccagcccaaggccuugcccaguggcaggggaaaggggcaccucacuccaccucaaagucauuugacugcccccauccaccccaccacccuaaucuuccaccaccucuccggcugccccugcccuccaucacagacagcagagccgggcagcuuucuuaugccauuuucuacacugugcuucaugaguaggacuuucuugcacuaguuccuaugacugagucuccaaacugguuuccuaguagucccccaucccuuccucccuuacccagcuaugauucaguugucucugcccucccucuuacccugccucuguguuucggugagagucucuguauauguacugcuuucuguuuuguugcauuguggggcagaggccucucugcucuuguuuaaccccauaaagaaauaaaugguaagacuugaugauaa

SEQ ID NO: 192844 - RNA, 3588 nt, Homo sapiens
cucuuuucgacccugcggagcauccgcuuccgguucccagacugaauugucagugagcggagucugaggucgcuguggacugcccacuggugagguggugcggcguuuaugcggcugagagugcgggucucaggcagaauguggggcggggacgugggagguggcuggucaggugaaggaagggucgaucuaaggacccuaccauuacuaaucacaucuaggaaauguggggcggugccuugccccgagucccugcggauaguuaacacucccuugggcuucgaaaguagaucuuuuuagacucgacccugauuuccucuucuccagguuugagacgguaacaucuguuuugcaggauugugaaaaaugagguccucuuucuagaguaccugacagguugcuuggcauccagaagauguuuagcuaaguuaagaguuuucuucugucuuccuucucuccuccaaccuuaacaccuagauaugggcugggccuguagacugacugccuuggaauggguuggagcugcugucugaaacuugcugggcugcucucccuuuugaaccacuuuuugucuguucugauucacucuuccagggccuugcccgagauggacagccggauuccuuaugaugacuacccggugguuuucuugccugccuaugagaauccuccagcauggauuccuccucaugaggugggaaccaucuguauuccugaguaggagauuuuuuuccccgugggcaugagaugaugcaugaaagguaggauagcaggguuagaaggcgaaacggagagugaaucuuagcacuuguagccagaggacccagaagcuggauucugagcaacaggacccauugggaacuucuuuauggaagccuccugcuagggucuguucacaccgguuaauucuggaaauuuggagccuucauuuccauacuguuaagagguucagcgcgguggcucaugccuguaaucccagcacuuugggaggccgaaacaggcggaucaccugagguugggaguucgagaccagccugaccaacauggagaaaccgcgucucuacuaaaaauacaaaauuagccgggcgugguggcacaugccuguaaucccagcuacuagggaggcugaggcgggagaauugcuugaaccugggaggcagagguugcggugagcugagauugagccauugcacuccagccugggcaacaagagcaaaacuccaucucaaaaaaaaaaaaaaaaggugaagaaauggggagcuacugggcugccccagugcuauccaucuacucauuuagucuguguuaucuguucuacuuaaauuaagucuaugaccuuuccuuuuccugacuucaggguaauucauuaguguuucagaugaagguaggugugaaguaagacugguaaaauuucugggguugcugugucuugcagaggguacaccacccggacuacaacaaugaguugacccaguuucugccccgaaccaucacacugaagaagccuccuggagcucaggugaacuuaugaaaccuuauuucaggcuagauucauccauaccacaaauuggcaguguuggggggauggauuggaaagcaggugcagaugugaggaaacuuuccuucuuguggacagaaaagcugagauaacacuucugcaacuucugacuuuccucucagggacacacaagcugagcuauuguacgaugaugcuacuaguuguucuuguguuuguggucuccauugagcccccauucugugcucuugucuuacaguugggauuuaacauccgaggaggaaaggccucccagcuaggcaucuucaucuccaagguauuuaugcccaguaggcaauauggaucguuacuucccuuuguuaaauuaacagauugcagaacccuaaugucccaagggcugagaggaugacucuggauucauagaagggguauaauggagacacccccuuucccacuuaaaacuuuucauuuggcaggccaucugucugcauacauugucacagaaaaacaauagcaccauacauuugaauagcaccgaauuucacugacagucuucugaaauuaucgcaucccaaucacauguauucucucuuuaccaacaggugauuccugacucugaugcacauagagcaggacugcaggaaggggaccaaguucuagcugugaaugauguggauuuccaagauauugagcacagcaaggugagcacaguacuugggcuguggugcugcaagaagccaucucaaauaggacagauuggacaggaguagccuaaucuguaacuuaauaagaaagcauuuugcugggcacugugguacacgccuguaaucccagcuacuuaggaggcugaggcgggaggaucacuugagcccaggaauuuaagaccagcccaggcaacgcagcaagacccugucucaaaacaaacaaacaaacaaacaaaaagagagagagaaaguaagcaccucuccugggaaaguacaggagggaagcagcuauuagugacacacagguuggaguggcaaaucccuuucccccuauuaugauucugucuugggucauaucucuucauuuguacaagcugcuguguuccuuccaggcuguugagauccugaagacagcucgugaaaucagcaugcgugugcgcuucuuucccuacaguaagugccacuuucuuuuuucacuuuccugacagggcccuaaguaagaacucuuuaaauacugaugacuagaggcccuacaaguuggggauagggaaucaggagcucaagcgugaagauaaccugcucuguuccuccuuuucuucuucuuuccuucagauuaucaucgccaaaaagagaggacugugcacuagaaaguugcagcccacagcccuucauguggacucugucaugacaugcuaacuagacuucaggggagccacuucuguuuucagccccucccuggaauagugaguugggaggauggggagacagcuaaccaacugcauuacccaaaccauauugcacuuuuaguucccuaguuuucuaggugagcuucauucccugaaaggaggaugaugauaucuaggcauaaccuagccugugaggaaccuaguuaggaaagacaacugacauuuauugaauaucaugcacuagucccuuacauaugucauauuuuaauuauagaaaucaguagcaaaaagaaucuuggggauuuuccaucugacuucccuggccaucuuaucccauccuugcacuaccagaagauucauacacuuuugagacuccagugagacgcuguuuucaccccuuccuccuccuagccucucucccaaaaaguaaaacacaaugcugaagaaauauuggugugacuuuugaauguuaccgauuggauguaaaaugcuaucgagggaagaaaaagcucuuccaaagagaggagccacuggaaggaacagagcaauacuauaccuuccucgcaacuaccugugaugucugaccagaacauuagcaaggccaaggaacuuuaaccacaguauaacuaagaaauggcauagagugaggggcacugaaagaaacugcccguuccccuaggag

SEQ ID NO: 192845 - RNA, 4228 nt, Homo sapiens
agaggaaacguguggguggggagggguagugggugagggacccagguuccugacacagacagacuacacccagggaaugaagagcaagcgccauguugaagccaucauuaccauucacaucccucuuauuccugcagcugccccugcugggaguggggcugaacacgacaauucugacgcccaaugggaaugaagacaccacagcuggugggaaaucugggacuggagggggcuggugagaaggguggcugugggaaggggccguacagagaucuggugccugccacuggccauuacaaucaugugggcagaauugaaaaguggagugggaagggcaagggggaggguucccugccucacgcuacuucuucuuucuuucuuguuuguuuguuucuuucuuucuuuugaggcagggucucacuauguugccuaggcuggucucaaacuccuggccucuagugauccuccugccucagccuuucaaagcaccaggauuacagacaugagccaccgugcuuggccuccuccuucugaccaucauuucucuuucccucccugccuucauuuucuccccaaucuagauuucuuccugaccacuaugcccacugacucccucaguguuuccacucugccccucccagagguucaguguuuuguguucaaugucgaguacaugaauugcacuuggaacagcagcucugagccccagccuaccaaccucacucugcauuauugguaugagaagggacgagggggaggggaugaagaagagguggguuggaucagagaccaagagagaggguagcaagucucccagguaccccacuguuuucuccugggguaagucauaagucgguugaggggagaugaggcuaggcucuggauaucugcaguacccagauuggccccacuguuccucuuccuuccaaccuuucuccucuagguacaagaacucggauaaugauaaaguccagaagugcagccacuaucuauucucugaagaaaucacuucuggcugucaguugcaaaaaaaggagauccaccucuaccaaacauuuguuguucagcuccaggacccacgggaacccaggagacaggccacacagaugcuaaaacugcagaaucuggguaauuuggaaagaaagggucaagagaccagggauacugugggacauuggagucuacagaguaguguucuuuuaucauaaggguacaugggcagaaaagaggagguaggggaucaugaugggaagggaggagguauuaggggcacuaccuucaggauccugacuugucuaggccaggggaaugaccacauaugcacacauaucuccagugauccccugggcuccagagaaccuaacacuucacaaacugagugaaucccagcuagaacugaacuggaacaacagauucuugaaccacuguuuggagcacuuggugcaguaccggacugacugggaccacagcuggacugugagugacuagggacgugaauguagcagcuaaggccaagaaaguagggcuaaaggauucaaccagacagauagaaggaccuaauaucaagcuccuguucucugccucccagcuucucugcucacccccuacccucccuccuccaacuccuuuccccccuauuuucuccagugaguuuucuuuuuuucuuuucuuuucuuucuuucuuucuuuuuuuuuuuuuuuugagacagagccucacucuguugcccaggcuugagugcaguggggcgaucuugggcucacugcgaccucugucucccugguucaagugauucuccugcuucagccucccaaguagcugggagcaugcacaaccaugccuggcuaauuuuuguauuuuuaguaaagacaggguuuugccauguuggucaggcuggucuugaacuccugaccucaggugaucugcccaccucggccucccaaagugcugggauuacaggcgugagccaccauuccugacaccagugaguuuucauuagggauucccuacccauacucuuccugauaccagauagacaaguaaacaaaaggaagccauuaaggggauccagaggggaggcauuagauucaagucagugaagggagcaguguggcuugaguagucaagagaugagagagaaacugggcaguagcagagaugacacugguggguguucaggaguauguuuuaauucucccuucucucauagacacccacuuucccucauccucuuucuccucaaggaacaaucaguggauuauagacauaaguucuccuugccuaguguggaugggcagaaacgcuacacguuucguguucggagccgcuuuaacccacucuguggaagugcucagcauuggagugaauggagccacccaauccacugggggagcaauacuucaaaagguaaaaugggcccacaugacccaauccaugagcccaacaccccagccuuucuaacaccacugucuuuugcuccacuucccugucacuaaagccccuaaacuuggugccccaucucuccacacugucuaaccccaaccucuagaaaucaagguuuuucuguguaggguuggguuagcguguuguuagaguaggggaguggauugagaaggaggcugagggguacucaagggggcuauagaauguauaggauuucccugaagcauuccuagagagccugcaaggugaagauggcuuuggaaccagcuggaucuaggcugugccacauacuaccucuuuggccuuggccacaucccuaaacucuuggauucuguuuccuaagauguaagauggagguaauuguuccugccucacaggagcuguugugaggauuaaacagagaguaugucuuuagcgcggugccuggcaccagugccuggcauguaguaggggcacaacaaauauaagguccacuuugcuuuucuuuuuucuauagagaauccuuuccuguuugcauuggaagccgugguuaucucuguuggcuccaugggauugauuaucagccuucucuguguguauuucuggcuggaacggugagauuuggagaagcccagaaaaaugaggggaacgguagcugacaauagcagaggaggguuuugcagggucuuuaggaguaaaggaugagacaguaaguaaugagagauuacccaagaggguuuggugauggaaggaagccacaggcacagagaacacagaaucacuuuauuucauaugggacaacugggagaagggugauaaaaaagcuuuaaccuaugugcuccugcucccucuuucuccccugucaggacgaugccccgaauucccacccugaagaaccuagaggaucuuguuacugaauaccacgggaacuuuucggugagaacgcugucauaagcaugcugcagucuaucaacugccaacugccugccagcaagacagacagagugugggggugggggcagagaggagagggaaggaggcccugcacuaacugucaggauguggccgaccaaauggggcauggacuauacagagagagacacacacagaagugcagauuauagauugaaugaggcagauggcaacugguauugggggcccaggagccuguguaucccuucuguaaucaauuacagugguugcagacaucaugaguacuccuuuggcacagagcucggucuuuuacuuccugccccuaauugaccccugaccuggacauaucugucuuuaggccuggaguggugugucuaagggacuggcugagagucugcagccagacuacagugaacgacucugccucgucagugagauucccccaaaaggaggggcccuuggggaggggccuggggccuccccaugcaaccagcauagccccuacugggcccccccauguuacacccuaaagccugaaaccugaaccccaauccucugacagaagaaccccaggguccuguagcccuaagugguacuaacuuuccuucauucaacccaccugcgucucauacucaccucaccccacuguggcugauuuggaauuuugugcccccauguaagcaccccuucauuuggcauuccccacuugagaauuacccuuuugccccgaacauguuuuucuucucccucagucuggcccuuccuuuucgcaggauucuuccucccucccucuuucccucccuuccucuuuccaucuacccuccgauuguuccugaaccgaugagaaauaaaguuucuguugauaaucaucaaaaa

SEQ ID NO: 192846 - RNA, 2602 nt, Homo sapiens
ugguccugacgaucuuguuuauugaaaaguuuuaagcaggauuuuagacauaaaaauaaaagagcaaauauagaggucuuggggaccauggccacagucacugcugagcuggaggccugggcuguggcuucauggggcagcacccucuacgccaugccuuguacuccccgcacuuggggaagaugaaguuuuaguuuccaaaugagaagggcaguggggcuccaggcagccaccucgggcggcaggauggggcuuggcagcuaaggagcagcaauggugcaguccucagagcugggaggguggcuucccgggagaccugguggugcuggggcugccagugagucccgggagcgaggauauuggggagagccagagccggcagagggagggaggagccuggaaugcggggaagucagacugugggcgaaaggggagcccggauuccggccucacaagcccgaguaggaggccucugaggucucagaccaggaugaaucccggcgggaagacgauggcugccucuggagcccucucugguuggggcagcccaggcgcaagagcagcauccacauccgcucccggaacuugaccccuacaaaggcauagagcagcggguugaggcagcagugcauguagcccaggccugaggugaccgacuuggccacgucuacccugcuuucucggccacaguugcgggccaaagcgcccagguccaugaggauguccaccagcaccaccaggugauaggggguccagcagagggcaaaggccaccacgaccaccaccaccagccgcauggcccgcaggcgccgcuggccccuggaaaccagcagcacggccaggaugugggcauagcaguaggccaugaccagcaggggcagcagaaagccagccaccagcugcagcacccgcagagccgugcggcccaccugugggaaguuguauuggcaguggguggcguugaggcgcucgucguggugggccgacaggaagaugaagucugggagggcgaaaagcaggcagagcccccagacagccaggcaggugagggucacgcgggccgggggcccccggcgguagagcuggguggcaugaacuauguucagguagcggucaaagcugaugcaggccagcaggagggcuccugcguagaaguugauguugaagagggcaccugccacuuugcagaggccagagccaaagacccacuggacggcagcguccacugcccagagcggcagugucagcaccagcagcgugucugcuacagcuagguggagcaggaaggugucggugcugcucagggcuguccgccggcucagcagcacggcugccaccgcgccguugcccagcagccccagcagaaagaggaggcuguagagggcuggcaggaaggcccggucgaaguucaggcugaaguccugugggcagggcggggagguacagcacgagucacucucguuuucuccauagucauaggaagagcugaaguucuccaggagggcggcaaccucggcgucauuuagcacuugguggucacucaccugugagggcgggaacggggaggaaggggcuguguaaaggccuggcaggaacucuuuugugauugagucugauuuagucugugauuuacucugagcagcuccuccuauaacuguccccgccagucuuccagggccguacuuccucaacuccauccgcucagccugggcucugggauagugacuucccuucucaaaggcugcuucucucgcauucuucugcgugaucccaucggcccagggaccccugggcaggaagaagagcgucccuccagugcccagagcccucucugcccacuguccucucucucccugcucucccuucaggcuugccuugcguccucagugccccacccccaacacauaguucaaccaccuuccuccccagcgccucuccacaauccccuuuuccagucacuaacccuccucuucccuccuuggcccuuguccggggaccccaacuuccugcgcccccccccaccguguggccucucuacaagucaccacgccccccaaaugcaugcagucugcccaguccuucccccucccuacacugaggcuugcacggccauuuagcugcccacaaggggaucccccacuuagcuugagaaggaaucuucuuuauccccucacccccagcacuauggaccugcaggucuccccaguaccaauuuaguccagcacgccaagagucaaaguuccaagucuccugaagggagccuucgagucuacuugccccccgccccccccauuuugcagacgagacaccgaagccagagaggagaggagaggcacccagggucaguggccaagcuggguucccaauuccccagugcuguuucugccacaacccaugcggccuccagcuacucacccaacccuguggugacccugggcugugggccagcccuggcauuccccugaugccccggguuuuccacuucgaauucuggccuggccuggcugggcagcagcacuuaccucaaggaccauggcugggcuggugcucuggcugcuggguggugugcugccugccccucugcuuuggugcuugugguugg

SEQ ID NO: 192847 - RNA, 82289 nt, Homo sapiens
aauugagaugcggcuuucaggcauuuguuuaggacaugcccauggcggggcuucuaaaggggcuuguacggcaacuggagcgguucagcguucaacaacaagcuuccaagaugccgcccaaaggaaaaagugguucuggaaaagcggggaaagguagagcggccagagcgaucaaggagaaugggggcgggugaggagcgaagggagggaacagacaguccaucuccggaguccgggacggacgcagcagguagccaguggccccacagugcugccaucgauuacaucuguaggaauacauugggcuacgguucagggaccguccuaguggguaauggaaucugauggggauaguuccucggaggcgaugacuuagggcugcuauuucaagggguuauuagagcucuaaaauugggucuuaucaaaagccagcaauaggaaguacacauugguuaugguccuuaaaguucacuuuaaugcuuacagaaugacaugcccaccaucggggaaggaaucauucauccauugaacagaaaugugucaggcagagugcuaagcgcugaggauacacaaauaagacagaaggcugggcgcgguggcucacgccuauaaucccagcacuuugggaggccgagggaggauggaucacgaggucaggaguucgagaccagcuuggccaacauggcgaaaccccgucucuacuaaaaauacaaaaauucgccaggcguggugguggugcgcgcccguaaucccagcuacucgggaggcugaggcaggagaaucgcuugaacucgggaggcagagguugcaaugaaccgagaucgcgccacugcacuccagccugggcgacagagcgagccucugucucaaaaaaaaaaaagagauuuuggccuuaaggagcucccgaaguagugaggaagauaaaggcuuagugaucauaaagcacuguacuaaauguaguguugagggauguguaugggauauaauagaaauugagggaaguccuucauuuagcuggggaacagggaacggaagacuuccuggagaugaauuaggcaggucaagaugugcauugaggguagguuaaagcauuccuuacuugggguccagcagcaaaagcacugaggugagaaacagcaugaugugugcagcguaguguugcuggagcaaaaacucaaggcagaauggcaaguggugagaaugaaaacagaaacaaagacgagaucauggagagugcuauauauucugcuaagaaggacaguuaaggaucagaaagaccuguaaggagauuguugugguagucuuggugagagaugaugguggacugaccuaagggaguggcugugggaacugagaaaagagaaaagauucuguaaauauuaggaugugaaauagucaagacuuggugauuuauuggguuggggagggguggugagggaggaucaacgaucauucuguuuucuggauuggauuucuaaccuguugcugguccugcaggguaacaucaaggauacaugaggagcggggaugagauugaugaauucacuuucagauagauuggcuuugaggugucugugggacaucucaguggagauguagucaggaagugguuggauauuugagucuaaaguuugagggagaggucuagacuguacauguaaguuuuaggagucgcuaacuuauagaugguaguugagcccauuagaguguaugcaauuauccauggagaguuuauagaaugaaaagagcagagagcagaggaugugauccuaggacaggcagagaaagaggcagacagauagagggagugcagaaugguggccagaggcuggagagaccagaauguuuuaaagagagaggguauagucuaucaagaacagcagauuuggaaauuagagguggccuuggguaaaagugguuucagugaaacagaagccagauuaccgugacuagagaacugacugggaagugguaauuuggacuucuuggaaaguuuuaauugaaaagcauggaaaugggaugguagauagagaaggacagaggauuaagagaaaguuuuauuuucuuugcuucuuuggaauggggaaaacuugggagugaagcugaaggauccaguaaaguaaaagagguaaagguacagaagagugagauuuaggagaaaauggaauccaggaccuagggggagcagggacaccuuaugcuugaggucauaggaaaggagauggaggggcagggacucaguaggcaucuugaggagagugguaaaggucuggaauaucguaauggaagagggaaugaaacacaaaagaagugccuucagggcuaggagccugacuaagaucaaaggccaugaauuuguagacuacauaaucuucacagucugauuuaccuaguacuaugcaauuggcacaauauaggauugaaaagagcuaggugcagccuuaagccaugguugagguuuuguuaggcaguuaugauaggaggauagcaacaccagggaauuacaagggccagugggaaugcaguucagaugaaggaacaugggguccagagugggaagggaaaaagaagucugguggccuaggugaauguagcaggacgaagggacuggggucaagggagagguucugugaaguuaaagagcaaguauugugggaaugagacaugaggaagcuggaagaacaggagguuauagccagagacugaacuaguucugaguggcacaguuccaucgugugcccccggggcagguagcuuggaguagagagcaugacauucgggaaagagaccuagaacugagauuccccaagauagauggugaggucacucaagguaauggcaggagugaggguggagaggaagcccaaagcugaugccagagucgucaggaaaucaaaggcagugagguggcagucagaagaugacagcauccagcagggaagaggaugggauaacuggaaggcaucaucauucaagaauggaucuauagcaaacccaguuaggaguuugauuuaauaacacuccuuuggcaguaacauuuuuuuaggguuuugguagucaguauuugggguuuucaguuuaaucaaacauuuauuaaaacaccuuuugugugccaggcauugugcuaggcuuggagauacuaagacaagcaagauggagacucuugcuuaaaacuuuucaauggcggccaggcgcgguggcucacgccuguaaucccagcacuuugggaggccgaggcucgcagaucacgaggucaggagaucgagaccauccuggcuaacagggugaaacccugucucuacuaaaaauacaaaaaaaauuagcggggcgugguggcaggcgccuguagucccagcuacucgggaggcugaggcaggagaauggcaugaacccgggaggcggagcuugcagugagccgaaaucgcgccacugcacuccagccugggcgacagacagagcgagacuccgucucaaaaaaaaaaaaaaaaaaacaacuuuucaauggcucccuauuacgucuaggauaagucccaagcuccuuaauggggccaaaaggccucaaugcccugacccucagcuaccucccucaggcaggcucaucugagugcacucccaccucagauuuggcuucauccauacaauuucuuacacauaccaugucguuucccccauucuggagugucuccucauccuuucuuuggcuaaccagcuccuacucauccaggaaaccuucccuggcuggcuccagugucccucugugcuuccacagcccccuguccauaaccaucucugcaucuccugcauucuccugaaaugauccgucuuccucacuagaauaugaguuuucugaaggaagguacauggcuuguucaucuuuguacucccagugccuggaacucaguaguuguauaggaaauguuuauugaacugagcccuuaauucaacuguaauucuuaggaacaucagccucuagcaguauguaggcugccauugacacagaaguuaccauaguaguaaaaugacauacuaguaaaauguaagaugcugcuaaugguucuaggaagacaucaauaggcaauguaguagacucuagaaauuuggacaugaauguauucuuuagccaaaaauggguagugggaaauuugaucuuuuuaaaaaauguauucuuagagauuuuacuuacuggaauugugaugcuugaacacauaguugugguacaugauagaacucuuacaagaacuuaggagucugcccucagaaggcaggguguuaaauuggaugcaaagaaucugggccaggcuuccggagcuuucauucaccuauuagcacacucauuuguguauccauuuucugugaaggguuuauauagggcacagauuuccuguuugaagaaagaugggucagauuaauuuagcuugauguuguaaagcaagcuuguccaacccacggcccacgggcugcauacggcccaggauggcuuugaaugcagcccaacacaaauuugcaaacuuucuuaaaacauuaugagauuuuuauuugugauuuuuuuuuuuuuuagcuugucaacuaucauuaguguuagcguauuuuguguggcccaagauaauucuuccauuguggcccagggaagcugaaagguuggauacccuuguuguaaagugucuggccgaguucccuuuugaaguguggcguuaugauggaaauauccacuccgguuguguguuggaccuuucuguaaacauggaggugcaguuuaaaugaguaccugucaucucuucucuaaagggggagcagccucugggagugacagugcugacaagaaggcucaaggucccaaaggugguggcaaugcaguaaaggugaguuacugguuccuuuuuuuccauguuaaauauaaauucuguuuauguguuaguacacauaaaagacagaaugcuuaacucauucuaacaggcuagccuaacacugguauaaaaucaaaauaacacaaaauuguagcugggcgcaccuguaaucccagcacuuugggaggccaaggcaggcagaucagccuggccaaaauggugaaacccugucucuacuaaaaauacaaaaauuugccugguguggugguguacacuuguaauccuagcuacuugggaggcugaggcacgagaaucaagaaucgcuugaaccaggaggcugagguugcaaugagcugagauugcaccacugcacuccagccugggcaacagaguaagauuccaucucaaaaaaauaaauaaauaaaaauaaauuuuaaaaaaauggaaaauauagaccagucuugcuuaugaaaaguaauucccuuuaaauauuuugucauguacuuucucagauacccagaauuucuuuauaguuuuuuaguauuguuccuuaaaaugcauuaaguuagaucuucccaguaauugaguuauuucuuaggacaaaauaauauuuuauaaaaccaagagauuagauaaguguuaaaaguccucugcugaauaaacaggcaagggugcaggucucuuuagaaagcuuccccacuggugagccacaaaccagggucuugaccaugaaaaugggggcaggagaaaaucagcaaauaauuacuugaaauacuuaaccuagccccagaggaguaucugcugggagaaaauuuaaucugcaaacuaguaagugcuauguaacaaggcaauuuccauguuuuagucaggauaugggaggcuguacuuugauucauucauucaguaaggacuuagugacaucugcccugugccaagcaauguauuaggcucuggggauuuuuuaucauguauuuauuuaauaaaaaaguaagagaugggccaggcacaaugguucauuccuguaaucccagcacuuugggaggccaaggcacgaggaucacuugagcccaggaguuugagaccagccugggcaauauagcaagacccugucacuaaaaaaguaaaaauaaaaaaucagccagacgugguggugcacaacuguggcccuagcuacucaggaggcugaggugggaggaucgcuugagcccgagaauuugaggcuacagugagccaugauugugccacuacacucauccuaugcaacagagcgagacccugucucaaaaaaauaaauaaaaaguaagagaugguccuuguuaucacaggcuacuugggagcaguuagguaaagauauguauuucauugcuguaugauaagcauagcaguggaacugcaucauauaaauucagccauacauguguagccuaaaaaagagagaucauguaaaugguguggacuguucugcccacucuucuauucaaugaaccuaugccccacagagagagagagagaugagagacaugcaccugcuuuucuauaguugcccugaauucuugugugagcauccaaucaugugaagugggguucugguauccaaagauaaguuuucauaaaacauagccccuaaauacaacccaguuacuucauguuacaaacggaguacagcguuccuggcuaugucugggcuuaaaugagagcugacaugcuggucucccauaugacaucuucauaaagggauauucuaggguaauuuuggcuauaugcaguuuucaccuaauauguuuucacaagcaucuaaccuaagagacuguugcacugcauauggcuuuagcuacuuuuuuuuauuuuuuuuuuugagacggaguuucacucuuguuguccaggcuggagugcaauggcacgaucucggcucacugcgaccuccgccucccagguucaagcgauuguccugccucagccucccaaguaucugggaucacaggugcccgccaccgcgcccagcuaguuuuuuguauuuuuaguagagaugagguuucaccauguuggccaggcuggucuugaacuccugaccucaggugauccaucugccucggccucccaaagugcugggauuacaggcaugagccaccgugccuggcggcuuuagcuaauuuuuuaaaaacuuuguuuuguuguuuuuaucuuuguagagauggagucucgcuauguugcccaggcuggucuugaacuccuggccucaagcgauccucccgccucagccuccaacaguguuaagauuauaggggcaugagccaccacaccuggugcauguggcuuuaaagaggcaccuuacccucucuggaaaaaaaauaaguucaauguggccacucaugagauauauggaaaggaguggcacguuauucacuaggaaaguagauuaggguuaaauuuguuuuuauaaagccuuuuauuuugagauaauuauagauucacaugcaguuuuaagaaauaauacaucuagcugggcauggucgugugugccuguagucccagcuacuugggaggcugagguaggaggauuguuugagcccaggaguuugaggcggcagugagucaggaucacgccacugcacuccaaccugggcaacagaaugagaccuugucucuaaaaaagaaaaaaagaaaaaggaaaagaaauaauacguauuccuuuguuucucccaaugguaacaccuaacaaaacuauaguacaauagcacaaacaggauauugacauugauguagucaagauacagacaauccuaccacuacaaggaucccuccucuuggccuuuuauaacuauacccgcuucccuccugccccaccucugcccucuuaacccauggcagcaacuuaucuguucuccauuuguguaacuuuauaaugucaagaauguuauaugaauggaauaauacaguauguaaccuuuugggauugguuuuauucacccaguauaauucgcuggagauuucauucaggugguuuuguuuaucaauaguuuauuccucuguauugcuaaauaguaccaguugaguaucccuaauccaaaaauacaaaauacaaaaugcuguaagaucugaaacuuuuugagcgcugacaugacacucaaaguaaaugcucauuauagcauuucagauuuugaauuuucagauuagggaugcucaacugguaaguuuaaugcaaauauucccaaauccgaaacacucuggucccaagcauuuuggauaaaugauauucaaccuguaucccaugauguggaagugcuguaguaugucgaaccauucaccuguugaaggacagcuggguuguuucaaguguuuuuugaaggcaccagucggugagggacccugggacccucuggccuuuuaggguucagcuccuuucacauucugucauucugcuucagaccccaccccugugcccacacccugcccuuuugucgcuauaagcucugcagauucugagacccauccacugaccacagcuucccuccuuccccuucccuuccugccuccgccaauccuguuccucuguucuucuccucacagacccccaagcccucaagcccacccuaaucuccccacuuucuccuaggcuucauguuuguuuuccuauccccugcacacucaaaauuaggccuaagggcuugaucauuggauugaggagguccaguuuuucuuuuggccaccucccugcauccaccucccugcuacucaggaucaauccaauggucuacuuucuaugcacuuaaaauuagaucuauaguuagaagagaagaauucgagugguucuaguauaaagaaaagacaaauauuuaaggugauggauauuccaaguauacugauuugaucuuuaccaauuauaugaauguauuagauuauugcauuaccuugaaacuguacaucuacuaugcaucaauaaaaaagaaaggaaggaaaagaaaagaaaagaaaagauuuccuugaaaacgucuagcugggggcaacuuaaauauuaauacuugauuuuuaauaaguauguaaauaaaguauuuacuaauaauuccaauaugaguauuauauuugcuuauagaugaacuuauuucaguagcuuggcucaaauuugaaacaguuacuuaagaaagaaaaauucagccgggcgccgguggcucaugccuguacuccuggcacuuugggaggccaaggcuugcggaucaccugaggucaagaguccaagaucagccuggccaacaugguaaaaccccgucucugcuaaaaauacaaaaauuagucgggugugguggcgggugccuauaaucccagcuacucgggaggcugaggcaggagaaucacuugaaccugggagacagagguagcagugagccgugaucacaccacugcacuccagccugggcaacagagcgagacuccaucucaaaaaaaaaaaaaaaagcuccccagaacugcugggcccuacuggaaagucacacagccuuggggauugggacuacuaauacuuggucucugacuuuaccuaggcccucagugcugcucagcaauccuuuaccgcccaccuguagccauccaccaccccacucccaucagucaacagagaacuucauuccaugguucucaacccuagacguacaucagauucgccuaaaaaaauacgagugccuagggucucaucccagaccaacugcaucagaaucucuuggaggggggccuggacuuugauaacuuuuuuagaagggcugggcucuguggcucaugcuuguaauccuagcacuuugggagcccgagguggguguaucacuugaggucaggaauucgagaccagccuggccaacauggugacaccuugucucuacugaaaauacaaaaauuaguugggcaugguggcaugcgccuggaaucucagcuacucgggaggcugaggcaggagaaucacuuggacccgagaggcggagguugcagugagcugagauugcgccacugcacuccagccugggcgacagagugagacuccaucucaaaaaacaaaaacgaaaaacuuuucuagaauuucuggaggugauucuaauaugcugccaggguuaagaaacacucaucuagucucacagcguuagugugaggauuuaaugagauaaguacucaucaacuuuuaaauguuuuuauuauuuuaacaagaaaguggaaaccagacccauugucaggaacucauuggcuuucagcccccuagcaacaaaguuaccuccucaccuuuuuuccuuuaaggcuaauuuuucaaaccguguucugaauaccaaaccuugcuccuucauuuaucucuacccucuuuuuuguucugucuucaaccgguuuuuuuuuuccuaggucuuucccuucauuccgaaaauaugcccagggaccuuuaaaauucguggguuuuuuuguuuuuguuuuuguuuuugagauggagucucacucuuguugcccaggcuggagugcaguggcgcgaucuuggcucacugcaaccuccaucucccaguuucaagcgauucuccugcuucagccucccgaguagcugggauuacaggcauccaccaccacucccggcuaauuguuuguaguuuuaguagagaugggauuucuccauguuggccaggcuggucuccaauuccucaccucaggugauccgcccaccucugccucccaaagugcugggauuacaggccugagccaccucgcccaguguaaauuucguauuuacaugucuuccacuuuuugccucuagccagagcccuuucuccuuuucaaacaaaguuaguuuguuugaauuacccucccacuugacauuguuuccucagucagccugcuguauucuggcuucugcacuuaaacucuucugaaacuccuuuuucugagaucauuguuccaucauugcacaauguauuauacuucuuaccugaugucucugcaacccuuaacccuuguugaccauuuccuccuugaaacucucuccugccuugguuuguuagcacacgcuucucuccuaccuauauggccuuuccuuuuuauuaugcuuuuuucuuuuuucuuuuuaagagacagguucuugcucugucacacaggccggggugcaugacaugcaguggcaugaucauagcucacugcagccuucaauuccugggcucaagugauccuccugccucagccuccugaguagcuaagacuacagaugugcaccaccaugcccggcuaauuuuuuuuaaaguuuuuguagagaugggggucuuacuauguugcccagacuggucucaaacucccauccucaagggauccucccaccuuggccucccaaagugcugggguuauaggugugagccacugcgccucgccccuuuuuauuacacuuuuugaguucuuuacuuguugcuugaacauugauagucuccaagguuacuuuagcuuucuuuccuccucuucucauuuucaucuccuuccugguaaccucaugaauuccacacuucagcugccaccuccauagucaucacucccaaacucuuucuguagcuuggcucuccaagacacagcugcacuguugccaguucguuggucacacuugcagaccccacaggaaugaaaaacucuuugucgcacugucuaaacuagaauacucguuuauucauuuauaaaaugguggacgguauccccuaucugugaccacgaaugcaguguacauuuucccaggaauuguaucagacaaucacuuugugaguauggaagcagaaacaaggaggcaaucuagaagcugucucuuaaaaaaaaaaaauuaacuguaaaacagccucaggcagguccuucaggagguauuccagaagaaggcauuaucauaggagaugacagucccaugcauguuauugucccugaagaccuuuccaugggacaggacauggagguagaaaacagugauauugaugauccugacccugugugggccuaagcuaguguguguauuugugucuuagucuuuaauaaaaaaguuuaaaaauuaaaaaaaaaaauuuuaaauagaaaaaagcuuauaguggcugggcgugguggcucacaccuauaaucccaacauuuuugggagguugagguaggcagaucacuugaggucaggaguucaagaccagccuggcuaacacugugaaacccugucucuacaaaaaauacaaaaauuagcuuggcguggugacacgcgccuguaaucccagcuacucaggaggcugagagacacaagaaucgcuugaaccugggaggcggagguugcagugagcugagauugugcuacugcacuccgacuuggaugacagaaugagacuucaucucaaaaaaaaaaaaaagaaaaaagcuuauagaauaaggauaugaagaaagaaaauaguuuuguacaguugcacaauguguuuguuuuuuaagccaaguguuauuaaauagaguccaaaaguuuaaaauuuuuuaaauguauaaaguuaaaaagauauaauaaccuaaggcuaauuuaauauugaauaaagaaaaguguuuuauaaauuguagcuuacauguauaguguguauaaagucuacaguaggggacgggugcgguggcucaugccuguaaugccagcacuuugggaggucaaggcggguggaucacuugaggucaggaguucgagaccagccugaucaacauggugaaaccccgucucuacaaaaaauacaaaauuaggccggguaugguggcucaugucuguaaucccagcacuuugggaggccaagacaagcggaucaccugaggucaggaguucgagaccagccugaccaacauggcgaaaccaucucuacuaaaaauacaaaacuuauccaggugugguggcgcgugccuguaaucccagcuauuagggaggcugaggcaggagaaucacuugaacccgggagagggagguugcagugagcugagaucgcacugcugcacuccagccugggcgacagagcaagacuccgucucagaaaaaaaaaaauuagccgcuagccaggcgugguggugcaugccuguaaucccagcuacucaggaggcugaggcaggagacucacuugaacuaaggagggggagguuucggugagccaagaucgcaucauugcacuccagccugggcaaaagagcgaaacuccaucucaaaaaaaaaaaaaaaaaaaaaaaaagucuacaguaguguacaguaauguccuaggccuucauauucacucaccacucacugacucacccagagcaacuuccaguccugcaagcuccauucauguaaaguguccuauauaaguguaccauuuuuuaucuuuuauacuauauuuuuacuguaccuuuucuauguuuagauacccaaauacuuaaaccauuguguuacaguugcuuaugguauucaguacagucacauacuguacagguuuguagccuaggagcaauaggcuaugccauauagccuagauauguagcuggccauaccaucuagguuuguguaaguacaguguuauguuugcacaaaaacaaaauugccuaauaacucauuucucauguuucccuguaguuaagugacgcgugacuauaagugauucuauuugaaugugaaaugagaaauccugcgaaacagcuaucuugacaaaaucauuuucaaggauaauaguguuuuuuuaaauccauggcuuuauguaaacauaggucaaauuugaauacuucaguaggguugggcguucuuaauauucaaccuaugauaccuuuucaaaguguggaauuguggggaggcuuauacauugggucucuuuuaguaagaaauacuuccuggccaggcacggugugcugacaccuguaaucccagcacuuugggagcugaggugggcagaucacuuuaggccaggaauuugagaccagccuggccaacacagugaaacccaucucuacuaaaaauacaaaaaguuagcugggcgugguggugcgcaccuauagucccagcuacuugggaggcugaggcaggagaauugcuugaacccguggguggagguugcagugagccaagaucgggccacugcacuccagccugggcaacagacggagacucugucucaaaaaaaaagauagaaauacuuucuagcagguuuuuucuuauccucacucugaugaaauaauagcuagccguuggucaaugguagcugcauuaucucaaucuucacaauccuaugagaacacauaggucccguuaucauugcaucuugauguacaaauggagaaacacuuggagguuuaaaaacaugcguaaguucagccaggcaugguggcugacgccuguaauccuagcacuuugggaggccgaggcgggcagaucacuugaggucagggguucaagaccggccuggccaacguggugaaacaccaucucuacuaaaaauacaaaaauuagcugggcgugguaaugggugccuguaaucccagcuacucgggaggcuaaggcaagagaauugcuugaacccgggaggcagagguugcagugagcugagagcacaccacugcacuccagccugggagacagagugagacuccgucucuaaauaaauaaauaaauaaagccuaaguucauacagcagaguugggauuugauucuaggaccacagcucucaacccguaucguguuuccuccuccuguuagcaugaagguauaugguaaaagaugggagcuucccggccgugagcggcggcucacgccuguaaucccagcacuuugggaggccaaggcggguggaucacgaggucaggaguucaagaccagccuggccaacauggagaaaccccaucucuacuaaaaauacaaaaauuagccaggugugauggcacauagcuguaaacccagcuauucaggaggcugagacaggagaauugcuugaacccgggaggcagagguugcagugagccgagaucacaccacugcacuucagccuaggugacagagcaagacuccuucucaaaaaaaaaaaaaaggcggagcuucccacagccaggugccuauuuuccaucuaaaucaggacucugagacauugucuuaauauggggaaugggauugugguuguuguccugggcaaacuuccaggauuuuuacuugcuaugaacuaauguguuuuuuuuuuaacugguggggguaauccaaauguaaccacuguacuuuaaggagucauuugggucuccaaguauuacaugaauguacuuuuuccuugcaggucagacacauucuaugugaaaaacauggcaaaaucauggaagccauggaaaaguuaaagucugggaugagauucaaugaaguggccgcacaguauagugaagauaaagccaggcaagggguauguugcucuuauuauuuauaauuuucucucaagguaagaaagcaaaguaaaaaugacaaauaauaaaauaagauaaaaauucuccauccuccacagaagaaacacagaaguagggaucauuccuuuguucaaccauugguuguagcgauauuuugguuuaaagaucucaaaagcagaaauguccaacuuguaaauaguagaauaagggucaucuaugucaaaaccuaugcaugaccaaacuugcacggcuaacuucaaaguccagcaguguugagaguacuuauguguucagucuaguuagacuucuucuaccuauuuguccuuauugagccuauuccuguauugcucuuaggaauauaccucguaaccuuagcaaaauguugggaaauucucucaagcuacaguagaacuguucccucuucugggccacuugauaucacuuaucuuuuggguuuuucagggugacuuggguuggaugaccagaggguccauggugggaccauuucaagaagcagcauuugccuugccuguaagugggauggauaagccuguguuuacagacccaccgguuaagacaaaauuuggauaucauauuauuauggucgaaggaagaaaauaaaaucauaugaaagacugaauaaguuuuauacauuuuguuucuuuaaaagguauuacauauucuuuugagcuggagcugcaaggaaauacaaaaauuuuuaaaaagaaaagauauuggaugcuccuuguauucugugaaagcucuaaguauggguuuguagguguaagagaggguggggcuaagugaaugucaacuguaguagguauucagucagucuuucucaaagagaagucaagcagacucccuuuaaccuguauucucuuuccucccagaacuauaucugacucucagucugucccauaaauuaauucagaaaccaucuucaggggaagcagauaucaacucacacuauucacacaacugaaaauauugggcaucaaauagauuagugugugagaaucauaaaauaaguuccuagacaacauuuguuuuacauguuagucaacucugaucuuccaggacaggugguauuagcuccacugucuuaacauaguacguggcacguuaugccuuucaguguuaacuccuuucuuuuuaaauaaauguuuauuggaggaaaaaagcacucaguuguuccaugaguuguuuuguacuagacuaaccgagugcugguuaaagggagggaugucagcauaaaaaugucauucccucaucuucaguguauggguuacauuaagacuguccuuuccagggccaauguucugugcaucuaaauuuuuaaaauuuaaaaugccauauuuaugacauauaaaaaaguauaaagauuacuaauauaaauacuauacugcuucaaaaauaaaacuuugccaacacagcuaugugauucuuaacagauuauuuuaacacacugccuucucucccucagcugcauuugauauuauacccacuuauauaaugggaacuuuaccuagauaccugacuuucccacuugagaagaguuucugagcaccucaguagguuaugccuccaugagauuuuccccacggagcagauaugccaguguauacagagaaguucaaauagauauaagaugaaacuauggcugggcccaguggugugcgccuguagucuuagcuacuugggaggcugaggcaggaggaucacuugagcccaggaguucugggcuguaguguccuaugccaaucgggugucagcacuaaguucagcaucaauacagugaccucaucugggcacaguggcucaggccuaucaucccagcauuuuaggaggccaaggugggaggaucacuugagccuuggaguucgaggcugcaguaagcuaugaccaugcccccugcacuccagacuucagccugggcaacagaggcccugccucuuaaaaaaaaagaaagaaaaacauggugaccuccugggagugaaagaccagcagguugccuaaaaaggggugaacuggcccagguuggaaacucagcaggucaaaacuccggugcugauuaguaaugggauugcaccuuugaauauccacugcacugcagccuggccaacacagugagaccccgugucuaaaaaaaaauuuaaagcugaaacuacauguuauugauugauuuuuuuuuaaugauuuauugacauggggucuuguuacguugcugaggcugggcucaaaugacccuucugccucagccucccuaguagcugggacuacaggcaagugccacugcacccugccuacguguacuuugaaaacuacauuaaaaacaaugucucuaggcugggcacgguggcucaugccuguaaucccagcacuuugggaggcugaugcagguggaucacuugaggucaggaauuuaagaagaccagccuggccaacaugguaaaaccccguuucuacuaaaaauacaaaaauuagcugggugugguggugcacaccuguagucucagcuacuugggaggcugagccacaagaaaugcuugaacccaggagguggcugcugcaaugagcugagauuaugcuacuacacuccagccugggcgacagagcgagacuccaucucaauaaaauaaaauaaauaaaauaaaacaaugugucuaaauaagggcaguaaauucugaagagcuguauaggcaugagacacuaccaagcuagaguccuuugcuugggacauugacuugcccaggauacuaagugaauaccuauugcacagaugucaccacaaaggaaagaagcgagagugcugaaagguggacuagaaaaagcaaacuaaauucugugguauggagagagagcaguuauagcuagccugugagaaaguaaggcaggaauggaccucugacaccaagcgaaccuuugggaaguuagcuuuugauugacaacuaagauucugaaagaguugguaaacgggccaggcagcgcggcugacgccuguaaucccaacacuuugggaggccgagguggguggaucacuugaagccaggaguucaagaccagccuggccaucgugguagaauccugucucuacuaaaaauacaaaaauuagcugagugugguggugugugcuuguagucccaacuacucgggaggcugaggcaggagaauugcuucaaccugggagguggagguugcagugagccgagauugcgccacugcacuccagucugggcaacagcaaaacugucucaaaaaaaaaaaaaaagaguugacaaaugaaaaaaauuaaggauuuauacagauuuauauacauuauagcauaugcauuuaauucugcuuuaagacaucucugauuaaguucaguguuuacagaacaaaccuuauucauuguaaaauaauugcaaauuaaaaucaaaauaagauacaaguucccucuuuuuaugugucagauugguaaaguucagaaaguuuaacauuguuugguaaggguguggggaaacagacauucauccauucauuaaugguggaaaugcaauuauauccucuggaaaauaguuuggcaauaccugucaaauuuauaaauauacccuuugacccagcaacuccauuucuaggaagguauacuauaaucauauguauaaaagauacaaggauauucauuacagcauuauuuggaaacaaacugaacacuaacaauagauuaugauaaauuaugguauaucccucaauagaauaucaugcaguuauuuuaaaauuuaaaaugagguacagaauaguguacacaauacacuaucacuuggguagcaacauaaauauauacacauauguacuugugcuuguacaucauagacugucucugggaaugggaauccagaacuccaggacaggagggcaagagauuuuucaccucacacccuuagaucaggggucuuaaccuuucauuugugccuugcagccuuuggcaguuugcccagccuauggaucccuuuucaaaauguuuauuuuaggcuggaugcgguggcucacaccuguaaucccagcacuuugggaggcugaguagggcaaaucaguugaggccaggaauucaagaccagccugggcaacauagugagacccugucuacaaaaaauuuuaaaaauuagcugggcauuguggugugugccuguagugucugcucuucaggagggaggcugaggcaggaggguugcuugagcccuagaguuaaggcugcagugagccgugaucucaccacugcacuccagccugggugacaagagcgagacccugucucaaaaaagaaaaaauguugacuuuaagugcuuaaaguaaaauacauaggauuacaaaagacagcaacuauguugaaauacaguaguccaaaguuuuuaaauuguggcugggcacaguggcucacgccuguaauccaucccaguucuuuggggggccgagacagguggauugccugagcucaggaguucgagaccagccugaggaacauggugaaacccugucucuaccaaaaauacaaaaaauuagccaggcgugaugguggcgcacaccuguagucccagcuacuccuggcaggggcagguagggcugaggugggaggauugcuugagcccaggaggcggagguugcagugaaucaagauugugccacugcacucccaccugggugacagaguaagaccucgucucagaaaaaaaaguuuguaauaugugugugugccucuuuauuaaauaccugguaguaggucuaaaaagcacugugacuuugcaguaaugaauaucaauggcauuuugagauaucugcaauaaccccaaagucuaugugauuucuacuggugacauaacauguacugcuaauauuucugcaguuuaugcguacauuuguuaacaguggaggauguccagguucuuggcaucuugaacaaagaacgaaacgcacaaacaaagcaaggaagggacaaagggauuuauugaaaacgaaacuacacuccacagcauaggagcucaaaacacccuguuagagaauuuuugggaguuuaaauauccccuagaggauuccauugguuacuugggguauacccuguguaaauggaaaggaugacgugaaguuacaagucauuuacuuggccuacgcccuguggagaggauauuuccugucauagcuuuagugugaaucagccuuauguucccugccuccagacccuauuuuccugcuucacauucaugaugaaaggaaaugcuauauuucagcuaccagacagagaaaagauaaaacuuuuuuuccuauccaaauucagacaccugacuucuucuacccaugaaccccagguuaaaaaucccugccauggauacuguuugaauaugagcauguauuuuuuuccccaaacaacagaauuugucauaguacacacacacuugaacagaaagagcauugcuauuuucagugagaaauauuccuaggacuuagacgcuucacuguucagaucaaauggauauaggccgcuaaagcuuccuugaaggcaaauacauuguguggauuuuuuguuuucuacaucagggaagaaagaaguuuauuagcugaauuuucacaaacauuuuugugugugguagaagggacagaaaaacaaagauguguagggcgcagcuacucccuucacaucauggugggaagcacagggaaaugguaagcugaacucagaugcagacugugaauugcuucacaguuaguuacaccaguauuucaaaaauaaugauauauauucaaucguauuacccuaaaauaguaauaauugcuuuuaguaagagcaaaauuuuguuccaucaauaaccugaaauucagcuucuuuugaacuucuguaaucucuuguaauauacaugagauuauuaauguguauauacauauaauuuacaaguaacuuuuauauguaugggauauaauaaaaauaaauauuuggucuuugucccugguuccuggcauauaguuccugaaagccuugaaaucucaacuggugucuuuuguaugcuaaugacauagcuuguggcuggaggccccuaguagcuucaggaugggggcuggucaccagaaacagcaaggcaugauuagagggaacguucagcccuaacugcaaccucugcagaggggagaggggcugaagaugaguuaaucacccauggccaauuauuuuaucaaucaugccucccuaaggaaaccucaaaaaccuuaacaauggaguuuggagagcccuggauuaacaucaaaauguugggaggguggugugccuggagggcauggacgcuuaaugcaccacccccauaccuugcccuacacaucucuuccauuuggguguuccugaguuguagucuuuauaauaagcugguaauaguaaguaaacguuuccugaguuuuauaagcuauucuagcaaacuauuaaaccagggggugggaugggacggucaugggaaccccuaauuuguagccaagucagacagaagugugguuaacauggggaccgaacacuugccacugacgucugaagugagggcagucuggugggacugagcccuuaaacuuguggagucugaugcuaacccuggguagugucgaaacagaaucguaggacaccaguucaauuuugaauuggagaacuggagaacugcuugauguggaaaacccccacauuuggugucagaaguguuuugaguaaaaacagcucaguguauuauaguguauucauuuacacaagguuaaaaaucgguuucaccccaaccaugucaccacagggaagucacggccucacugaucacugagccuguuuccucacaugaaaaauggaaaugcuauucucccuucaccucaaaagauuaugguaaggcugaaaugagaaaccuguguggagugcccaacacauaguacgucaucaaggauaguccacuucucuggugacagagugcagcgugcuauacugcaguuuaucuuucugcaagggaaccaaacuccuuuucagucuacaauccaaagauagacugugauaauaugugucagaauagacgagauaccugguuuggugaaagggagaacacaguuaauggugcauuaagaauggcuaaauggucagcagugacuccagggcaagcuaccagugauaaagaauccuagcaccagguaccuagcucagcuuucugcuguuccaguuuaguacucuauccaaaaugcuggggaccagaaguguucuugauuguggagaauuuccauacacauaaugagauauuuuggagaugggauccaagucuaaacaugaaauccauuuauguuucauacacacauuauauacauagucugaagguaauuuuauaauuacuuuuaacgauuuugugcaugaaacaaaguuuguguauguugaaccauuuuauuacccuuuguaggcaggcuugcaugggagaaucugggccuguguggaaaggauauauaguagcugaaggggucuaacagaaucucuuuucucuuggggaugcugaguaaacaguguguuauacaccuucauuuugacugugacaugucacaugacaucagguauggaacuuuccucacuuguggcaucaugucagcacucagaaauuuuccccauuuuggauuggauuagggaugcucaaccuguauuaagcugaaagcaugaaacagcauguucacaagcauaucuuaagaucugccaguaucaucucagugaaacaaaguggauggaaaacacuugagaaaaguaacuuuaauuuucuuaucugaacuguuauauacaaagaugaucacuuucagaguaaaauuaagaaugaccagaauaauuuuacaaaacuuuccaagaaacaacacaguuaaauuuauagaauaugccuaaaauauaagaauauucaagugaagaaauauuaagcuagugcucagaauaccagacuauggaguggggggcguugcagggcagaaguugcuuuuugagaucuuucuugccuuaagccugaaugcuucauguucccaaagaauccaauuaugggaacaaaaauucccucauauucaguuucacuuuaaaauacaauaaacagguuacauucucaauuguuauuaaguugcuuauacaaacuuaaagucaagagcauaacuucaggaucugcacuuuuuaugucaagcgcuuuaacuaagcaguuuagggccuccuggauuuuuccacacucuuuuaguucuuuuccacgcuuuacaagagucucauagucauuuguagccucugccgccuuauccuggggagaaccaaccaacuguucaccagacaaaggcucaggggcaccaagagaggucucuugagcuagagcacuaggcuuagacgucauuaaccagcuggacuuguuuucugaagacaguguuucuccggaaggauccucuucuguauacuuggaggcuucgccacugcuuuccuccaccccuucuucuggauaaucuucaggacccuuugcuucacugcugucgucaagucuuuccuccauguccuccacguggucuaaaaccauauuaauaagagaccuccuagaagccagagaucuucuagaguucauagacuuauuuacacuacuggguauuugagaugaaaagaaccuuccugguggacugaugucauuuuugggaguugaagcaucaaauuguuucacagaugagaauugaaagagagauguguugaauggauuuaugcuugagguaucuuuaaaagaaucaucuucaucuucgccaucugaaacaauccuucuagcuuuacuucugauuuuugcuuuaacuacuacuucuucugguucaucgucuuucucagaaaacucccaacugagacauguuuugcuaugcacaaacccugcucuggaauuaggugcagagccacacaagcuauuuucuuucucaacaugcucuaaagacugacuggaaaaauuuugucuguugucugcugagucuuccaagaaaagauugaaaucacaugcauacuguggugaagaugcugaagguuccucuuccaacuuggccucacuugcuugagcauccugcagugcacuaugggaugcugaaaggucaucagcuauuucaauaauggauacauuugauucugcauuuugacuuucauuuguuauggaaauaaugggccaaggauugcaaugacguaaaaucucaucauccuuuaguugaucuaaauuuggcccaauaucagcuuugguugauuugcuaaguacauaauuaaaacuuuccagaggauccucuugcagugccucuugcuuaggccccucuuguaaugucucuuuuuguacagcuucauuuuuaguugcaaagcuuuuuuccauucccaaugaagaguuaguacaaaguucuucuacacuuccaaaccccuuugguaaaguagcuauagagucagcacuaccuguaccuuuaccaucuugcaaggugguaacauucaccuuuauacuggagagaucuuguuucucacccucuuugggcagaucaucaaugacuacacuugccauuuuggaacugauaucuucuuccugaguaugaugaguacuuagaagaggugaaggcugaggcugugguuuauucaauuuagggcauuucuucuuuguugaagaaggaaauacagguucucuuagccaggcccccucauuucuaguucuuuguuguuccaucaggaacucuuuauuuugagacucgaauucaacgaggaauugagcuuucugaacccuuuguugaauauagugagauucuucuaccacaucaagcucuucuuuaacagacagaucacauguguacaucaaaucauggucugagauuccagcuauccccaaagacugcagguaggcaauauguucaucuaguuuuauaucagauuuccucugagcagcaugcaaagacugaagcugcagcuggguuacagaguucugaagauccucgauuguaaagagcucucuuaauucuuguuuacuaaaauaucggaaaggguucuuuuuuucaccaguaguuugucuuauuaaugaguccuugaaaaccugucuucuguauauuuuuuccucuacagucccacaagugauuagccuauaaaccacaacauucucuuuuuguccaauucgguaaacucuauccacagcuugagcaucaguugcaggauuccagcuagggucaaaaaugaccacucuaguugcugcaguuaauguuaaaccgacaccaccuacuugagugguaagcagaaaaacagaguaaucuuuauuuugcuggaauaaguuaauucuuuuuucucguuccaaaagaugaguaacugucccaucgauucgcaaugucuuaaagugccuauucuuuaagaggcguucaaugauguuuagaauuugccucgauugagaaaacaccagaguuugaugucccucaucucgcagccucuuaaguagguccauuaggaauaucauuuuuccagauucuuccaucaaugugucaucaguuacuugaucaauaugguccacaucuggggaaucuucccccucauuuccaucuugagcagagaaugucccaagauuuagcaaacaacaagcccgugcagacagcagccuaggaugaucacacagcuucuuuaagacaccuagcucagccaaaggugagcgcgucuccauuagcaacuccuugauaugaucuaaagacacaaauuuccuguauauuucuucuuguaaaggcacaagucguauccaaauaauuaaaucauuuuuccuggaaagggaaggcauuucacaaauggcaucaacaucuggauucuuuucauuaagucuggccucuggguugcuugacuuuuucuucuguacgucuucuuuaguccuccugagaaaauaggguuuuaugauugccauuaaguuuucagauauuuuaaaucccaaggcuuuuucuccugggguagcauccuucucucuugcucuaguaauaggauuuucauacuccaucuuaaaaguuuuuaauguucccagcagggacccuugacaagcaaaaucaaauagggaccauaguucuuguaaauuauucuggauugggguuccugugaggaggaggcgauuacuugcaggaauagcacgagcacauauugcugacuuaguagaugagguuuuuauuuuaugugcuucaucgaggaugacauagucccacacaaacucuuggccccuaaagcuugaaaguugcugccaguuauugauuaacauuugguauguagugauaauaacaccauuccuuugcugaauccgauugagguuucugguccguucauccuugcuaggaccaugaaagguuuugacucucauuccuggaguccacuugaugaauucuuuuacccauguguuaauaagauugguuggcaugaucagcagcacaugauucacaagugaugcaucaaacauaccggaaaggaaagcaaugauuugaacagucuucccuaaucccauaucaucagccaauauaccaccuuuucuuccaucccuauacaggcuauagaggaaagcuaugccuuccuucuggugcucaaagaguugguugugcaguucucgauaaaguagcaagccagaguugcacacaucuguaaauucaucaucucccuguucugccaacuccuccaaggcuuccuguauuuuuuggauucugcucagcacuuuuucauugggaaaaauguccuuugccaaauugaaaaguuuaaaugcuucuuccaggucuccauucuuaguugcuucuuuggccucuuucacauaucuauagaaaaaaaaagaagaagaggagaaaggaaacauugaacauucagucuaagaaugcuuuagaguucauuuuagaauccaaacugcagcuggacuuuuaauauccucaauucaggaugggaaagauuagcacacaagaugccaaugaaagcuggcgucacuugagacacaaacaaauauccaccagaugcugccagcaacaccuucaggcacuaguuguggaaaaugaaugugcaaagguuauugguuccacaguauuuuuuuuuuaauuggcacccauaagaaguaugaagugauauuuuuuguaaaacaaaccucuauguguaggggcauggaaacaugggaaccucucuggccuuauuuuacuggaccuccauuuaacaguauugaucacuccccuccccucuuaaaauucccuccuuucacgagauuccuauagauuccuucugguuuuccuccucuucacugaccauuucuucuguguucuuccucccagaggacucaguccuaggaccucuucucacucuuuuuaaucucuccucaaguuuucccagagcuuccgcucccaccuaugugcucaugacucucaaaucacucucuccaaccuagagcugucccucaagcucuacucuagacccauauuccagcugccuucuggacaucuccacuugaaaucaaauucaauucaucccaaacuagacucauuauuuccccucuaaaaacgugcuucuccauuuguaugguacuaaauaacacuaccaucuauuuagccacccaaacuucaaaucugaagagaauccuugaccccaaccuaaauaggagucauccuuguccuuucuuuuuaugccccacccccaggccaggcagucccaaguccuacuaacuuuauuucccaaguuauaaccaccuucuuuccaucucuacuaccauuacuguggcccaagucaccaucaucucuggccuggauaacugcagcuuccuacauaaacugcucucccuacauaaacucuugccccuccaauacacacucuauauagcagccagcaauacugucuuaaagcauaaaagaaaucaugucacuccucugcuuaaaauucuucagugguuuauggucaauuacuuucaguaagggcgccaaaauaauucacuggggaagaagucuuuucaacuggauauccaugugcaaaagaaugaaauuggaccccuacucauaccauacacaaaaauuaacucaaaauggaucauagaucuaaaucuaagggcuaaaccuacaaaacuuaggaaaaaauauagguguaaaaaucuucaugacuuggauuuggcaauaucuuaaauaugaugccgaacacacaagcaaccagagggggggaagagauauacagggccgggugcgguggcucaugacugugaucccagcacuuuugggaggccaaggcaggaggaucgcuugaggucaggaguuuaagacuagccugaauaacauagcgagacugucucuuaaaaaauaaauaaauaaauaaauaaauaaauaaauaaauaaauaaauggaaaaaagauauacagaugggcacaugaaaagacucucaacaucauuaguugucagggaaaugcaaaccaaaaccacaaggagauaccacuucccauuaggauggcuauaaccaacaagugggaaaauaccaaguguuggcaaggugugaaaaacucccacuauugaugggaauuauuaaggguucagagcugcuuuggaaagcggucuugaucuauguucuagagcuugaaggaaaaaauaacauucuuaaauuauuagauuauuuccaaguuccugaacugguaaccuacccaguauccugaaaccccuaugaaaccugggguucuguguaacucuagccaggcgucuuucccagagacuaaagugcugucccugauccuuagcucugggccagaguccccacuaaucacacacgccagccuuuuaaauggcaacugugugccuagacuucuuagcaccagccuaaaauacuuauugcugugcucuacccacccucuggaacccccauuugucaaccucugccugaaccacaacgagaguuuacaguauuccuuggauaucacugcuuucuggcuggguuaaaccgcugcugugagccaagcugccuuccccagucccugguccacccuaguuagcaggucugucuaacaacugcaucucagcucuuccuuuccccucagucuauuccaccaauuaaguuggaccuaggaugguauucuuucccuacaauggaaucaggaggaaaaauaaaugcuuuuaauagcacugcccuggauaucugauuauuugcaagacuagaaugcuuuuuacaaugcaguuugauuuagccacuuaacuucuaaucacuuccauuuuucagggcuuggagggaaaacauguccuuuuuauugcuaauguaaugauuuauccaucuauagcacacaggaucccuaaugaucuggauaacuuagcuaacacuucaugggcucaaguauuuuuccagaauugcuccccuauuuuccuugaacauaggcagggagaagccaggccugcuugggagccaagaggacagggaggaguaaccaguucaggacaaagaaccauaacccucaagcaagagaacaaggagaagaauagugcuagaguauggggugaaaugucaguuuuuaauuccauaggaauggacaauaaaaacaaaaauuuuauguuuaaaugguuuuaccugaaauuauaugacuagagcauguuucucuuuaaggauuauuuuaaaggacaucuaaucaccucccacaaggugucuccccaaacacgugaggauuacagucuggauuacaauucaagaugagauugaggauuacaaucuggauuacaauucaagaugagauuauggguggggucacagccaaaccauaucaguggcacacaccuguagucagucccagcuauucaggaggcugaggcaagaaguucgcuucagcaugggaggucuaggcugcagugagccaugaucgcaccacugcacuacagccugggugacagagcaagacccguuucaaaaauaaaaaaaaaaagaaauauuauauacaaacaacuccuggaggaaggugauacaacaauuaaacuugggcuacaaaguccuguuaccuggaaagcuacacuuucgcuggcaaaacugcccaguugcuaacccccugggucauaaccccaccuaaaggucucucuauaagaagcccugcccaaguggccauauaaaaucaucucuguggcugggcaugguggcucaugccuguaaucccagcacuuugggaggcugaggcgguugaaucaccugaagucaggaguucaggaccagccuggccaacauggugaaaccccgucucuacuaaaaauacaaaaaaauuagccgggcaugguggugggugccuguaaucccagcuacucgggaggcugaggcaugagaaucacgugaaaggcggggguugcagugagccaagaucgcaccacuacacuccaaccgugcaccacagcgagaccccaucucaaaaaaaauaauaauaauaauaauaaaaucaucucugccccaaagcuauuuccucagaugcaaacauuuuccuugaccauagccaauuaaccucucaacaucuaauccaccucccuuuggaacuggcugauaccuugagaaaccuuucuucuccacagagggucugccaguucagaugcugaaaaguuuuucuaucuggagaaacccauaagccauacuauuagaccuaugccccaaagagcuaagcuaaguuaaacacacaguguuuacaaaugagcagcugaaaaggcacacaagcuuaaguugcagaagacacacacuugauuuuccuugcuauggagggcccuuuagaacauucccuacaaaguuauuuuagaaugugaagagacagcugggagcgguggcuugagccucuaaucccaguacuuugggaggccaaggcgggcagauugcuugagcccaggaguuugagacuagccugggcaacauagugaagcccuggucucuacaaaaaauagaaaaaaaauuagccggguuugguggcaugcgccuagacccagcuacugggaggcuaaggugggagggauggcuugagccugggaggcagggguugcauugagcuaugaucgugucaccacugcacuccagccugggcuacagagccagacccugucucaaaaaaaaaagaaugugaagagacagagaacugaaugcaaagacccuaacucaauaaaacuuuguuuucuucacaugcaaaacaaucagaaaugcucuuuguuuuguaaucuggccaccagccacuaggcccauauagggguggaggagccuagaccugcuaaucucggcgcaugugagugggguuauugcuguccucucaacaagaacccaguuuugagagacaggacuugcuggauuuccuaggcugacuaagaauuccuaagccuagcuggggaaggugacuacaccuaccuuuaaauacagggcuuauaacucagcucacacccaaccaaucagguaguaaagagggcucacugaaauacaaauuaggcuaaaagcaggagguaaagaaauagucaaaucauauaucgcccgagagcacagggggagggaaaaugaucgggauauaaauccaggcauucgagccgggaggggcaaccucgucugggucccucccauuguaugggagcucuguuuucacucuauuaaaucuugcaacugcacacucuucuggucuguguuuguuacggcucgagcugagcuuucgcucaccguccaccacugcuguuugccaccguugcagacccaucgcugacuuccaccccuccagauauggcaggguguccgcugcguuucugauauagcaaggcgcccauugccgcucccaaucgggcuaaaggcucgccauuguuccugcauggcuaagugcccggguucguccuaauccagcugaacacuaguugcuggguuccacgguucucuuccaugacccacggcuucuaauagagcuauaacacucaccauguggcccaagguuccauuccuuggaauccgugaggccaagaaccccaggucagagaacaaaaggcuugcugccaucuugggagcggcccaccacuaucuugggagcucugagaacaaagaccuguccguuaacaguuucccuauacugauccagcuccuggaguaucugcucccugacaugucucuauguccaguccccuugucaagaugcauguagaugcauuagacacaacagaugucuuuugauucuccaucaaaaucaauaaaacauaaaacauuuggauaacauaaaaauugcaggugaccugaaugccaguauugaaaacagguccauuuaaagcccaagucauggcagaguaggcuaggaggauuccuuccuuuuggcuucacuuucagggauggucauuuuaauuaagguggggaucauuuuaaaaucacauauaaacacaaacaauauuauuaaauagugauuucugacauaaauuagggaaaaaugugguucacauuucagucaaacaauauuuaauaauuagcuuuucccugcuuagcgccauuuauaagacaggcauuuaagagucaaaaaaacaaacaauguugcuuuacucuuaauagccaaaaacuggaaacaaccccagcacuuugggaggccgaggcgguuggaucaccugaagucaggaguuugagaccagccuggccaacauggugaaacccaucucuacuaaaaauacaaaaauuagccaggcaugguggcaggcaccuguaaucccaucuacucuggaggcaaaggcaggagaaucaugugaaccagggaggcggaaguugcagugagccgagaucaugccacagcacuccagccuggaugacagagugagacuccaucucaaaaaaaaaaaaaaaaacaaaacaaaaguuuaggccaggcacgguggcucacaccuguaauccuagcacuuugggaggccgaggugggcagaucacuugaggucaggaguucgagauuagcccugccaucaugguggaacaccaucucuacuaaaaauacaaaaauuagccagguguggugacggguuccuguaauccuagcuacuuaggaggcugaggcaggaaaaucgcuugaacucaggagauggagguugcagugagccaagaucaagccacugcacuccagccuggaugaaaaagcaagacucugacucaaaacaaacaaacaaacaaaaaaacccaccaaucugugauauauucauacaaaggacucaauaauagaaaagaacaaacuacuacauguaugaauuuauacauguaugaaucucaaaaacaugcugaggaaaagccaggcauaaaagaguagcaacagugugauuucacuuauaucaaguucuaaaauaggcaaaacuaacauaugguggaaaacaucaagacagugguugccucuggagguggaaaaugccugggaaagggcgugagggcacuuucuggggugauaauaguauucuauauccugauagggguuuggguuacacacguguaugcacuugucaaaauucaccaaauguacacuuaagauuugugcauuucuuuguaugaaaauuuuacuuuaaaagaaaaaaacuaaacaaauauugaaauccacuuaauaguuuauaugcugaaguguuuagggggaaguacccugaugucugcaauuuacuuugaaauguauccuaaaaaaagaagauggauugauggaauagaugcaagaauagguaugugauaaagugaguauaguaaaauguuaauaacagaaucuaggugguaggugaaagagacuaaaaagacugcuuugccaauagacugcugccuaucaauuugaaggcauacaaaaagcaagauucauaacacgcugcgauuuggcuucuuaccuagcacucuaauguaacuguucucaccaaggacaccaaccuccauauugccaaacuccauggacaguucuuagucuuuaucuuucuggaccuuucugcugugcuuaaaaccacugauaacuacaucccuccugaaguuuucccucccgcuuggguucaguggcauacaacccuucuccuagauuucuucuaccucacuaaccauucaagaugcucagucugcaucuugaauuccucuccauccacauauccccuauaaaauguuggcauuucuggggaucuuuuuguugucaauguccuucugauucuauguacauuucccagaagauuuuauccacgggagugcccuguacuagguuaaauagaguccuccaaaauuucaugucaaccuggagcccgugaaugugaccaggacauugcagauguuauugauuuaagaugagaucauacuggauuaggguaggcccuaaccucauaugacuaguuuacuuauaagagguaaacugagacaccgagacauagagaggagaaugccacaugaagauggaggcagagaauggagugacgcaucuacaagccaaaaagcuccuaggauugccaguaccaccauaaacuaggagagaggcuuggaacagauuauuucucagucuccaaaaagaaaccaacccugcugacaccuugauuucagacuucuaguuuccauaacugugacagaaugucuagguuuuuuaaaaaaaugugguaaaauacauauaacauaaaauugccauuuuaaccauuuuaaggguacaauggcauugauuacauucacaacguguaaucaucaccacuauccuucucaugauaccaaacagaaacucuguacccauuaagcuauaacuccccauuucucccaccccucagugacaucuaaucuacuguuugucucuguguaugugccuauucuagauauuucauauagguggaaucauauaguauuuguccuuuuguguuuggcagguuaaccagauaaccuugggcuagaagauuaaggagcuggagguacuaaaggucuauacccauuguaaaaaccccaaaguauuuguccuuuuguguuuggcaagguuaaccagauaaccuugggcuagaagauuaaggagcuggagguacuaaaggucuauacccauuguaaaagaaauuaacugucccuggagaauuuuucauuuuuaguuagacuuuauuccaaagggucagucaggauguuagccaccaaaugcuccccaaaaauaauaaaacuucuuucugcugaggaacauuggcugguaggauacccucuagaugccaaagcacaucugcuaugccagaaaaaaggauaauuuugguuuuggcauaauuacuguuaugcuguuuuuuuccggagugauuagccagcagguucagcugcuuucugagggcauguuguuagcauguaggaggaugcuuccuuccuguuuauucuggcagaaggguauuugcccaguucaaccaaaagcagcacuaaaauguucaggucugauuacaaaggaggaguucaacaacccugccugcuuuuacucacuuugaaaucagcuuugcucuuccugccugcuuguauucucuuuaugacaggguauaaaggaccuaaaagagcaagaagaaccuugggucucuuuugagccauauaguuugguccaaauaguucuugucugaggaauccaaagccaauaaccagauaauaaauauuacagaaagccuuacgcuuuuuucagugauugcucuuguaggugaaauagaguacggagcugacagugucaagccccaaaccaaaacuuguguaggcuccuauccuaagaggcccaggccaccauuaaauugaauauucauguuuuauacauuuuauuuaugcauauauugugaaauauacauaucuuauauuucacaauaaaaguuuuaaagaauguuacuugcccacccuaguggccaggggauaagaccauuaccagaagguggacaugaaagcuuacugagcagaaaaaaaaauaaaaaaaaacacaaaaagaacaaaauacaacagcaaccauuauucccuacacauaagcaagugccugaaauaugggcacuccaugcuguuccaggaaagaacaguguagaacucuugcuucuauuccauugaucuauaucuauacuuaugcaaguaccacacugucuugacuacuguagcuuugucguaaguuuugaauuugggaacuaugaguccucuaacuuuguuccuuuaaaaauuuucuuuaaauaauagagaugggggccgggcgcgguggcucaugccuguaaucccagcacuuuggaaggccaaggcaggcggaucaggaggucaggagaucgagaccauccugacuaacacggugaaacccugucucuacuaaaaauacaaaaaauuagcugggcaugguggugggcgccuguagucccagcuacucaggaggcugaggcaggagaauggugggaaccugggaggcggagcuugcagugagucaagaucgcaccacugcacuccagccugggcgacagagcgagacucugucucaaaaaaaaaaaaaaaauuaauaauagagaugggguauugccauguugcccaggcuggucucaaacuggccuuaagugauccuccugucucagucaccugaguagcugggauuacagaugugaggcaccacggucggcuaaacuacucuuuuucaagauuguuuuggcuauucuggguccccuguauuucuauauggcuuuuauaauaguuugucaauuucuuucucuuuuuuuuuuuuuuggaaacaagagucucgcucugucacccaggcuggagugcaguggcacggucuugguucacugcaaccucugccucccagguucaagcgacuguccugccucaaccucccgagcagcugggauuauaggcgugcaccacccucaccuggcuaauuucuguauuuuuacuagagacgggguuucaccauguuggccgggcugguagcucaucaauuucuacaaaaaagccagcugagauuuucuuagauguggcauuagaaucuguagaacacuuugggaaguauugccauuuuaaagauauuacaucuuucaauccauaaacacaggauaucuuucuuuuauuuaggccuucuuaaauuucuuucaacaauguuuuauaguuuucaguaucuaaguguugcaccuccucguauaaauuuacuccuaagcauuuauuuuuguugcuauuguaaauggaauuguuuuggcugggcacaguggcccacgccugugaucccagcacuuuaggaggcugaggugggcggaccaccugaggucaggaguucgagaccugccuggccaacgcagugaaaccccgucccuacuaaaaauacaaaaauuagcugggugugguggugggcaccuguaaucccagcuacuugggagacugaggcaggagaaucgcuugaacccaggagguggagguugcagagagcagagaucgcgccauugcacuccagccugggaaacagaaugagacccugucccagaaauaaauaaauaaggccaggugcgguggcucaugccuguaaucccaguacuuugugaggccaaggcgggaggaucaccugaggucaggaguuugagaccagccuggccaacauggugaaaccccaucucuacuaaaaauacaaaaauuagccgggcgugguggccugcgccugaaaucccagcuacucaggaggcagaggcaggagaaucgcuugaaccugggagauggagguugcaguaagccgagauugcgccauugcacuccagccuggacaacagacucugccucaaaaaauauaaauaaauagacuaggcgugauagcucaugccuguaaucccagcacuuugggaggccaaggcgggcagaucacuugaggucaggaguucgaaaccagccugaccaacaugaagaagccccgccucuacuaaaaauacaaaaaaauuagcgggcgugguggugcacgccugucaucccagcuacucaggaggcugaggcaggagaaucacuugaacccgggaggcagagauugcagcgagucaagguugcgccacugcacuccagccuggcgacacagugagacuccgucucaaaaaaaaaaaaaaaagaaccuccacuauaauguugaauuauaaugugaagagaagucgcaagagcagacaaacauccuugccuuguuccugauaugagcgggaaaagccuuuagucuuucaccauuaaguacaauguuagcuaugggauuuuuguagauacccuugaucagguuaaggaaguuaccuuuuauuccuaguuuguugaguguuuuuguaucacgaaaaggugcuggauuuugucaaauguuuuuuucugcaccuauugagguaagaaauguguuuuuuguccuuuaguuuuuaggcauguuaaaucugauaugucuauuaucaagcagagaugucaaccaagcaaucacauauaggaguauggaguucaagaggucaggacuaaagauaaaaaauguaauaaucaucaaagaaaugcaaauuaaaaccacauugaaauaucaccucauuccuguuagacuuucuauuaucaaaaagaugaaagauaaguguugacagagcaggagcaucggcaucuuggacaggccccucauucagcgggagcaucggcaucuuggacaagccccacauucuaaaguucaccuuaauaaaaaaccaccuaaaucuaaagggcaucagccuaauggcuaaggucagcaugaccauaaaccacaauuaacaucuccaaccagaaacauuccaaacuccucccugaccagagacaugcuagccccaagauaaccccccucuggccaggaggaugccagccuugagauaacaccccucuggccagaaagaugucugccccaagauaaccuccccuccucccagagagauuccaaccccgccauaaaacuucucccucacacagaaacauucuaagcuugugauaagcccccucacccuaaaaccaauauauacuguuagucuguaagagaaagcacuccugaccaaaauuggccagaaaccccucucagguuuuaucuaaaguaaaccugccucuaacugucaagcauuuguguuucuuuucucuuucuuuaacucuuauauuuggugccgaaaucuggaacaggugcugggggcagaggcucucuugcaacccaggaagcagugggcaacggcagcucaucauaaguuaauuccuggauccugagggucucuggucaccugccccgucuuuucucucacuucauuuuuggagcgauuugcaugaggacaacuaaccugaaggggacugcaaggcucuggccggggcuacuccccaacaagucuuuaaaccuucagaucuugggaauccaccuccaacuucccacaauggguauuuugcccucuccccuccuccucccuucucucuuucucucuuccucauguggcucugguuuaaggggcccuuugccaauuccaacuggaacauccaacauuggacacuaauccagccaacugcuaagaucugcccuccucuggcuuucucacgguaccaggaaaaguuaggucugccaucccgguccucagaggaccagcaggacuaaaaagcuagaagaaaucuuggggaugcccaguuuucaucucagcuugaccauccucuuuagaaagaggacgccgggucucugucuuucaucuggggaugccuagaacaaaaacagacacccucggcuucuucucaccaguccacaugggugccaaacaaucccacauuccuacauccuccccacugggcugccuccuucacaaccucaccaaacuuggcuuaccgggaagcauaaagccaaagcauuuagucuuuuauugcaacauggucuggcugcaauacacauuagauaaugacagccgaugguuggaaaaugucaccuuuuacuugcaaauucuuagggaccucgacaacuuuauaaccaggaauggcaaauggcaagagguucucuacauucaggcuuucuucuaccuuagcucccaacccucccuaugucaagcuugcaccccucaugaaguccuucuucucaaugaaaaugcugucugggucucucccuccuccaaaaaccuuuccucugagaucccuucccgcgaaaacccuuccuccaaaaccccuucccucgaaaccccuuccucugaaaccccuuuugacccugcagaugaacccccuucguauucccaucccccugguucugcuccucauccuuccaaacccuccaccccagggggcccuccugcccucaagccuccagccccaaaccccacuccuccuccuucuccaccuguuacccguucaaaagccaccagucaaaccaccccagccauucucccucuccgggaaguggcugggguugaaggcauugcucguauucacaucccuuucuccaagucugauuugucacaaaucaaacggcagcuaggauccuucucugacaaucccuaucacuaucgcagggaauuccugcacguaacccaauccuuuaauuuaacuuggcaugauauuuauauaauuuuaaccuccacccucacuccugaugaaaaggagagcaucugguguucagcugaagcccaugcagaugaacuccauaaccaagccccuauauaaaauccaguggccaaugaugcagucccccauagagacacagacuggacuuaccaacagggaaacaauggcaucaggcgacagaaccacaugauuaccugucuccucacgggcaugaacaaaaaugcccauaaggcaguuaauuaugaaaaacucagagaaauuacaaaggagccccaggagaauccagccuuuuuuuuuuuuuuuuuuuuuagauggagucucacucuguugcccagguuggaacgcaguagcgcgaucucagcucacugcaaccuccgccucccagguucaagcgauucuccugccucagccuccugaguagcugggauuacaggcgcgugucaccacgcccagcuaauuuuuguauuuuuaguagagacaggguuucaucauguuggucaggcugaucucgaacuccugaccucgugauccacccgccucggccucccaaagugcugggauuacaggcaugagccacugcgcccggccugaauccugcccuuuucuuaucacaucucacugaagccaugcuaaaauauaccaaucuggauccagaaucuagagaagggcaaacuuuucuccacuuccaauuuauuucccaaucugccccagauauccagaaaauauuacaaaaauuagaggaaggucagccgggugcaguggcucacgccuguaaucccagcacuuuuggaggccgaggcaggcggaucacgaggucaagagaucgagaccacccuggccaacauggugaaaccccgucucuacuaaaaauacaaaaaaaaaauuagccgggcaugguggcaggcgccuguaaucccagcuacuugggaggcugaagcaggagaaucacuugaaccugggaggcggagguugcggugagcugagaucacgccauugcacuccagccugggcaaaaagagugaaacucugucuuaaaaaaaaaaaaaaaauuagaggaagguccccaaacaucucagcaggaccuccuaaaugcggccuuuggagacaguuuugcucuuguugcccaggcuggagugcaauggcgugaucuuggcucacugcaacuucugccucccagguucaagcgauucuccugccucagccucccgaguagcugggauuacaggcaugcgccaccccacccagcuaauuuuguauuuuuaguagagacgggguuucgccauguuggucaggcuggucucaaacuccugaccucaggugauccacccgccuuggccucccaaagugcuggaaggccuuccgugucuuuaacaacagagacaaggaacaaaaaauucaaaaagacaaacaugucugguuaaaauaccagaugcucaccucugcuguccaaaggucaguuacacaaaagccuccagacaaccccaagggaaacuccgucaccucucuggaagugucacccugaagugccacaucaggguuccaauguggcaacccuggacacugggcaaaggcuuguccuagccccuggcccccuaccaaaccgugcccaacuuguggucuuuggggacacuggaaaauggacugugcccaauggauacacccucccuguucaaguguagcccugugaggcccccugaccaucacaggaggaaauaucuucacugcugguacugacaacggaagacugagggugccuggaauccuucacccccacauccagugaguccauggaacccaggguaauugggacgguauccaguaagauuauuuccuuucuccuggauacuggggcgagccuaucaguauuaacugaauaucaaggcccacuagaauguucauaauuuucuguuguuggcaugaaggacauacaagaacuuccauacaaaacacugccucuauacugcucauuucagggagucacucucacucacucuuucuuggucauuccucauugucccacuccuuuacuaggaagggacauccuacacaaacuagggggaaucauucauucaucggcccuacaucaaagccacccuuacuuauuauuaugucaagaaaaaaaccccuccucagacacuccacaucaaauagacuuaaaacccaaauuccuggcucacgccuguaaucacagcacuuugggaggccgaggcaggcggaucaccugaguuugggagcuugagaccagccugaccaacauggagaaacccugucucuacuaaaaaugcaaaauuaacugggcgugguggugcaugccuauaaucccagcuacucggaggcugaggcaagagaauugcuugaauccgggagguggagguugcagcaagccaagaucacgccauuguacuccagccugggcaacaagagcaaaacucugucucaaaacaaacaaacaaacaaaaaacacccaaaucccucagccagguaaauccuauaguauggaacacugacucccccauaauagcuacccaccauucucuaauucaaaucucacuaaaggauccuaagcgcuacacaguggucccacaauaucaccucaacccuaauggauuacagggacucaagcccaucaucuacugacuuuuggcugccaauauuuuaauccccacccauucuccccauaauacuccuauucucccaaucaaaaaaccagauggcuccuauagacugguucaggauuugugauaaaucaacuccacuguuguuccuguuuauccuauuguucccaaaccccuacacccuccuauugcaaauuccucccaacacuagccauuucucaguauuggaccucaaagaugcuuuuuuuacuauuccucuacaucccuccucucaaaaccuuuuugcuuucacuuagaccgacccugacauaggcuacucccaacaacuuaccuggacuguccucccccagggguuuagggacagcccucacuauuucggucaggcacuucaauuagaccucucccagcuacaucuacaaccuagcaucuugcuucaguacauggaugauuuacuucuuugcagccccucucuagaacauuguauucaacacaccaccaggcuuuuacauuuuuugucugaaugcagguaccagguguccaaaaagaaggcccaauuaaccucuccaaaagucucauaccuaggauuaaugauaacuccaaauacuugagaaauucugccagcaugaaagcaaagcauucaacaaaucccuuuuccuaaaacaaaaagggacuuacuuucuuuccucggauuagugggauauuucugauuauggauagcaaauuuugccauuaucacuaaaccccuuuaugaacacacaaaaggcaaucuugaccaaccacucacucccacuccagcccuuuaucaugcuuucucucaccaaaaacgugccuuauuacaggccccugcucuaggccuuccaaacccccugagauccuuucgucuauauuuacacaguucucauaaucaggcccuuggacuauuagcccaacccaugggagacucccuccaacugguaacauauuuuucaaaacaacuagaccccauuuacaaagguuggccccuuugcuuaaaaauuuuggucacagccccucuaauuaucccugaggcacaaaaacucacauucuacaaaccccuucagguauuuucuuuucacagucugcaaaauauacucagccauaaggcgcuaagcuccaucucauccuccugcaugcaggccuuacauucaccucuccuucaacacucuaucucucuucauagaugcuccccccuuaauccugccacucuuuugccuucaggaccaauuuuagacacugaccaacacucaugcuugaauuuaauugaaaguucucucaccauguucuacccccuuacuuccacucacauaaagcaagccccagauugguuuauagauggcagugcaucagaaaacccuucccuccaagcaggguaugcuaucauugagggauaucaugaugauacccaccuagaagagucguagaggcugcccccuugccuuugggcauauccucccaacaagcagauuuauuugcccuaauaagagcacuaacccuagcaaaaaguacacaaguuaacauauacaccgauucuaaauaugccuauaacaccauccauuccaaugcccaaauuuggagcgagcggggcuaugucacggcuaagggauuuccuaucauuaauggaaaacucaucacuuacuaaaggcagcuuuacuuccagaaaagguugcaguuauccauugcaaaggacaucaaucagauaaaaaccacauuccaauaggaaaccgugaggcugaguauugggcaaaacaagccucaaccaaccauccaaucccccaauaccuauuaagccucauacaacauauccccuccuuuuauccagaacaccaaauacagcaacuaaucacagcgggggcacaagucaaacccccauacugcuuuguacaaaacaaauuagucccaucugacccugaagaaacugcucuuuuauaggacauucacaaccucuuccauacuagccauuccccuugacaacauuucuuaagcucccauauacacauaaccccagauauaaaggaacagcuaaaggccauuucccaucaauguucuacuugccaaaaggcuucacccuacuccaacacuaaaucccuuucuuucccaacccaucaagccaggggacaccuuccaggacaggacuggcaaauugauuuuacccauaugcccccaguuaaaaagguucgguuucuuccaguucucaucaauaccuuuucaggaugggucgaggcuuuucccacaaccaacaaaugggcuucuacugucaccuccaaauuaauaauggaaaucauacccagguucagggugccucuuucuuuucaauccgacaaugguccugaauucaucucucaaauuacucaacacuugcaccagcucuacauaucaccuggaagcuauauauccucuaucgaccucaaucuucaggaaagguuggaaaaaugaauggcauucuaaaaaccacccucaccagguacucacuccaaacucuuaaagacuggguuacacuuuugccuuuggcccuucuaaaaauuugggcauucccacauaaacccuuaaugcucagccccuuugaacucauguaugggaaaccacuggccccuuuuguuccaccucagggucaaacaccaccucuaccaacuccccuuguuuccccucuucuguauauuauccgccauuucauuugggaauaugcugacaaauaccugccacaacccaucacugacuccucuaaucccuuccuauagccagaagacuggguucucauaaaagaucccaguccuacccccaauuccccccucacaccuaaauggaagguguaaaaaguaaaguagagguuccucuucaaagacuuuccuccccaccuaauuaggaauaaauaguaacuucucuuagaagcaaaauuuauucaaagaccugugcuaacauccuuaaauaucggccagccguaauaaagaaaucaauguacuuuauguucuuagcuccuacaauuuagccuaaauauuugcccuggcaugcuuauacuaguccaagcaaacauuaggucauagccuguuccucuuccuuauuugaagguguuuuuaccuuucucagcauuccacaaguuacuuccuccuuccuuuguucuccucugucuuugccucuuuuaaaaaguucuaaguugcuagccaaucgggacaaauacagaaugugaggucccguuccagccaauggaaacuggacacagcaguaggguggaagcgucaguuuauaaaugacccugucuccuuuguucgguguacucucauggcaaaacugcuggcgagggugcucuuucugcagaaaguaaaaauggccuugcugaggaaauuaauuuuauguucaagugcuauuucuuuauggcaccagggaacaaacauuucuaacaaagggaccuuaccaaaucauucuuaccauacccacagcagcaaaacuccagggacuccccaacugguuucauuauacuucucucaagaaaacagacuucccuuugccacauacccaaacaaccaaauccaaaaccccuucagccuucucuugugucuccacaggacccacuucccuuugccucacccgaaucuuggaagaaaaggaagagaaauucaccuaaaccacuuaugucucuuucucucccaaacuuucacugcuuccuaaucaaccuuguuacaguccuucagcgguacccuuacgaaacucccauuauauauccugaucagcucuuuacuguucuaugggaccuauggcuucaaggaacuuuccaggacuuuacucuuacccaaauaaccuuuuucgcuuuuugcuuguuuuuuuuucaauacaaauacccuaaguacaucaaccucaccaauacaaccacuucucacugcucucaagcucgaacuauaaaccuuacacaaucccucuugcugcgaacuaacucuuccuuugcuccugaaugcuggaugugcuuaucgcugucuuccucagccuacacagcccuuccugcaucccuucaugaccuuuuagcagggagcauaacccuaauuuauacacuccaaaagggagcuuccuuucuugaaagagcugacacccuggucggcaauuauccuacuuccagggccaaucaggcuaacaaauuauuucaaaccuauuacaacucccugcaacgccucaagccucaagacucucccauuaaagggccuauaacuaaacacaccccccuuuuacaacaagcuucacuuugcuuuucagccucugaaggaaaucucccuguaggauccuuaacaccuaaccaacgcaaccguacuaucauuauuaaacaccccucugaccaucaaacuaaccgaguuaacuacccaguaucaccugaagcaaauggagcauuuccgcaacuggcucguuugacagccucucucucagccaaugccuauggccuaacuugugcugugccuggugcccaccuuuuuccauggcucaauaucaauggugcaacauccuauugcauuaaauguguaaaaaguaacucuuccuauauuucuacuauaguaggugucucccuggccuccuccuuguccauuuggaguaaugaaccacaggaaagaaaaaacaccccauguuuaguucaccuacugucuuuccauaucucugccuguauacacgacaaaggccuguucuuuuuguguggcaccaacacauaccuuugucucccuaccaacuggacuggaaccuguacccuaguuuaucuaucucccuccauuggacuuguuccuccugaucgaccuuugcccaucccacccauccaauauguuagaaaaggaagggccauccaugucauucccuuaauagccaccuuggguauaaccucuggacuuggauugagagcaagcagauuagccacuuccauaacauacuuuaaggcuguuucaacagaacuacagaacucauuagaagacacagccccaagccuuauaaaaguccaagaccuuggccaggcacgguggcucacgccuguaaucccagcacuuugggaggccgaggcaggagauagagaccauccuggcuaacacggugaaaucccaucucuacuaaaaauacaaaaaauuggcugggcgugguggugggcgccuguagucccagcuacuugggaggcugaggcaggagaauggcaugaacccgggaggaggagcuugcagugagccgagauugcgccacugcacucugcucugggagacagagcaagacuccgacucaaaaaaaauaaaaaaaaaaauuaagaauaaaggauugaucaggcuauuugaagagcaaccucaucauaucccacaauuccaaacuccuccccaaccagagacaugcuagccccaagauaaccccccucuggccaggaagauggcagccuugagauaacccgccuuggcuggaaagaugucugccccaagauaaccuccucuccucccagagacauuccaacccugccauaaaaccucucccucacacagaaacauuccaagcuugugauaagcccccucacccuaaaaccaauauauacucuuagucuguaagagaaagcacuccugaccaaaaaucggccagaagccccucucagguuuuaucugaaguaaaccugccuuuaacuguugagcugcauuuuguuucuuuccucuuucuuuaacucuuacaaguguuggcaaggauguggagaaaagggaacgcuuguauacuguugguacuauuauaaauuagcauggacauucugggcugggcauggugcuucacgccuguaaucccagcacuuugggaggccuagggugggcagaucgcuugagcucaggaguuuaaaaccagccugggcaacauggcaaaaccccaucucuaccaaaaauacaaaaaauuagccaggcaugguggugugcaccugugaucccagcuacuuggggggcugaggugggaggacugcuugagcucaggagccccaagcuucagugagccgagaucgugccacugcacuccagccugggugacagagggagacccugucucuaaauaaauaaauacauacauaaguauggccauucuggaaaacagugcagagguuccucaaaaaacuaaaaauaaaguuaccauaugauccagcaaucucacuucuggguacuuccaaaggaccugaaaucaguauauugaagagauaccugcacucccguguucacugcagcauuauucauaguagccaagaaaaggaaacaaccaaagucaccaucaacaggaugaauggauuuuuaaaaugugguauauacacacaaugaaaaauuauucagccguuaaaaggcaggaaauucugauuugcaacaugaaugaaccuaaaagacauuuugcuaggugaaauaaaccaggcacggagagacaaauacuccaugaucucgcuuauacauggaaucuagaaaagaaguagagaguagaacaguaguuaccagaggcuggggggauagggguagauggggaaaggagaaauguuagucaaugguacaaaguuucaguuaaacaggaggaauagguucuagugaucuacugcacaucauggugacuauuauuaauaauaaugaaucauauauuucaaaauagcuaaaagaaugaacuuuuuuuuuuuugagacagggucucccucugucacccagccuggagugcagugugccaugaucucagguuacugcagccuccgccuccuggguucauaggauucuccugccucugccucccgaguagcugggacuacagaugcguaccaccacacacaacuaauuuuuguauuuuuaguagagacagaguuucgccauguuggucaggcugaagaauggauuuuaaauuuuuucaccacaaagaaaugauaaguauuugaggugauggauauguuaauuagccugauuugaucauuucacaauguauacgugcauugaaacaucacauuguaccccacaaauauauacaauuauuguuggucaaaaauaaaacuggucaagugcaauggcucaugccuguaaucccagcacauuuggaagccaaggcagaaagaucguuugaguccaggaguucaagauuacggugaacuaugauggcgccacugcacuccagccuagaugacagagcgagacccugucucuaaaaaaacagaaauaaaacuguacuccauaaacauguauaauuaugugucaauuauaaauaaacccaaaaacuuuaaaaauaaaauaaaauaaugccaaaguaaaagguuuacuaaaaaaaugugaaaguucucagcacagagaugagauuuaaagccaagaaccuggauaagaucacccaaggaaggaguauuaaaaaaaaaaaaaaaaaaaaaaaaagacagcugggcaugguggcucaugccuguaaucccagcacuuugggaggccaaggcagguggaucacuugggcucaggaguucgagaccagccugggcaacauagccagaccugccucaaaaaaaaaaaaaaaaaaaaaagacauggcauuccaacauuaagaucaucuauagaauuccagcuaaugaauacacaaagaacggugaaacuagaaaaucacgacuuugcagccaggcuugguggcucacgccuguaaucccagcacuuggggaggccaaggcaggcagaucaccugaagucaagaguuggagaccagccuggcuaacaugacgaaaccccguuucuacuaaaaacacaaaaaauuagccgggugugguggcacccaccuguaaucccagcuacucaggaggcugaggcaggagaaucacuugaacccgggagguggagguugcagugagcugagaucgcgucauuguacuccagcuugggcaacaagagcgaaacuccgucucagaaaagaaaaucaccacuuuguaaucucuaauaacugauuugacacuuugggaggcugaggcagguggaucgcuugagacuaggaguucaagaccagccugggcaacauagggagaccccaucucuuuaaaaaaaaaaacugauuugagcaauaauuaucaaugguugaaagccugauggguugguggggaacuggauauucacagaauacuaagcuauccugaacguauuacuuccucaucauaagggggaaaugcaacuuugcaaaggaggaaucagauuguaaucacugaacccauugaucaaccuuucaauagcauuauugaaaguaggaaagucagauguuauauacuuccugauaugacacaauauagcuacacagccuucccuauaaaguauucaugccaaaaauauugaagcuuaaucuuaucaagccuuuaguuuaaauuauaggagacagaacaaacuaaugacacuacaaggaagacaucacacuaauucaaaucauugucauagaaauaaaaguggaggggaggggagaacuguucuagauuagaaguucaagaaacauaaaacccaaaugaaguuguagaccuucuuuggauccugauaaaccauucaaaaauuugaggcugggcaugguagcucacgccuguaaucacagcacuuugggaggccgaggcaggcgaaucacuggucaggaguucaggaccagccuggccaacauggugaaacccugucucuacuaaaaauacaaaaaauuagcugggcaugguggugggugccuguaaucccagcuacucgggaggcugaggcaggagaaucacuugaacccaggaggcgaaguuuacagugagccgagauugcgccaccacacuccagcccggaugacacugcaagacuccgucucaaaaaaaaaaaauuugaauauggacuauguauuagauaauaucaaugaauucauuuauuuuguuaggugugauauggcauggugguuuuguaagaauaugguuuuuuuuuugaccgggcaagggggcucaugccuguaaucccagcacuuugggaggcugaggcaggugaaucaccugaggccaggaguuugaggccagccuggccaacauggugaaaccccauacuaaaaauacaauaauuagccuggcgugguagcaggugccuguaaucccagcuacuugggaggcugaggcagagaaucacuugaaccugggaggcagagguugcagugagcugagauugcgccacugcacuccagccugggcaacagagcaagacuccgucucaaaaaaaaaaaagaauauguucuuuuuaaggaauauauacuuaaguauuucagcgugaaaugucauaucuggggauuuaaauuaucuuagaagauaugaggaggaauaucaacagaaucugaagcagcagucagugaaguaagaagaaaauccggagagcaagggcuccuuggaagacuaaugaaucauguguuucauggagaagugauuaacuucgucaaguacuacuggucgagguagaugaagauugagaauugacuguuggauuuaguuauaugaaugucauuggugacuuugauaaaagcaguuuguguaaagugauggggugaaaaccugauugggacgaguucaacagaaguuaggagaaaagaaauaggaaaugacaaguguagacaaugauaugacaccuggaauuuugcuguaaaggaaagagaagaaauggagcaauaacuggaaaugaaaauaggaucaagagaggauuuuuuuuuuuaacaaugaaagaauuggugggcugaaguccuuauaccagugagugacaagggaugagaucuuuugcacaaauggagggguugugccuuagcuagaagcauggagaguucauccauacuaacaggacagaaggcaaagaacacagagggaauaaugcugggaaguagguugauauggaagaagcuucuggaaacugucuucugauugcuucuaucaacccagugaaauuggaagcaagagagaugagggugagauguugagggucugaaaagcaagaaggcaugaaacaggcaucuaguacaauggaugagugaauacauuagagaaauguacuaugauugccaggcagcaugaagggccugcuugacaucgauauugauggauuucaaguaagaccagucacaugauuguuucuucaaccauguucaucugagagggccagaguuggauuuagcaaaauguauuaguuuccuauugcugccguuacaaaucaucacaaauguuaaaacaacacaaaguauuaucuuuuaucuuacagguuauaucuugcagguuauauagguuagaagucugacacaggucucacugggcuaaaauuaagguugcagcaaggcuguguuccuuucuggaggcucuagggggagaaugugcuucuugcuuuuccagcuuccagaggccauacacauuccuugguucauagccccuucccccaucuaccgagccagguaggauagguugaauccuucucacacugagucacuaugaccuccucuucugccucccucuuccacuuuuuuuuuuuuuuuuuuuuuuggagauggaguuucacuuuuguagccuaggcuggagugcaacggugcgaucucagcucacugcaaccuccaccuccuggguucaagcaauucuccugccucagccuccuggguagcugggauuacaggcguguaccaccacguccagcuuauuuuucuauuuuuguagaaacgguuucaucacguuggccaggcuggucucgaacuccugaccucaggugauccacccaccuuggccuccccaagugcugggauuacaggcgugagccaccacacccagccccucuuccacuuuuaagcacccugugauuacacugggcucacccagauauuccaauuucccuauuuuagggucagcugguuagugaccuuaauuccucucuaccauaugaggguaacauauucacaggguucagaaauuaguauguggauauccucgggaggccauuacucugcuuaccauacgaaggcuauggucuugccaagccaguauaauuaagugugaaagagaaaaaaaauaaguuaaaguuguauacaaggaagccuccacaauuauugacucugaacuucaaacuauguaaggagagaagugagaaccugaggggugugcaacagugaaaagauggaaucaaugaacuauaggucccaacaauaucaaacauuuguuggaauugguauucuagagggaguaagguagaagauggagaguagaaugcuugaacggugguguaauaauguaaguguaauaaaaagucugauucugcugggcaugguggcucacaccuguaaucccagugcuuuggcagccugaguugggaggaucacuugagucuaggaguucaagaccagccugggcaacacagugagacuucaucucuacaaaaaucuuuuuuuucuuuuuuuucugagacggagucuugcucuguugcccaggcuggagugcaguggcgccaucucagcucgcugcaaccuccgccuccuggguugaagcaauucugccucagccucccaaguagcugggauuacaggugcccgccaccauaucugacuaauuuuuguauuuuuaguagagacggggcuucaccauguuguccagacuggucuugaacuccugaccucgugaugcaccugccucgcccucccaaagugcugggauuacaggcaugagccacugcacccagccuacaaaaaucuuuuaaaaauuagccgggcuucauggcacacaccucugguauauguuuauauguacaguaaguccucaguuaacguggucaguagguucuuggcaacugcaacuuuaagcaaaaugacacacagcaggcccuugaaugacacugguucauucaauaucauuuugcugcaacacugaugagaaaaaaauugguuuugcuacgucauuucacuuaaagucaguuuccaagaaccuauggacaauguuaagugaggacuuacuguauacacacgcacacacaucuuugcucacucauguaaguguaucuguagaagaaaauacuacaagucuuagcuucaaaaguaaaacuauguaucuuaacuuuugaauugacucauauagcucaucacacaccagccugagagaauauaaauaaaugcuuacucacacuauugacuuuauuaaaaucuggcaugguuuucuugaauggcaauuuuaaauacacauucccuaagacccagcaaucggaauuccaaaguguacacucaguuacgaagugcacaaaaauucacacaaaggcugccuauuacaacaaaaguauaauggcaaacaauuggaaaaaucuaaaugaaaggccuggcaugguggcccacgucuguaaucucaacacuuugggaggccgaggcaggaggauugcuugaacucaggaguuugagaccagccugggcaacauggcgagacccugucucuacuaaaaacacaaaaaaaauacuuugggaggccgaggcgggcggaucacgaggucaggagauugagaccaucccggcuaacacggugaaaccccgucucuaccaaaaauacaaaaaauuagccggguguguuagcgggcgccuguagucccagcuacucgggaggcugaggcaggagaauggcgugaacccggaaggcggagcuugcugugagcccagaccgcgccacugcacuccagccugggugacagagcgagacuguaucaaaaaaagaaaaaaaaaaaauagcugggugugguggugugcgccuguggucccagcuacuccggaaacaggugggaggaucgcaugagccccgggggauggaaguugcagugagcugaguuagagaucgcgccacugcacuccagccugggugacagagccagacccugucucuaaaaauauauauaaaacaacaauaguaaaauaauaaauuggcuggacaugguggcacccaccuuaagucccagcuacuagggaggcuggggcaggaggacugcuugagcccaggaguucgaggcugcagugaacuaugaucaggccacugaauuccagucugggcgacacagcaagacccugucucaaaaaaaauuaaagcaguaaaauucacagagacagaauaaugguugcuaggggcugaagggagggggaaauggggaguuuguuuaaugggaguaguuucaguuuugccacaugagaaaaguucuggagaugacggacggcugcacaacaauaugaauguagucaacacuacugaacuguacauuuaaaaaugguuaggaugauaaacuuuauuuuucauaaaacccaguuucugcacaaaaagauaaaauuuauguuauguguacuuuaccacaauuuaagaaaaaauuuaaauucucaucccaacauuaccacgccccccacccuuagccaacuggugaauguuuacucauuuuucaacgccuagcucaaaugucuccucuugccacgccaucccuuagcugaccacccuuguaguuggccauucccucuuuuaugccaacacugugcccugcacguacauuauaccucuuacagcacuuaucaaaccuaguaauuauugcuuuacagauccguuuccacuacuagauuacaaacaauuugggggcggggaccuuguuuuacucaucucuguauccccuagacuuagggcuugauaagcugaaaagaaucaagaagggcuugauuaauuaaggcuccucuggcuuuuaaggagaccauacuggagggucauuugcccaaaagaagaggcaucggggucuccucagguuuuagaaaucuggucaaacauccagagcugacucccacacccuacugcgagaagagcgcgagcgcgcgucucaaaaggcuccgccucaacaguucggguccccaggaggauccgggggccaccccaccuccacccugggccaggucgguuagcuagacccgcccagcgguccagacauaccuuagguaaugagcagccugcucugggcucaaggccucggcuuccggaaaccuucgggaugccuccaugacccucggauuggguuccaguuaccccggcgggaguuuggagcuuggagcuuggagcuuggagcuuggagcuuagaguuuggagcuugaauuucgcucacucccgccccgcgcaugcucugugcgccguggagagggacacagccaaccgacggccucgcggccggccaauccgcgaccacgcgcugcgacgccuccgccugagccccgcccaugacggugggcgccugcgccuacgcgcgccgggaagcagaaggugaucucugccuucgagacacggagugugcugccucagucugugaucccucgcguuucaauccaauucaaaccaugcugcagccaauucguucgcgcgugcgugugccaucauugugaguggaggagacugcccgauaugaucccagucauugcggcgaccccuggagaucuccaacgccugcgucccccaaccauacccugccccgcauccacagauaucuucccuuccuugaucgccaguaccuggcacugaccgugcuuugaauucaaacacccugggaggcauagucccugugauuuaaacuaacauugaagaagcgaccagacgcggugguucacgccuguaaucccagcacuuugggagaccggggcgggcggaucacgugaggucaggaguucgagaccaaccuggcuaaaauggugacaccccgucucuacuaaaaauacaaaaaauuagccgggcgugguggcgggcgcccgcagucccagcuacucggguggcugaggcacgagaaucgcuuggacccaggagguggagguugcagugagccgggauugcaccacugcacuccagccuggguggcaaagcgagacuccaucucaaaaaaaaaaaaaaaaaaaaaaaaggcugggugcagugccucacgccuguuauccuagccuuuugggaggcuaaggugggaggaucacuugcacuuaggaguucgagaccagccugggcaacauggugagacucccgucucuuuaaaaaaaauuuuuuucuucuccacagggcguuaugcuguauuuauuuucuuaaaaagagagagagaaagagagaagggucuucaagaaucucaaacccuggagguggaggcugcagugagccaagaucaugccacugcacuccagccugggugacagagaaagacuccaucucaaaaaaaaaaaaaaaauuaaaguucuuauuuaagaaauaaguaacuagguucacauacuugguauaauaaaaggaagacaaaaauaauuuaaaaaaaaagaaguagugcuguggucaucauuucuucagaagcaccaacuaagauacagucauuuucaaaugcagagccuaaaaagaaggcagagccuagagcuuaaggaaaugugauugaguuuaaguggcuugcuugggugacacuaaauaggagguugugggccaacaaaaauuguccuuguucauauacuguuaagaacacagacaugacuccucaagacacuaauuuagcauucaguauuggaaaacucaccuauuggcccagucauacaucauauguccagagaauuuuaagcuuuucauaaaauuuauagaccguuaugaguuaaaaggaauguuggaggccggguucaguggcucacugaaccuguaaucccagcacuuugggaggccgaggcgggcggaucaccugaggucaggaguucaagaccagccuggccaaauggugaaacccccgucucuacaaaaauuagcugggcaugguggcgggugccuguaaucccagcuucucgggaggcugggguggaagaaucgcuugaacccaggaggcagacguugcagugagcugagaucgugccauugcacuccagccugggcgacagagcaagacuccaucucaaaaaaaagaaaaggguuggggggaggugggggaucuuggagaacaugggcuauuuuccugguuuguaugacuuuaaggccuuuauuaagaggccuuuuaguauacuauuauccacauuuuucagauguggaaacaggcucagagagauaaauugacuucaucuaagcuuccugagcuaggaagcagcagagccagaauucaauacuagguccauauggacacaaaucugugccguuucgcugugucacacuggaaagaagagggcaguggcgggaaaugagguugaugaggcaguugaaggccagguuaugaaggaacuuguuuacucugcuaaaguguuugaaucacaucuuuuccuggaggcaagcuuggauugggcugugcuauggucugaauguccuucaaaauucuuguguugaaacuuaauccccaccaugguggcauugagaggcggggccuuuuagcaaguaaugucaugagggauccuacuucaugaauaaauuagugccuuaugaaagggcuggagggagcuaguuuaggcccuuuuugcucuucugcuuuccuaccauguaaggacacacuauuccuuccccuccagaggaugcagcaacaaggcaccaucuuggaagcagagagcagcccucaccagauaccaauccugcuggcaccuucaucuuggacucuucagccuccagaaccauaauaaauacauuucuauuguuuauaaauuaugaguuugauggccaggugaggaggcucacgccuguaaucccgcccuuugggaggcugaggcgggcagaucaucugaggucgggaguucgagaccagccugacggagaaacccugucucuacuaaaaaugcaaaauuagccgggcaugguggcacaugccuguaaucccagcuacuugggaggcugaggcaggagaaucacuugaaccugggaggcggagguuguggugagccaagaucacgccauuggcacuccagccugggcaacaagagcgaaacuccgucucaaaaaaaaaaaauaugaguuugagucuauggcauuuuauuauagcagcacaaaggagcuaaggaugaguugagaguccaggcgcccuggauacccaaaggaugaguaggaugagaagagcagaauaggggagaagauguaggagagaauucugcagaaaggaaaagagagaugagagcacaaaaaucuucaucuugagucuggggaaggccaugucugguugugcuuuggcucaggguccaccaucaucgcucauauccggggaauuguugagaacugaagaugaagcaaagcaggccccuggugguuguuguaggcaugccccauugugggcugugaagaaaagcuaaagagaacucccucaggaaccccggcuaccuccucucugcuucccagcuggcagugaugccuaaaggcccugaucaccgggaaggaaggaccaacacucggcuugccugcccuuuggcuauuggauuuucuaagccccauuuucacacagcuguagggcuccuccuuuaaacuccccagcucuggcugcuccuccccuccccuucgguccuguagucugcuucccuugggcccuucuuggugccuucuggagucccaggucucaacccagggcucugaugacccaggaaacuccccagcccaggcuccuaguccuccuuuauaaauggucacccaggcucacagccugaaaauaagagagagauugggaggauuuugaguggguaaauggagagaaucaaagagagucaaaauaauaguuacuacuauaucccucuuaugugacaggccccauucaaaacacuuuacaucgauuaauuaucugcuguuccucauuaugcaucuaccccaaucaagggcucccauucccccagcgucucucaagggaaugggguuuauaaagcucucccagcugggcucaguggcucacgccuguaaucccagcacuuggggaggccgaggcgggcggaucacaaggucaggaguucgagaccagccugaccaacauggugaaaccccguuucuacuaaaaauacaaaaauuagcgggugugauggcacguaccuguaaucccagcuacuugggaggcugaggcaggagaauugcuugaacccaggaggcggagguugcagugagccaagaucucacuacugcacuccagucugggcgacagagggugacuccaucucaaaaagaaaagaaaagaaaaggaaaaagcucuuccuaggcugggugcgguggcuuacaucuguaaugccagcacuuugggaggucgagguggguggaguucaagaccagccuggccaacauggugaaaccccaucucuacuaaaauacaaaaauuagccggccaugaugguaggugccuguaaucucagcuacucgagaggcugaggcaggagaauggcuugaagccaggaggcggagguugcagugagccaagaucaugccauugcacuccagccucuacaagagcaaaauucugucucagaaaaaaauaaacaaaaaaagcucucccuaauuauuguuaauuuuaaaagggugauaaugguauugcuguuuuuuuuuuuaagguccucaucuguuagaaauacaaguuggaguauuuucagacaaaaugauaugacaucugggacuuacauuaaaauacuccaguacagagggaaaaaaaaggagaguacagaugaacaaagauuggcaaaauguugauaauuguugaagcuuguuacagagguucauuauccucuucucugcuucuguguaugauugaacauuuccauaauaagaauuuuaaaaaacaaaacuuuucaaccuaaucuucaaauuacacugagucauccgcacucacaggccggaaauaugauaaugaggcuuugugggaggguucagaaugcauaaauggagagauggaugaggccgaauaagaacaauagcuauuacuuagauagcacugaagugccaggccuuguucuaaggacuuuacaugcacugucuuuuaauccuuaacaacaaccuuguuagaugguguauacuauuaucauccuccuuuuacagaugaggaaacugaggcacagaaagauugaauaacuuacacaaguuuacacagcuugugaauggugaagcagaauuccaaacccaggcagucuggcuuucgacuuuuugcucuuuaacaugaugcuaguuagauauagaaagcagcugacaggugaagaaaaggauuaauucauccauuuacuuauucauuuauuuaguaaauauguguugagccuuuacaagauggucacguaaggauccaggugcuggggguagaguggugagaaaaacagacaaguccuugcuaucaaagagcuuaaaguuccauggugaagauggacuugaaacaauaaucacacaaacacuuggaaaauuacagacaugaagaggucucagaaggaaaacuacaggcaauuaugacagcauaccaugagguaucugacccaaucuggagggcuggaaaagguuucucugaggaaguagcauuugaucuaagagcugaaggguagggaggaguuaaccaaacaaaaagggaagggaagggcauuucaggcagagggaauagcaugaucaaaggcccugaggcaggagagggcuugauguguaugaaaacuaaacaggcuaagaugguuggagcaagccuagaaugcugaguugaaacgguuuuuuggacuccagucuaaugccacagguaagggaacugccaaugggaaagaaggaagugaccaguccaaggucagacccugaaccugugacagaaacaguacucaaaccuagguaccuucaaucccaacccagcguuuuuuccagcacacaucauggcuucccugcauaugaggagggagugccagcaaaauguugcucuuggggacugagaauggaagaguguuuuugauaaccaaaugaaguauucaugcacaaggagaucaaaaguggguuuggggccaagugugguggcucacaccuguaaugccagcacuuugggaggccgaggugggaggaucacuugagcccaggaguuugagaccagccugggcaacaugauucaucagacaaaaaacacaaaaauuagcugugugugguggugugugcuguaguccuagcuacuugggaggcugagaugggagaaucuuuugagcccaggaguucgaggcugcaguaagcagagucacaccacuguacuccagcccgagugacagagugagauccugucaaaaaaaaaaaaaaaaaaaaaaaaaaaaaaaggagccgagaguggguuuggggcaggaaaaaagaugaaauugauuagaaacaguaauaauguauuuaugagacagggucucacucuguugcccaggcuggagugcaguggugugaucucggcucacuguaaccucagacuccugagcucaagugauccuccaggcuccagcgauucuccaaccucagccucuuuagcagcuaggacuacagacaugugccaccacauccaccuaauuuuuuuaauacuuuguagagacagagucuugcuauguugcccaggcuguucuccagcuccugggcucaagcgauccucccgccucagccucucaaagugcuaggauuacaggugugagccaccaagcucugccaacaguaagaauuuguguuucccagauaccuaauuaggcuucucccaccccauuucuagcuaggguucuuauaaaguaggugggauuuggggguaggggauagaagauugagacugaggguuuaaucucccaggggaagcaggaaggaggaggaaagccaugggauggaggcugccccagccaacagucaucuccagcucugccagcagagggagccagaaacugaauuuccuaagaauggcagcuggccuggccccugggauggauaaacccuucuuggaaacuaaucaagucagcccaggaugcuguggaaaugacagggacugggaggaagggagggagccaagaguuaggauuaccugcagggucuuugcccuaaguuucacagucuuugaugaaagccuucuaaaccugccuuucgggguuugggugaagugggcaccaaaggauagagaaaccuuugacaaggcagucccacugcacaaaacauggcauccuccacucccuuuggguuaccucaguggcucucaaggccucacaauucugucucuagccucaucgucucuccugagauuuggaccuagauggcaaaauggcuauaggacaugucaccccggaagcucaaacucaacauggcaccgaacucacccucucuccccuagaccugcucucucaauauuucccaucuccaugaauggcacuaccaacccccaaagugguccaagucagaaaccgggaagugucuuugaggccugccucauauuugccccucaaguucaauucaucagugagucguguuggcucuaccucuaaaauacaucccaaauccaaucacuucucuccaucuccacugccaccacgguagucuaugccaccauucugucucacuuggacgacugcacuagccuccuggcuugucuuccugcuucuauuugugccuuucccccacuaucugaucucuacccaaaaaccagaaucaucuuucaaaaauaccaaacugaucaugccauggcccugucuaaauccuucaaagcccccucguuucccucaagaucaaguccugccuccuuaccauggcuuacaaggccuuccugaucuggccucugacuaccucucuggccacgucuuacuucuucacaaccccuacacauacaugcacacgaucucuucucaaacugaacaacuuccagcuauucagaucuugccuccaggccuccccacaugcaguuuccucugccuggacucacccuuuucaccucacuauugucuauucacuccucuugucucagugcaggucucccugcuuccaggaaccuucccugauccuucucaacaagucauccucugugaucccacauccugccuuuaucauuggguuuauuccauggaauguagcugccugguuaccugucuggcucccccgugaucaugugagcucugugaagaacauuucugucuuuuucacaguuauacccucgcagagcucagaauggucccuacacauaauggcugaccaguaaauaguuguuggauggauggauggauggauggaugaucugucaauuaguaauccuaaaggagagcacugugugcucuguuagagaacuagaaugaggccuugggugggaaugauauauccaaagacauaaugaggaccagaaaucagggaaguggggagggccaagcauacccaucccagccacuucucuugccaauacuaccccugucucccuuuuauaccugccuccagauggaccuggaaguaacacagaggauucugaguuacacccaggaacuagacagcccucuucuagucccuucccagaucuugugcuaggacaaagccacccaugcuuggcugugagaugaacaggcuccagccagagcccagugucgcuggacucuccagaugcccuguacccacuuguuccccaagucaaggacauuucugggagcuccccaugagcucuccuguagcuuccuuauccuccuucugcagcagcagagaaacccucccuacauagcaugggugccucucacaaaaccuggggucaaggcuucucccuggugccagcccaagaagggacuccaagugggcaucuaauccaaauaggcguggccuuuuucccuuccucuuuggcacuaaaagagacagguaguaaaaacuacaagcucuugagggcaacaggagggaagugggggcaaaggugaaguuuuucuacagcccuucaaaggucuuggccccuugcccagauccaagucaagaacuguuuguuucagagaacuggcuucccagccaucugcucagagcuuaaagagccuaggggcccucaugggauguucuguucaaauuagccaaaaaaggcagggugaagacaacacagcaggaggggccuugaccagucugggccucugaagguguggaaggaaggggcagguauauggcacuagggcacauugaggguauggcaagucccagaacagagagcucuucucacagcccaguuccacugaucuuagaaccaugucuuccauccuuugugagcagcuaauuuaugccaggaacuuuccccacaacaaacaagauguucucuuguaccaguugaaggaaccaaggauuagagagguuaauugccuugcacgaggucaugcagcaaguacacagcagguucaaugaguguccucuggugauugguugccaaggcugcuagaaaaugauucuucccuucagugagcagauaggcagccugaggauaauagccaggaggggauacagaaagucacacuccuuuugcgccuaggacauagcuugcuccauccagaaaaaaaaaaaaaaaaaaaaaaaaaaaaaaaaaaaaaaaaaaaaauguccuuauuccuuugacacacacugucucuggguuguagaaaugggucaggcacuaaggucagguuuuacauguggaaaaucuuagggugaagacaggaaaagacuuucucacagucagaguguaagagaacaguucagaugaauggagcuguccaagaagccaggcagauaugcaggagaaagacugacaaggaaacccucucuccuaaaaucccccacagccaugaacauucacaugaauugaaaaaccaauccucagccaggugcaguggcucaugccuguaaucccaucacuuugggaggccaaggcgguggaucaccugaggucaggaguucaagaccagccaggccaacauagugaaacccugucucuacuaaaaauacaaaaauuagccaggcgugguggugcacaccugugauuccagcuacuccagaggcugagucaggagaaucucuugaacccaggaggcagagguugcagugaacugagauugcgccacugcacuccagccugggugacagagcaagacuccaucucaaaaaaagaaaagaaaaagaaaaaaaaaaaccaauccucaggcaaaauugcuaggggguaaguuugaggacuugcaaaaguagggggccuuuggggccaaucuuuaguucaccagggguucucaagucugcauucaugugagacucacuggggauaucuuaaauaauaauuauguuugcgauauauuuaucugacaaaagacugauacccagaauauauaaagagcuccuacaaaucaauaauaaaaugaccacccaaaaauaugagcaaaagaguggaacagacaccucaugagacaggauauaugaauggucaguaagcacaugaaaagaugaucaacauaauuuuccauuagggaaaugcaauuuaaaacuaaaaggacaugccucuacauacccaugagaauggcuauaauuuaaaagacagacaauaccaaguguuagcaaagauauggaacaacuguaagucucaucuuuugcugguggggguguaaauugguacaaccacuuuggaaaccagcaguuucaaauaaaguuaaacccaggaauuccacuccaagagaaaugaguauaugugcucacagagagacuuguacaagaauguugauagcagcuuuguuucuaauagccaaaaacugggaccaaugcaaaugucccuggaugccugaauggauaaacuuugguguauccauacaagggaauaccacucagccacaaaaagaaaugaacuacugauccucagggcaguaggaugaaccucaagggcauuauacuaagagaaauaaggcaaucucagaauguuacauacugcuugauuccauuucuaugaaguucaagaacaaucaaaaugaaucuaugauagaaaucagaacagugucugccucuggcaggggugaagggcagugacuggagaaauggaaauguucuauguuuuaauggggcagugguuacacaagcacccacaauaucacaauucacugaacuauacauuuaaggccuaugcauuuuacuguggguaaauuaugccuaaauuuuaagacucaugcccaggccucaccccuaauuaaaucaaaguaucuaaagguggggccugggcaagggcauuuucaaaaucuccucaggugaugcuaaugugcagccgggggugagaaccgcugauaacauuaccaccaccuuucccuggcaacagucccucucagccuccuguguucuggagacuuuucagagaugcccaucagaaaaagucucucccacuaucacaagcagagguaggcaaguggggauagaaggcgagugaggguaagugcauaccaauauaucucaaagguuguuucauaucaaaacauaaaggcacugaauuuuacacuuuaaaauaguuaaaauggucaauuuuauguuauguaaauuucaucucaauuuuucaaguuaaaaaaaaaaucagccgggcauggugguacgugccuauagucccagcuacucagguggcuaaggugagagaaucacuugaucccaggaguucaagaccagccugggcaacacagugagacccuaucucaaaaaacaaaaaaaugaccaagaacuuccuuagauuugauggcugcacauauuccauuguaaagguguacuuuauuuaaucaguccucuauugaaggauauuuuucccaaucuuuugcuguuaaaaacauagugagagcuaggcaugguagcucacaccuguaauccuagcacuuugggaggcagaggugggaggauugcuugagcucuagaguuugagaccacacugggcaacauaaugagacccgucucuacgaaaaauaaaaauaaauaaaaacauagugacaauaaauauucugguauaugguuuuuuuuuuuuuuuuuuuuugagagggagucucacucugucacccaggcuggagugcagugccgcaaucucggcucacugcaaccuccaccuccaggguucaagcaauucuccugccucagccucccaaguagcuggaauuacaggugcccaccaccacgccuggcuaauuuuuguauuuuuaguagauauggggguuuugucauguugccaggcuggucuugaacuccugaccacaggugauccucccaccuccaucucccaaagugcugggauuacaggcaugagccaccacgcccggccugguacaugcauuuuuuuaaaaaauaugugugagugggccgggugcgguggcucacgccuguaaucccagcacuuugggaggcagaggcgggcggaucacaaggucaggagaucgagaccauccuggcuaacacagugaaaccccgucucuacuaaaaauacaaaaaaaaaaaauuacccgggcgugguggcgggcgccuguagucccagcuacucgggaggcugaggcaggagaauggccugaacucgggagguggagcuugcagugagccaagauugugccacugcacuccagccugggcgacacagcgagacucugucucaaaaaaaaaaaaauaugugugaguguaucuguagaauaauuuccuaaaauuggaauuguugggucaaaguguauaugucuuucuuauuuugcuagaaacugccaaauugcccuacauaagggauaaaugaauuuacauucccauaaacaauauaugaaaguguguguuuuccccaccuuugcuaacaguguuuuccaaccuuuugaucuucaccccucugauuauuaaaaagugguaccuuguaguuuuauuuugcauuuucccugagaguaagucuuaacugacucagauaaagacguucaaguggaggagagggguguuuuuuucgagguagggaagaaggcagcuguuuuaguucuggcugcuauaacagaauaccauagacugagugguuuaaacaacaaacauggcugggugcaggaagcucaugccuguaaucucagcacuuugggaggcugaagugggaggcugaaguggacucacuugaguccgggaguucggggcugcaaugagcuaugauugcaccaauguacuccagccugggugacagugugagacccugucucuaaaaaaaaccaaaaaauuaaaaauaaaauaaaaaaaacaaacgaacauuuauuucucaguucuggaggcugggaaauccaggaucaaggugcaggcaaauucagugucuggugaggcccucuuccugguuugcagacauucaccuucuuguuguacucucacuugagggagaacagagagaaaaaggaaacaagcucuuggagucuuuucuuuuuaauaaaaaaaauuuuuuuuugagagacagggucuugcucugucacccaggcuggaauacaguggcacaaucacgguucacuguagccucaaccuccuggucuccaagccuagcuauuuuuauuuuuuauuuuuucguagagguggguucuugccaucuugcucaggcuggucuugaacuccuggccucaaaugauccucucauaggcaugagccacuuagugccuggccuccaggucuuuucuuuucuuuuuuuuuugagacagagucucgcucugucacccaggcugaagugcaguugugcaaucucagcucacugcaaccccugccuccuggguugaagcaauucuccugccucagccucagccucccaaguaacugggauuacaggcacgcgccaccacacucaguuaauuuuuguauuuuuaguagagacaggguuucaccauguuggccaggcuggucucgaacuccuggccucaagugaucugcccgccuuggccucccaaagugcugggauuacaggcgugagccaccgcgcccggucccuccaggucuuuucuuauaagacauuaauccuauucaugagggcuucaccuucaugaccuaaucaccuaucaaaggccccaccuccuaauaccaucccguuuuggguuagaauuucaacauacgccuuuagcagggacacaacgcaugguucauaacagcagguaucuuaccauguuucuguuauaguuguguuagcuuugagcaagucaccaagaauccaagggcucuuaacugaauauuaaggacacccaaaugucuuucuuagguccaaaccucucacuggagucccagacuccuauaucaagucccccucgacaucugacauuucacucugaaaacguccaaaagagaauuauugguucccaacccacccucaaacuugaccugcccugguuuuccccagcucuacaaacggcaccacucaguugcucaaaccaaaaaccuugaaauuagaaacaucaucucuuucccucauccaguucaucaccaagcccuguuggcugucuccaaaauacauccugaaucucuccaccuauccccacuccacugcaacuacccaagccuaagccaccuggaauuuaccaaugguuuccuaacuagucucccuauucccauuccuguuccccagucaaucuuucuuauuagaaaaucaggccgggcacgguggcucacgccuguaaucccagcacuuugggaggcugaggcagcuggauugccugaggucaggaguucgagaccagccugaccaauacggugaaaccccauuucuacuaaaaauacaaaaauuagccaggcgugguggugugcgccuguagucccagcuacugggaggcugaggcaggagaacugcuugaacccgggaggcggagauugcagugagccgagaucacaccacugcacuccagccugggcgacagagcaacacuccaucucaaaaaaagaaaaagaaaaaagaaaaucaacgcggggcgugguggcucauacuguaaucccagcacuuuggcaagcugaagugggaggaucacuugagcccuggaguucaagaccagccugggugacauagugagacaccaucucuacaaaaaaaaaaacaaaagaaaacaaaacaaaacaaaaaacaacuagcuuggcauggugcugcaugccuguaguccuagguagaugggaggcugaggugggaagaucacuugagcuuggaagguugagacuucaaugagucaugaucaugccacugcacuccagccugagcaacagagugaaacccugucuuaaaaaaagaaaaaaaauaaaagaaaaagaaaagaaaagaaaagaaaauccauuccucaaacaguacccaauaauccuuucaagaaacacauaaagcagaucaggucacuccuuugcuuaagaccuuucauugaguucacaacacacuggaaauacuaucgaaacuccucacugaagccuacaggucccugugugauuuccaaaucucacccuuuuucuucaggcacauuggccuucuuucuguucuuugaacaaccaugcccauuuccaccaccaggucuuugcuuuugcuguccccuuggccaguaacacuuuccccuaaaaucugagcauggcuggcuccuucuuaucauucagaaaucagccaucucuccugagaccuucccugacccaccuucuuuaaaguagcuacccccaccacucuaauccuauuuauauauuucagagcccauaccacgauuuaaaaguaucuguuucccuguuuacuuccauguuguuuguuucuccuguagauaucagcuccaugucuguauuuucaaaagccgcaaucguccuagcacauaguaggugcugaaaaaauauuuggaauuaaugaauaguuuaacaguacuuucuuguuuucaaagccuucaccugguaaggaucucagauuuggggagaggaaggguuguuuuucaagucccugaaggaaacaaagcugauuuuaaaaacuugagaucugugucuauccaaauaauuagcaaaaagucugaucuauucgugaacuaagcucuccuugaccugcugagcugccuuugaaauauccugugucauugcaggcaauaaaacagccuuucuuugucaauauucucugcuucaaauuucucacuaauuccagcuggccucaucccagccaaucugaaugacugaaaggcagagugaauauaauuuaaucagcggcucugccccugcaggaugagcuugaggugucucugugggccucaucuccaaaaggugucccaggggcugugauuuugcacggaauaaaggagggccagcaggaaccccgcucuggcgggggauucaggcaggcaccggcucagggcggggguccggggaggugggaggagucgggguggcggcgaggcgggugggggcagagccgcagaaaggcagggagaaggggaaaagaagacaauaccgggaaaaagaauagucgugguaauaauaguccauuggcggaucgcuugagcccaggaggucgaggcugcagugagccaugaucacgccacugaacuccagccugggcgacagagcaagaccccaucucuaaaaauaauaauaauaauaauaauaauaauaauaguaauaauaauaaucauuguaaugccagcuggccgccguuuuaguuuacaaacucuucaagccauuaucucguuuaugccugucaacagcuugcuugcagguucucauccccgugucaccgacagggaaaucaaggcucagacagguggcggcugagaaggcugcggccucccugccgcguggugcccucggccuuuccugccgccuucccgccccucuucccgcccacggcgcaccgcucccccaccugaucuccugccaucagugagcccggcggcgcccggccguugcuauggcauuucuggagugucagaagugcccaggaagcauacaaaucgaccugcgugagacagcucugugcaaaacaacuuccaauuuacucgcaauaauuaccacccccagauaauagccuguacucaggcgggcgagcagggggcggaugggggaagggagagaggacucugagaggcagggaaggaggccgggcacaacagacaaacagccacggcaaggcugggguuucagggagaggugggggaaagcagagagguggugcuccugaauuagggacugaagaaggcucaguccuccuaauuugguucuggaaacuccaacguucuucuggacggaucauaugaaggcauuucauucgauauuuacugggcaccuuuggaggugggcacuuugccgggcaccgggaaugcaaaggcgaagacuccaaguucuuguagugaaguggcucacagacuccugggagagucaaacauaaagggccaugauucauucaagcaauacuuacuaagcaccuacuauaugucagguauuguguugaggaaaaaccggagagcaaaacacacaaaaauccuugcccucaugaaguuuaacuuagaguaggggcagacaacacauuuuuaaaaaauagccaaaguacuguuaguugguguguuccagagaaaucaaaccaacaggaucucuagauuuauacacauaugugacauacauguauauauuuacuauaaggaauuggcucacaugauuaugcaggcugagaacaaguucugcaguuggcaagcuggagacccaggagagccaagguauagcuccaauuugaagauggaugucccagcucaaagucggcagagaaaaagaauucuuccuuacucagccuuuuauuguauucaggccuucaaugaauuggaugaagccugagggcacccugcuuuacucaguuuaccaauucaaaugugaaucucaaccagaaacacucucacgacccacccagaaaucauguugaaucaaauaucugaauaccccacagucuagucaaguugacacauaaaauuaaccaucacagucaaaagggagaaaaaaaacaaaacaggagagcaggaauagcaaguguugguggaguagguguugcagauugaaacaggaugauggggagaguuucacugagaacguauguuuugaaugaagaccugaaacaagucgggcagcaagccaugcagacuuccaagaauguuccaggcaaaagaaacaguagguacaaaggcccucaggcucuggcauguuggaggaauagcaacuaguccaggguagcuggaacagagcaagggagagaauaggaaagagcugggaacagaucaucuaggcuauauaggcugacauuaaggacuuagacuacaaaugaaacaagagucacugaaggacuuugagguagaaaagugacaugauagcuggguguuguggcucacgccuguaaucccagcacuuugggaggccgagguggguggaucacgaggucaggagaucgagaccauccuggcuaacacggugaaaccccgucucuacuaaaaauacaaaaaaauuagccgggcgugguggcaugugccuguaaucccagcuacucuggaggcugaggcaggagaaugguuugaauccaggaagcggagguugcagugagccgagaucgugccacuguacuccagccugagugacagagcgagauucugucucgaaaaaagaaaagaaaagaaaagaaaagugacgugauuugacuuguguuguaacagaaucccucuggcuucuguguggugaauagacuguguggggccggggggagggcgugaugggcaggggcaaagucauuaggagcacugcuaggagcaaaggagcaguagaguaccauugcuguaacccagaugaaagcugauuggaacuuagaccaggguggcagcuagggagaugaugauaagugguggauucuggauauauuuugaagguggagccaagaguauuugcugauggauuggacauggggugggaagaaaaacaaaaggaguugaagaugaucaaggaggaaggugucuuggggcaggcaguguggugugaaacagagaguucaaguucauagggacucgggaguuaaguugggcuauaccccugcccuucuuagcuguaugaccuugggcaaguugcuuuccauuucugaaccugagauuccucuucuguaggaguacacagggcuguugugaagauuuaaugaggugauuauguaaaaccccaguuccacggcuggcacagacuaggugcuuccugagcacuugcugcucccuugaccuuccuuuucugaggaagcuggaaaagccucguagcagagcugagguuggaggcagcugggaaggaugaguggggcucuguuaggcagaaaagaggugcauggggcucauccuucacaacaggcaggaggaaaugaagccaauggccaggcaggccuucguggaagucucggguuggggaaagcugcaggaggacaggguguggagacuguggacugugugauggaaaggaaguccugugcaaggaaaggaaccccaacagagaggcgugaggagaugagagguccaccuccugccuccccagcucugccuuggaucggcccuggcccagaggaccuuugaaaccuucugaguuaccggaugaagcaggucauaacuauggcacacaaaauucccagcaugccgaggaguuacugagguuuguguuugugugaaucacacagcaaacaucugucuuggccacuggccagaacagggcuccccccacagccacacgcacacugauugcaaacauauggcccccaaggaagagacucuccaaaaggccucgugaaccaucuuugcauucuggccugaaucgccccagcccuuacucccuuacuccuuguacaaaagcaugaauccccuuuauaugggacuguuagacccacacugaggaaacccuacccccaccuccagaaccacaaacacuaacuccucaccucaugaggggcucugacaucagaaugccuggguucccauccagcccaucccuauuaauugugugaacuuggaccagguucuugaccucucugagccucauuuuccaccucugcgaagaaggauguaaaugauaccuccaucacaggcuugaugcaaggcucaaaugggauuaucugagaguaagacucaggggcucuaaaaaauuuggguuuuaccuuguccccugcacccccuacucaauacucccacuaccauuacgugauucaaaauaaaaauuauaccaaacuguaaagaggguaagaaaugcucuauaaguucccgccagaaaauaaaaaaaauuuuuuuacaaaaggguaagaaagucuaaccaaggucugcuuuuuccugugaugacuacuuugauggaguuauuugaaaucucaauuaucauauuauuuuccaaaacacuuuuguugucaucccugcuuuaugaaugcccuaagcauuuuuagugagcaguuaggccccagagaauauggacuuggaaacuguaacuggaaacaacacauucuuguuggccaggaucagcuaacacucaauagaguuuacuacuuuuuuuuuuuuuuuuuuuugagacggaguuucgcucuuguugcccaggcuagagugcaauggcaugaucuuugcucacugcaaccucugccucccagguucaagugauucuccugccucagccucccaaguagcugggauuacaggcgcccaccaccaugcccggcuaauuuuuuauauuuuuaguagaggagggguuucaccauguuggucagacuggucucgaacuccucaucucaggugauccaccagccucggccucccaaagugcugggauuucaggcaugagccaccaugccuggcccagaguuuacuauuaauagucgccagggaguguucuaauacaguuuauccucacaacaaaaccuaugaaguugguacaauuauuauccccuuuuacagaugggaaagcugagaaucaggggugugaauugacuugcccacuaucacagcuagugaauguugguggggguuuugaacacugguacucuggcacagaggccauauccuuuuuuuuuuuuuuuuuuuuuuuugagacagagucucgcucuauugcccaggcuggagugcagugguacaaucuuggcucaccgcaaccuccgcuuccuggguucaagccauucuccugccucagccuccugaguagcugggauuacaggugcuugccaccauaccuggcuaauuuuuuuucuuuuuuuuuuuuaguauagacgggguuucaccauauuggccaggcuggucuugaacuccugaccugaagugaucugcuugccucagccucccaaagugcugggauuacaggcagaagccaccgcgccuggcccagaggccauauccuuaaccgcuaugcuguagugucucuucaacaguuggaucaaacuacugccacacauauaagagccuuguauuccaaaggggcugggcuggguuaagagagugggauugguuguuuggguagcucuccccacagcuggagacccagccccaagucuucauccuagcugcaaagauacgagagugcucaaauuggcaguggugccgcccgguguccuuccgaggggaggcaucuauaaaugagacguuugaaucaaauguuuuccaaagguccuuucaguucaaggagcugaaggcccaacuuucccuugggccugccagcuaucuucuccuaugggagcaagcaggcccuuugcagacccuuucacucuguccucccucaaauaguggugugcaucaggguauccuuggcccuugccuaucuuacuuggaggcauggcacgccugagagaccucaucccuccagggcuccaguuaccuucuuuauccugaugccuaguccagaccucuccucugagguugagaaccaucucuccaacugccucccaaggcccuccuccuuagugucucccacguauguaccucgcccucuaccugcagugugaacucagugggugucucuccccggaccucuuccuuuuuucauguucuuuucuacaacuggcucugccaccuacucauccauuugcuuaagccagaauucaggcagucauucucaaguuuuccuugcucucacucuccacaucccaucagucaccaaggccugucaauuuuacccccuacaaauugcaugaaaccaaucccuucuuuccguccccauggcugucucucuaggccaagccacacuaccugagagcugaaguaaaaggcaaaagccuuccgcggcccucucugccucuauucucugcuuccaugagcugcuuucaccgugcagccagagagagcuuuuuaaauuaagcaaaauuuagccgggcgcgguggcucaugccuguaaucccaacacuuugggaggccgagguggguggaucaccugaggucaggaguucgagacuagccuggacauggugaaacccugucucuacuaaaaauaaaaaaauuagccgggcaugguggcaggcaccugcaaucccagcuacucgggaggcugaggcagggagaauuucuugaauccgggaggcggagguugcagugagccgagacgugccauugcacuccagcuugggugacagagggagacuccgucucagaaaaaaaaaaaaaaaaaaaccaaaaucugggugucgaccccccuguccagaacucauggaugacuuuauuucuguuuggauuaaguccaaauuuuuguacauguguaaugagaccuagugcuauuaggcaaaucauuuuacaggauggguucuggagucccuauaagccucgauucuaauguaaggccagccauuucauagcgaaugcgacuuucgguaugcuuuuuaacaucuugaaucuucaacuuucucauuugcaaagugggagaacaguaccucccugguagcguuguugugagggugagagaggagagagggcauguaaccugcucaacuuggugcccugcaccuaagcacuuuaaucacuugcugccaauuagaccugguuauuauaaaguugucaguaccaguaauaugauuuauugauuuaaucaacuaacgauuacuaauugugauaugauggauuuguuauauuguauuauaaguuauuauugugagguuaugaugauauuaauuuggauucugugaugaucucuccagccucgccucucacaacuuccucccaccccucuucccuugccuuuacuugucauacacccucauucccagguguucuuguuuucugccaucucucccuggaaaguccuucucuccccauccucugaguccuccagcccccuuuuaucucucuaagucccuucagaugcuuaagucagcucaaggcaccaauuccucugugaagccuucccagacccuccccccaagaccuguauaggugucucuucuaugggccuccaagagcaccucgugcuucccuucucagaccaccuaucacaacauauuugugauuauuuacuugucacaguccuggacuuaggucgucaguuugacaaagagcucuuaucacuguauuccaaguucuuagcgcucugcugagcacgugguugugguucgauaaauguuugcugaaugaacaagagaucaaccuggcagcauucagcgccccaccccaugacaaucugcccccuucaagggggucugaggccccgagccaaaccucuucaaagccaaaagcugcugugucugcccuagaaguauuucuguccuucaguucauaaccuucucacuuccugugggcuuagugaaggugugggcauuuuucuucaccaguaaaauggcaaauaagcccaauuuuucagggucguggaaauucacugcaaggaggagcucuguaaacugcaaagggcugcauguagcacuuaaugaugaucagacacaauaaauguguugcucuuuggcucaacucuugucaagaccccaugcagacaagggcccuccuguuuauacagcauuaucucuagcaaucagguuacaauugauugacauuaucacuuucuuuauguuuggcagauucccagccugcagcaacaugcuggucaccauagagaccugagaagcacccucaucucauugguaucauauuuacaaaccaccccuuaaaguggauuauuuugcagauggcugaucucaucuauucaauguugauucuauuaguuccaauuucagaaggugacauuuucugacuuuguccccuuaagcacaaacaaaaacuauggauuuuuguuuuuguuuucagaaaagagaaaguacaaggugugcuuggggaacagcaaggaaaccagacagaugugggggcggguuuguaggggaacugcuggauguaccucauuaauuuguucauuuguucagcacccacagggugccagugaacgggcuaggugcuggggauagaguggugaacaagaugagccuuaugcaccucacagucuccugggggagacagccaaauagacaauuuuaauacaauguggcaaauucuaugaugggaagaagagagaaauggugugugugagucccucaccuucccagagguuucccaggggaagcaacguuucagcugagaccugaaggauggaugacaguccaccagaaaaaaguuaguggagcggggacaagcaggguugcagaguggaagaaaaauguuccugugagaagaaacuguccaaagagucugaagagaaaagggaacagggugaauuugaggcccuacaagaaaaacaggagaccauucaacaggagacgcccagggagcagguggcuuugugggccugauguccaagaaagaagucguggugguaaacagagacuugggauugcaagcuacuguugucuuucuauugaaaaaauagcugagcaccacacuagggaggccuugcaaggacagcccaaagaauuugaacuugauucuacaggcagugauuuugaacaagagguuuugaagagaacgugacacacgucaagcugagcucuagggagugggcagcagccugcagaagagggacuaggcuaggagcacagaaaguagcccacggcagagguagcagaaggaauggaggagugcccaugugagggguacugagguggcacacuugccagaaucagggcagccugcuuggucucauaccagcuggaaccaguuccuaccagcucccaagggcuaauuguuaaacuuucaggaauuuucucagcauucauuaaaaaugaaaaaaaguaucaauauuaaaaauauuuuugcuggacauggugucucaggccuguaaucccagcu

SEQ ID NO: 192848 - RNA, 31651 nt, Homo sapiens
uucaguuuccuucuuuuauauuuugauauuuuuuuccauauuuaaguuuuucgauguuuagauauuuuucuuuggugaagcacaaguuucuuuucguggucccugaucaauuuuaaacaguuggaacaccgguggcacuguuaacugcuuucugggcagucucuuuagcuuggugggcuuguaguacagcuacagcuucaucaaccuuagaauggagugacucuggagacuugagcauaugaagaaguucugaauuaucaaucuccaacaacacgccagugauuuuaccggcaagaguagggugcauggcuugaauaagaggaaacagccauucacccaacauuugcuuuugcucuugaggggcagaugccaacauggaaacagucaaagguuccugaccuuguacaugaauagcaggcuguugcacuguaacuuguggcugugcauuaagauguugcugaggauugcaaacucccgcagcauauuuauacuguggaacggugcggacagcaggaguagcugcagcagcuguagcugcaagacguggacccauugucuguguugaugaauucaccaaauuuuuauuccagucuauuuugagacuucuggaaauaaaacaccuugauaccguuugcccuagggcugauuacaagguacacuuaaacugcuaaaaugauaguucauguuauucauagugcuaagguguaucugguaaugcccagugcuuuacugaauuuacaguauauuaccauuaauccuccaaaaaacaaaaaaacaaaaaacaauuugcggccgggcgugguggcucacgccuguaauaccaccacugugggaggccgagacgggcagaucaugggaucagggguucaagaccagccuggccaacauggugaaacccugucucuacuaaaaauagaaaaauuagcugggcgugguggcgggcgccuguaaucccagcuacucgggaggcugaggcaggagaaucguuugaacccagaggcagagguugcagugagccaagaucgcaccauugcacuccagccugggcgacagggcgagaauccaucucaaacaaacaaaaaaauaaacaaaaaccaauuuggccuuuuuuuuucuuggcaaaccagccaaaacugauguuuuuccuaagaaaucacaccucauaagcaaucuagucuagggcuugggauaaauacuaagaaacaaauuagaagucauauaguagugggauuaagagcacaaggaagaugacugcaucaaagaugauugcaaauaaucugcuacuuacuaugugaccugggcaaauuaccaaacaucuguaucucagcugcauuaccuauaaaaugggugguauacuuucaccucacagucacugugaugauuaaauaauuuauauagaauacuuaauacaaugccugacagcaaccagaaaaguuuagcuaauuuaauuauaguuaguaauccaugcaaggccuuauaguuaaaucuugucuaaauucaaagaccucaaagaaacuggacccuugcuuucuuauuuuuuaaaaugaccauuaagaguucaguuuauaauccacccagauuuaucgaauccuuucuucuagguaucuggggguuuuuuugagacaagguuuugcucuguaacccaggcuggagugcaucagcaugaucauggcucacugcagccuugaccucccgggcucaagugauucuaccaccucagccucccaaguagcugggaccacagcuguguaccaccacaccuggcuaauuuaugucuggauccuuuucacugaccuaagaugccugugcuuuggcuucauugucuagagcacuaacuuuuugauggugguauugaguuucaaauaauaaaaucaugaaugacacuaaacuuaaaaccuugggaaggucaugaguugaagagcugacuacaucaaaacuauccugagaaaccgaguuaugaugccaaugacagauagcucugcaggcaccagaggaaaugaaacuauaauacaauacaccaggugucacaaugugacgauuuacuugaaacaaggacaucuuaguggcuuaagcaauauguuuaagagauuaagauagaaauggaagacagaaguacaagcacacgugcacaccuacaaguuuuuguauauauacagggcaagcaagggaguggucagagcaauggcgagaauacaagaaacagcaaagaugcgccuacuuaaaaugucauucacauaaaucuuuccaggauucuuguauuggaauauaaucuuuuauuuuaccacucaacgauuaagccauucaacuacacaacacagauaaaacggaaguuauaacauauaaaccaguaccugcccacacucauagcagugaggggaauaaaaaucaagguugcacuguaauuccaugacucuaaaaaucaagucuauuugacauugguuugaagcaacagaaccuuuauagcagauuccccuuuuuaaagaaaaacccaaggagagaugaucaagcacaaaugaucacuucaugcauuuuauugauagucuauauuuuaaaucugcaguaugacaucuuacauagggaaaaaagcuucuuccuaaaagauaacuauuaauaaucaaaccagcuuuaauaugauugaccuuucaaggucuuguuuugcuuuaaacaaguuaacuuuuagcaguuguaaagcacuguacaaaagaaaacuguguacauucucaaaauuuaauacagggcuucccaaccaggagucugcuggauagguaucggagaaggguguuauguucagguuuaaauugaaagaaaaugagaaaccagauaaagcaagccaaccaaauuaacuucacuuugugcuccucucugcuuuuuugagucucucccgaaggucaggaagcccugguauaacaaucacuuuagucuuuacagaacauacaucuaugugcuuugugaccaaagacauaaaggcagccuuuguuacuguucccccuccaaaccccuucagguucuuauaagcuucagaaagcuuuccaagauugcugcccuguucuuuguaugaauccaaguaaacaacuauaccaaagcagcucuuccugggagaagauaaaacaggcacagauacaucaccaggccaacugcguaccuacucaacuugauaccugaucacauggcccuacauccuuaaaagcagcaccagggacaaauggagcuaucaagagguaaaauccaaacacuggacaguuaaaacacauacaaaccaguuaaaagaacauuaguaauggggcacuaaauagaguuaaggcuggacagcugguucaaccauaccuugguauugaaauaauucugcaagaugaggaacuuacagaggaaccuugaaagaggcaccaugauaugacaggguucacuuucacugcaugucuuuaagauaucuacuacucagcccaacugaccauaaagcagcucguggaacuuuaauaaacaaauccuaauaaaaauaaauaauuuuuagaauguuggaggguaugccuauuuccuucagaucugaucaagacaugagaauuauaaaaccgauacaaacuguucugugauuaucacuugacaguucuaacacuguuauacagcucaauucuaugcugcagccuuuaagauacaaacugggguuacaugagaucacucacuuguuagagaaguaucagauaaauuuuagaacuguuccaguuaaggaaaauaauucuuaauuucauaauccuaaaacuuuuucuaaaaauuuuugcagggcagguacuuaacucauagcuguuuuaguugauuaaaaaaucugauuuaaaaauaaguaaggcugggcgcaguggcucacgccuauaaucccagcacuuugggagaaugaggcaggcaaauugccugagcccaggaguucaagaacagccuggacaacauggcgaaaccccaucuccacaaaaaauuagccaggcaauguggugcaugccuguagucccagcuacuuggaaggcugaggugggagaaucaccugagcccaggaagucaaggcugcagugagcugugaccaugccacugcacuccagccugggugacagagcaagacccugucucaaaaaguaaaaaauaaaauaaaauaaaaauaaauaagugacauacuaguuccucggaucuuuuacuuuuuuccaaaugaaguaugcugucaauuuacauuuuucauguuuuuucaaaagcacacaauuuacuaguuaacucaaugaauuacaauacuguuauugaauauaaacauacugaagaauuaaagggaaaaaaacacaccugacacuuuaacaugugccuuaacaaucuugcauacuaagguacagaauacuucagaaaguaacaauuagcauagucuuauaagacuaggagaauaaaagugcccugcaaacauggcuucuauguacuuaauaugguaaaacaugugacagggaagccuguaagguaaaacuuaaaaaaaaaaucaaauaaggcagauuauaauuuuuuuuguucgcaaaagaacaaaggagaaaaggggaagaauaaaaacauucuccaucuuuaaaagaaaaaauauuaacaaccauaaggugccacuguauuuuagcaagcuguaaaaauggccuuuuaagaggaauuuugcaaucuuuaccucccuaucauuuggguauuuugggaacugaccgaaagucauggcugaugcuucacccauuucaugucauggacgccugggaagcagguaguuaaauacaaagcauauuaugugauaacccuucauaaauauaauuugagacacugacacuaggagaggauacuuggcacagaaaagacauguuauggggcgggggacacauuacuugaggcaacacuuacagccaaucaguuuccuaaucuuaagguuuggaugaauuccaaucguuuuuaaaaacuguguguguacacacacauauuuuauuuccuggugcuaaaggucuuauaaacuguacaauuaccuacauuccaacacuaaugugaacacuuuucucaauccccaccuccauuaacaccauuaagguguaacuaacauguucuuuucagagcaaauauuccaaauuaacaagguggcucaucuucuauaguguugauacaaagucagcaaacuuuuaacuuaacuugcucaauuuuguuucuaauaguacuaauaaaccucaacuuuggcuggacaugguggcucacgccuguaaucccagcauuuucggaggccgaggcaggcacaucacuugaggucaggaguucaagaccagccuggccaacacggugaaguccccaucucuacuaaaaauauaaaaacuagccaggugugguggcaugcgccuguaaucccagcuacucgagaggcugagacaggagaauugcuugaacccaggaggcagagguugcagugagccgagaucgcuccauugcacuucauccugggcaaccaaguaagacucugucucaaaaaaacaaaacaaaacaaaacaaaacaaaaaaaccucaacuuugucagcugcucagaguuaaaacaauucaaauguuucagacuagaagugaguuuuuaaaaacaucugaaauauucaagaaaauuuggguuuugguacuuuuccuuaugcucugaacaaugugaacucccaacauuguuuauccuuguuccucuuacugcaugaaguucaaacuaggucuuaaagacaacuuuucuguacuuaagaaaaagugcaaagauagaaaaugaaauguaagguguuuugcaagaaaugcucccucgagaaugguguuuggauguggguggggggaaaacgauuuuuguucuccauuguaaucugacaccuacgaaugaccuugucuucaauguccacaacacuaguaagcauguaauaaucacggacaucgcaagauuaaaaauuaaguagcaaauuccacuaaaacacuuguauucauucuauacaaucgaauggaaauccgugagugcuacugaaaaagguguucacaugcacauguccaauaugugcauuccacugaaggcuaaaagcuuaaaauucuauuuccaguguuuaugaauagcuucaauaucuacauucauagccagcauucugcuugaguuaccucuuacuuuaauacuucacaaaugaguaaguacgucuugggagauuaggaagguaccuguugucaauaacuuucucuuaugcuuagaaugugcugcaauuguuuuuaaacuauuuaaaaugaacaccccuauaauaaugaaacacuuuaugccaagaagaaaauugauuuguuuuuagccaaucaagacuacccugcagaucugaaaacuguagauuacauccuuaggaaaggagaaaaggaggcucacaaauauaaaggaauccugacuuuuacacggacaaauuuuuaaaaagauaaaauguauuacauaagcgccauaaacagugaaaucugcuuauauuaaaaaaaauaagugaagcuuuguuuggacauuauuuccuugcaagagcaguacauauccuuaguaaacaacuaccauauuuacaaguuaauuuccuugauacuuagauaggauugaaagccagaagaaaucauggaagagugagcuuugaaauaaucuuuacagcuaaguugguaacagugaagguacccagacaauuccuaaagcagacuuguuuauuuuguagaguauuugacuacgucuggguagcuagcuugcuuugauaaaggccaaggacaaguucaaucccuauuuuggccuguuaaagcuuuucccagaagaacaaauaucugcuccauagucauucuaauccuaaccccagcuagucucaaaaaagaaauuaggcaagaagacugggguuaucaugaaguuacucuuacuacuaagaaaccaacauaaagugcauguccauagauagcgagucagcagucucauuuucauauaugggcagcacaauuaaaauuugaauuucaaauaacccaacaugacuuucaacaaaggauaaaaaucccuuaaucuucaacuggucuuuaaauuugagauguuaggacuguguuagagauaguaaugaaauaugaucaagugugcacugguaccuuaaaugacaaaucucaaaaacaacacaaauucgagacuuuccuauuaacacacacauguguaccaacugcaauucauaugcuaaaagugguuuuauagucucuuuccuccauuuuuucauuuuugaggagcagacuuguaaauuuaacuugugcuagguaguagugguuuguuuuucuuaaaccaaaacucugccaaacuugcugaucuucugcuucaucuacucagguagaauaccaggucaagcugcugcuguggcugcucucaccauaugaaaccaguuugugucugcauuauuacugucuucaggaaaacuuuaaauucuucaguuuucuuuacuccucccauauuucacuuccugccuaaauccaaguuaaauuauacaauuuccacuggucuucaacacgguuuaauucugcacuguccuuuccuuugcaugucacaguagcuguucacacauuaaauauuauagauauguucugcucuugacaucuacacacuuacaaaagcagcuuuguacuuuguuugguguguuuguuacuauguuggcucacaaaaagcaguuuucucaguucuaagcaugguacuuuacaauuuuuaaugcauucauacaacagugcauuggaaaaguacugagccucuacaaaauagcuuuacauuuuuaaacaaaugaaugugauuuuuuuucacuuacacaagcauaggcuuuuuaauauuuccacaagauaaauaucucaauuaaacuauaagcucacucuacagugugccacagugaugggcuuaggagacaguuauacacuuagaagauccuaaccuuaguguuauuuacacugacauguccaguaucaccaagucugaaaggugaacaaacaauacucagaauguggcugaauuuguguuaacuaauaacugggaaugauauagcuuuaaucacuuaugaaacacauacuguaacuuagucuaaacugguaauuuccuuugcuccucucuuauggugugggaaaauuuaaagaucaacaugaaaaaggagccauugcuaaggcagaucuuuuaagauaacaaaggaaaaauugacaaguguauaugauaaauuaucaguaacagugaugcuaccaauuuaacugguacggaaaucagauuuuuagguccuauaacguggcuuuuaaaauauuuccuuuuauucuggaacaaaaacuggagaaaggacaaugauuccuucagaaagcaaugacucaauucagguuguuacuuuacauuuaaguaccacucaaaaaguggacauaaaagcaagugauuccuguuugcccaucacuauaucagcuacauagcugagaguucagaucuuaauuacacaacacuuucucuguuaccagaagcuaagacugcucugcgacaaauaggacagguagaauucucagauaaccagcgaucgaugcaguggacaugguacucaugggaacaagguaguuuacgaaguuuguugccuucuguauauucuguaaugcaaacacuacagguuuuuaaugcaucauuuucaccaaaacuucucauugccaaguugucaaucuguucuuuggugaguccucuagguuggucaucaucauccucauuuaagaggaaaaacugagccaggcuaaggaagggcaaagagccacuuucaucaaaugugacuggggcccuaugucgacccucucgccuggcaccugaugagccugaugaugagcuuccuucauuacugccuucaaauaaaucugagcuaguuucugaacuuucaccaccggaacuggaacuaggacuggaacuggaacuugaacuggaacuggaacucgaacuggaacuggaacucgaacuggaaccagaacuacuaccaccaccagaaccuccucuuccacuccgugacucugcccuuuccauauuucgauuugagacugagccaguaggcucugagucgcuaucacuguacauaaaauagcuuaacucaccaaaaccugucauuaucugccuuaacauggucugaauugcaacagauguagucucacuuaaaccaguauuuaagauucuacgaaugggaauucugaugguacugacauagguucucacaccugcccgcucagaacgugaaaauguacgccuaaaaccuccucguucacuuucauaggugacaguguuguuuggugucugagaccuagaccgaguucugcuggcuaugcuaucucucugccgauauucuccaggacgaacucuucuuacuugaagaucaaggacuaugguuggaggucucuguccugauccuguagauucaccacuggcagcugugucugaagaaccugcuccuugagaagcauuucuuguuccagaagcugcaaaaagaccucuacuuagcaacucaggcccagauauuugcugccucaaugucacauggugccggguucuagaacuucccuccgucucauuuaccaaaggauguucaaaagucugagaugagauacuaugaugagaucuucguggaauuucacucauuggaugcagaggugaccuacuucuuucagcucuugcucugguucuccgauggucugggcuccugcuucuugcccuccucugaccucugguaggugggaccucuguuaacgcuucaguugaauuucguucugaucuagauggccuugcagauguugauucagaucguggguuuuccacuugccuuuggcuguuguuuuccacauuuucuccacuagaacgucuugcagauggcucauuuucauucucugaauuuuggcucccauuauuacgguuaacauuuaucucuaaacugaaucugaaaucaccacuguuuggauuaguccgacucacugcucuccaagauugguuuccucuuugcccacuucuuguuguauuuccaguuugucugacagaguuaagccagucuauuauagagucaccauuagacacaucaucugaagagucuccuccuguucaaaacaaaggagggggagagggagaaaaaggaacuacuaaaaugaggacaaucauauaagugcucugaaacucugcauuaaauaacuuaaaaauucggaacacauuucauaauuacagauuuuuacaaacuauacugcauaaauuuauaagguaagaaaauucuaauuccauuugaaaagagcaagcuacacuagagaaauuuagagaauuauuugauuuuuaaagggaaucuggaggaagucuauuuucaguauuuuaucauauacagagccaagcauaccacugugggauggucagaagacguuuuuucaguccucugccaaaauacuaauguaaucaaacuagguaaggaaacaguguuuaacgaacagucacauuuaguucaagcuacauuucugucaaauuuuuauuagucuacauacugugccuuugauaacauuugagguuguuuuaaaauacaggacuauuuauuguagccauaagaaaaauacaaacaagauuuauagguuuaaaagcauuugaauauuucuuaauguuaccaagguuuucaauggacaugaaguuaaagaucagaucaaauaaguagucugaaccuugcauagcacauauaauggcauguucaagaaccaaauuauuaucguagccucucagguugcacaaucaaaaucccuacuugacacugggagggaaacaccagaccugagguuagagcaggauuucucaacagugguacuacugacauuuuaagccaguuaauucugugucaugggggcuguguugugcauuauggcaugucaggauguuuggcagcauuccugcccucuacacaaaugucuccagacguugcuaaugucccacauggggcaaaauuauaucucauuaggaaccacuggguuuagacauuucuuuuugcuggugaagaagucacauguuuauaaagaaggaauuaaguaggaauaaauuucaauggaggugaaaaacaaacaaacaaacaaaaucacauuuaaaugggccauuucucacuguguuccaauuaacauaaacaucucaaaggugagguagaaaaaaaaugcugacauucuaaguaucaagaaaaugucaguuuucuuuuuaugagcaguuacuuagcaccaaauuaauuugugccaaaucuggauaaucuuuggcugacauuuacuauuacaaaguuccuaucaucccaucgucuauccaccuccccaccaaaaccaaaacauaccucuauuuucaucugaguuuugcgguggugggccuucuuuaauuugcuguagucgucucagcaacucuuccucaguacuuucaccugaaauuuaacaccacagggcaaagaugacauuagggguaugacaaucaaauacuuuaucagugacucacaguaaucugacacaagaugauuagaaaaaaaaucauauuuuuaaaagagaaaacuuuuucaaaccaaaaagaaaaaccaaggaguagguagguccugggaaaaauucacuucuuuggaaacauauuaaaagcaauuuacaaaguucuuuugcauauaacaucuaacuuuggcucacgccuguacucccagcacuuugggaggccgaggcggguggaucaccggaggucaggaguucgagaccagccuggccaacaugaugaaaccccaucucuacuaaaaauacaaaaauuagccagacaugguggcaggugccuguaaucccagcugcuuaggagacugaggcaggagaaucgcuugagcccaggaggcagagguugcagugagcagagacugcaccacugcacuccagccugggcgaaagugcaagacucugcuuaaaaaaaaaaaaaaaaaaaaaaaggcaaaggcaauucuaagcugggcgcacagugguaccacaucuguagugccagcucguugggagacucaggcggaagaaucccuugaguccagccugggcaacaugagacccugucucaaaaauaaauaaguaaguaauuuuuaagaauugcagcuuugagaggaggauauuguuaucugcauuuuaaaauuaagaaacagacugagcgacagacuggcuugccaggagccacaccaaacagcagggccagaacuccaccuaaagcauucugauucaagccugguauuguuggcuaaaaacacacucccucucuuaaaagucaugcuaaaaccuuaccuuuuaaaaucuaagcaauuacucaaagguaaguagaauuaaacagaaaugaagaggaagacagauacugacuuuuaacuaggaucaaaugggacuuagugggguaaaagauaauuaagcacaaacuucuaauugcuauguuacccaaggcuagcucuggaggauuacaacugggacauauucagaaaaucagagauaacagaauaagucuuuccuaaaaacuaaguucccauuagcuauuccacacucggauucuuaucuaguaaguuagauaaagcuaacuaagaaaaaaaagauuuagcuccauucuuuucaauucaguucgcuaaaaauucauaauucauaaguuaaaaaucucucugauauaguguaauuccaaacaucaguaaauauaaucagguaauaaauacagcaauaaaugucauuccauauccccuauguuaaauaauauuucauaagggcuaaagaaauggauuuuuaaaacagguucaagcauuuuuuuuuaaaccagcaacuuacacuuauaaauccuuaaauauauguaagcauaccuggggugccuagcaaauuguuaucucucauaagccuauaaucuucuucacucagguuauuuacaaauugauagaaagcuucuucucgauccaaucgguccaucugacuucugcgcugugcugcagacugaucaccacuuccuuugucauuggaaucugaguuuuccauauugaugaacaaguggaaaauaccugaaaagagaaaagagacuaaucuugaaaauaaaggucacuauguauucuauacaaguuuuaauuaugugaaaauccagaauguaggucuagagauggauuuucagaccucaaaugaaauuuccuaacaaaaacuccugaaaagcacuguuauauuaagaguaggucaaggguuggcaaacuacagcccuugaaccagacaggguuggcgaacuaaagcccuugggccaaauccagccauacugugguauuuuuuguuuuuugagauggagucucgcucucucaaccaggcuagaguguaguggugcgaucucagcucacugcaaccuccaccuccuggguucaagugauucucugccucagccucccgaaguagcugggacgacaggcaccugccaccacgcccagcuaauuuuuguauuuuuaguagagacaggguuucaccauguuggcccaaucuggucucaaccuccugagcucaagugaccugcccuccucagccucccaaagugcugggauuacaggcaugagccaccgcacccagccucgugcugcauauuuuuauucuccuugcaaccuaagaaugguuuuuagagacuaucuugugacauaugaaaaugcaaugaaauucacauuuuaguguucauaaaguuuuauuggaacgcagccauacacauucauuuacauguuaucuauggcugcuucugugcuauaauggcagaguugagcaguugugacagacuguauguggcacucccauugcuuuggacugcugcucugugcacucuuaaguugcagugauguagcuauaaugacagcauuucaagugccuucacacuggacauuaaaaaaaacugaguauacacucaucaucucaaacaaagagaaaaguggacucugaaugucacgcuuaaaggugcagcagaggauggguuuuucaaaaaucagauuagauggcaaagaaugcaugauuaugcaaaaaauacuauauacuaaauacaauauauacugacacuauuaaacacuagugacaauauucccaauucacaggaaaacuacaguucaaaaaguuagaaaauuuaaagugaaaucucaucacaaaauauuucuucacaaaaauaaaaaugaggcuucaaucaaaguaaauuucccaggggcucauuuauuggcuaaacgaggaaagcuguuuauugauggugaguuagugaaauuauguuugagugcagaagcugaagaaauguguccagagaaaauaaacauaauauuggacuuuugguaaguauagugguccaaaaagcugggaauauugaaaagcaaugucacuaaucaacugaaaaauaagguaaaugauggagugguuuucucuuuggcucuugauuuguugacaaauguaacugauacuacuuaaguuauuguuuauucaaagagccaaguguugauuauucaaggaguuugaacugcagaaguagccccuauguguagucuacaugaaauaaucauaggugagaauauuuucaaaguugagaaaacuaauucagcaaaaccugaagcagaaucucauaauaagauauguuacuacuggaaugguaaaaauauauauggaauggaaaaagaccuaguuggacaaauuuacaaaguuuaugaaaauguaagguauuuaacguuuaugguuauauauuuuauuacucaucaucaagugaucugaagaaaauuucaaucuaucauauuacugaaccaguagcacuaaugauaaacuucucucuuaugaacucugguuuaagcucaaguuccaugaauuuuugucagaaauuuugucuugcucuacaacacaacauuugaugggcuaauauugguaaaguuuuauugugauuuguugugcucaaggcaaagauggauuuauuuucugugagaaccgcucucaauuacuauuaucaaacaauaaauagcuuggaaaauuaguguuuccugcagacuugauaauguuucuuaaugaauccauccuaaaacaacaaagcaaaaaauacuuauauaugaaacuuauacugugguaaagccauuucagcaacaacauugguaucacauguaaugucaagcuguuuuauauacuucauguccugacaaaguaaugagagcuccauucccacacaaauuuguagcacauacauuuucugagcucaaacuacaguuccagaacuguuuugcagaccccaauguaagcacaaaauaaauuuccuuauuucaaaauccauuuaacugugcaacugaggagcuuccaucuaacccucaacuagaagugacaucucugcagugguaauaugccaaaagguaaauauuaaagucaucuggcuggggugugguggcucacaccuguaaucucagcacuuugggaggccgaggugggaggaucacuugagcccagaaguucaagacgagcuugggcaacauagugagaccccaucuucauaaaaaauuaaauuaaauuaaaagauaaaaaauugccaggcgcgguggcucacgccuguaaucccagcacuuugggaggcugaggugggcggaucacgaggucaggagauagagaccauccuggcuaacacagugaaaccccaccuguacucaaaacacaaaaaaauuagcugggugugguggcgggcgccuguagucccagcuacucgggaggcugaggcaggagaauggcaugaaccugggaggcggagcuugcagugagcagagaucgcgccacugcacuccugccugugcgacacagugagacucuguuucaaaaaaaaaaaaaaaaagauaaaaaucuaacaaaauucuauauaugcuucacuaaaaucauacacuuguggauugcuuaagauagcaauaccuauauguaugaaaagauauuuucaaagauuaaauauuuaagucagcaauaaauggacauuugcaaaugacuaauaaggaauacuagcuaugaaucccaauuaagcaaaauguuacccucaaaagaguaucauucuucucauuaguaaaccuaucucacgaaacacuguacucaauuauuguuauuacauuuugaguuuuaucaggaaaaacugugagaauuugguuucucucuuuugugugacaauaugcucaauuuugcuuuuugaucugcaaagccuaaaauauuauacuaucuggccuuuuaaagaaaaaggaugccaacuccuguucuagguaauacauaaacuuagccaaaaauucuugucauucacuauuuguacgaguuuaaggaaaccagaauauuggcagacauuccacacauacucaucaaugaacugcacacuaauaaaaaacaaugguagucaacaaucuaaaauacagggagacuacaaacaaaaauguucauccucuaauucuuuaccuuacaaccccagauuccccuuauguuccccacgaacacaacuaaauuccaugaacauaugugcuacugaccaaauguuugucccccucaaauucacauguugaaauccuaaaucccaaggugaauauauuaggagguagggccuuuggucauaaggguggggcccucaugaaugagauuaacgcuuuuauaaaauaguccccagagaguuccuuuguccuuuugccaugugagguuaaagugagaagacagcugucuaugaggaauugggcccucaacauauaucaaaccugcuggcacccugaucuuggauuuucuagucuccagaacugugaaagauauguuuuuguuguuuauaagccacccaguuuaugauauucuauuacagcagccugaacagacuaggacaauacgaaaaaauuuauggaaaaaggguagucuauauugguacuaugacuuaaucccacauacacccacacacaacaccugaagugccggaauguucacaauucaauccuagagagaaaaauaagucaagucuuacuccagauauaaaaacacaaagaagccugucuugucaaaccuugccugcuugcuaagccuaaauaaauuuuagucuagacagaggcauaccuagaucuccacuguuuuccuuagaucauuauuuuuagaacuauccuaucuuguuuaauuaagaugaguaugucaagaaaugugguggugggggggagaucauaauauuuuuggaguuucuuaaucucauaacugagauugcuuaacuguaauaagauuauacuacauaaacuucugacaaaugguuacuuuauaauacuugaaacuuugacacuagaaaucaccagcuuaaauaaaacacgcacaaaaaacaggcacuaaaaaaauacaaaacaaaacaaaacaaaaaaaaacccugaaaaggaagccaaguuuucccacaugaaucucaaguaauacaacuugguauuagaagugguaaaggcagccgauuuuuaaaaauauagaaaagcacaaaggaaaaaaaaagucagccauaauuucucaaauuugcuaagaacauuuaacuaauguucuuaauaaagcgguuaguaguuugaacgcuaaugcaugaaaguuaagacaaaauucacuuguguaggauagguaaauuguucugaaaacaacugcaggguuaaaaggcuugaaaaauauaaaucuuccaaagaaggcaaagauaucugguuaaguucugacauuugaaggacaugaaccaaauaaaagagaaaacucacaugccaaagacauuuacagcaguggcacaaacucuuuaacaauaguaucgggggcugggugcaguggcucacaccuguaaucccagcacucugggaggcggaggcagguggaucaccuaaggucaggaguuugagaccagccuggucaacauggugaaaccccaucucuacuuaaaaaaaaaaaaaaaaaaaaagagcuuggcgugguggcccaugcguguaaucccagcuacuugggagggaggcugaggcaggagaaucacuugaaccugggagauggggguugcagugagccgagaucgugccacugcaccccagccugggugacaagaaugaaacuccgucucaaaggaaaaaaaaaaguuaucagggagguaaaagcccagaaggaacagaaacuuacaaaaauaugggaaagauuuaaaacacugaaugugaagcaagaaaggggucuuguacugaguauggagggggguguaucagguauauuaacagaagacggaagagucacucaacuuccauuuuguuucuauuuuauucaacaaugagaaucaucuucuaacuggaaagaguggaaaaaacaacuuuucaaagaaaaucaaaagccaagaaugcguaauuucuaaugacaaucuuuugagaugucauagagaacaggagagaugcuaaaugauccaaucuucaaaaaaagugagaucuacaaacuacagagcaguaaaaugugacaauacaucuaggggaaaauucugcaaauacauuaucagauaaacugcaaacauguagaagacaguauguucacaagaaguggaguucacugcuggucaacuuaaaaaaauacaaacccccccccaaaaagauuaaccuuauuuaaccuuauuugcuucacauagggaugguucuaaaccuuggcuugcacauuagaauuacuuggggagcuuucucugggguuggucagacauggauauuuuuuaaauuccacagguaauucuauuuugaaagucaggguugagaaccucuuugauagggacaucaggauaacacugcugacuuacugacuugauuucugcacaggaucugagguuuuucuuccuauuaagaagaaauauagaccaguguaauaggaauuaucuggaaaucuuguuaaaauacagauucugauucaguagauugggguagggccugagauucugcauuuuuauuaagccuccaggugauguugaugcugaaccuagaaucauacucugaguaguaaggagcuugaugacaauacaguuaaacagauucacaguuguugaacaccacccucaaagauuacaaagcaauguuaacuugcaaacagcccuguaaacuuuagcauuuuuaaaugaaccaguuggaugaauccacccaagacaugguaaacaaauccauaaacaacucgaagcugugaguuagcacagaagauguauauaauaaauauuauucugaauuaucaguggauuccuaggaugggcugaaauaaaaacaaugguaaauauccuaccucggacacuuuaugaagggcuaucaagcuaaaauaacccauaguaaaaguacacagucggggaagaaccugucuuggcaauucacaugaaagauaccucaaguuuuuggcuaacacaagcucaauaaaaagccuguuugaccuggcuaugaaaccuacgagaaucacaaguugcuuucauagaccacgguguucaaauaaaagcagguaacagccccacugaaaccugcuguucauaguacauguagaaggccggacacgguggcucacaccuguaaucccagcacuuugggaugccgaguugggcggaucauuugaggucagaaguuugagacuagccugacuaacauggcaaaaccccgucucuacuaaaaaaaauacaaaaaaauuaucugggcgugguggcgcaugccuguagucccagcuacucgggagguugaggcaggagaauggcaugaaccugggaggcagaggcugcugugagccaagacugcaucacugcacuccagccugggagaucccgucucaaaaacaaaagcagacuacauguagaguaagugaaacacgagugagaagccugggagcaucauaaaagaaauggaugaauuaccuggagguaguuagccuggagaaagacuaaaaauggacacaauuaccaucuucaaauauuuagagaggaauaacaugaaggagagcacaaccauaggguuaaauuaaggucaauaguuaaagacaugcagaagcaaauaauucuuccuuuuaguaaaacaaucuaacaaaauugucaaaaaaauagagaugcuaccagucucuugaagcaagcaaacuuccugucuccugagauaaucaagcagaagcuggauauuaaaaagaggauuccuuauuaggugagagccagaagagacugauuccaaaagaccauuuggacuaaaaugcuauuaaggguagugaagucucuuggucuucuauucugggcuuagggucauaguaagcuacauacuccagugacacaaaauuacaacauuuucuuggcaacaccaauccacuuagguuaccucuaccccauacuccccucccccaacauaccuugugcuuuaccaccgucacaauguacugcuauuccccucaguccccucuuagcuucucccuauuucaccaacccuuaaagauccaacgagaucuucccuccuaaggagcuauuacuaucucagcuagcaauuuuuccauccaucucugcauauagcacuugucuaugcuacuagaguggcacuuccugccuuccauaauguuuuauauuuuugaaguguaugugucuucucuucccaaauagauuucuuuuagggaacaaaccagaauuacagucccuuuaaaacuucugccaaaugccacuagcacaaugccuugcacauuguggauauuuaaaugacugaaagaaauccaaugugaacacugaguucauuucccuuaguaaucucucugaaacagcacaguccaaaagagauacaauuugaaccauauauguaauuuuucaaaaugccaagcagcugcacuaagaguaaaaacaugugaaauuaaucuuaguaauguaucuuauugacucaacauaaucaaaaaaaaucauuucagcugacugaccacgguggcucaugccuguaaucccagcacuuugggaggccgaggugggcggaucacaaggucaggaguucugagaccagacuggccaacauagugaaaccccgucucuacuaaaaauacaaaaauuagccggacgugguagcaggcacccauagucccagcuacuccuagucaggagguugaggcaggagaauugcuugaacccaggaggcggagguugcaguaagcugagaucaagccacugcacuccagccugggcgacagaguagacucugucucaaaaaaaaaaaaaaucauuucaacauaaaaaaaaauuuagauguuuuacauuaaaaaauacuguuuuugaaaccugguguguguuuuacacuuacagccuaucacaaguuggaugcuaaauuuucgacagauaaaauggaauguaguucagcaaaacaauacaguuguguuuaguggaaaaacauuuuacacuacuucaguuuuuuaagcuuaaaauaaaaaaaaaacuuaaaauuucaguuucacuagucuuauuucaagugucuaacagucacauagugguuaauggcuaccauauugggcagcacagcuuuaaaguauuucuuuguaagauagagaaaucccaaauagggagaguuucaaauguccccaauauauuuuucaugcucuacaaacccacuauuugcauccccuuuauguuuuccaaaaauaaaacaauaagguucaauacucuacaauguucaauacucaugggauagauaagucuuuccuaugcucaugaaucuucaagauucauucuugaccuuuuagaauuucuaccauuuccuacauagaaacuagagacaaaacauuuuaccuccauucaaaauuuuccugacacugauuucagagauuuuugaauccuaaacagcuccugcuugaugagcuuggauuccguuccaugaaagagggaauucuaaauuuuauuuaauucaaaauuuuaaugagacacacucauaaagcaacaugugaacaaauccaaaucacuaccucuucaauaauaauaauaugcugcugucuccuuuccugcuacccuuccauauauaugccagagacaaucaaggaaaauauuuuccccaugauacuccugcaacacacuuauuucaaagccuccauccuuucugccuuaacuuagcauuuccccugggcuggaauugggggucaagagauuucagcacuggcaaggcacucccucccuuauaagggaauucaaagaguaagcuauggcuacaauaccugcagagguccccuggacuagacauaauuacauuugcaaagaaaauggaaaucaaggcaaugcucucaaaugccuuguaaacuaauuuuacucucacacacccaaugagccuggucuuauuuuaagcagaccuucacuaucuaagcggcauaaaagaaagaaauggaauaaaucuaaaaaccacaaguucugccccagguagauauaaucugccacuauuguuuacuaagugcaaacaaacauuuuaaaguuuaggcaugccaaaaauaccagaaaaccauacuccaaaugaucaaauacagcucuaucuccauuuugggugugaaaauauuagugaagaauaacauuaacaaaacaggucuccagauucuacuuugcagugaguaacauugugguacauuucuagcuuaaguagcaagaggaaaaagagaauccuuauacaccgcugggaucuuucaacaucaucguaaaagagaaggucauaaauccauuucuuuaguuaucucagauaagucagaaauucugacuucagcauaugauuagcaucagcuguuuuucuaugaaaagauuacccgugaaacauacaguaauuuaaacaaugaaauauaacuguuuugaagucacuuaggucucucucuggcuauaagcaauacucaucacccuguauuuacauagcccuuacaccuguauuucauuuaaucuucacaauaaucccaugaauuaggaaucaccaccucuacaggugacaaacagaagcacagagaaagaaagugauuuaccaaaaaccaugugacuaguaagugggaaagggccaguaauuaaauccaggucucugcauuccaaauccagucaacuuuucacuaagacaacugccucccaacauaucccaagacucuauacuuuaaaacacauuccuuccuucaaucccaauagguaugacuaaacuauucaaucuaugagcuuuuuauaccauguucacucccuguaugaaaaauuccaaaaugacaaaacaccuuuuguaagcagcacaaaccuagauggacuuauuuuuaaauaagucaacuuuuaguaauuuuuaaaaauacaguugcuccuuagauaaacagcauauuuuauuaaccuuauuucuuuuagaguacugugugccaauauauccaaauccauuccuggaaacaagaaaccaaaugagaaauuuugcccaaucguuucaaagagcuacucaucuggucaaugaaugggacuguauccaguaaguuuaauucuggggaggaaaggccagcaagaacaccaacccugagauuuauuuaaaacagauuuuauucacuuugagaauuuuaaaguauuguuaauaaucucaacuucuucuagucauuauuauauauuaauauaaauuaugcaaaugacuguuucugauuacugcuaaauguaguaucucauuuaauucuucuaauccaugcacaccaaacuuuuaaaaaauuuaauuguuauaauguuaaggcaaaaaguuauuuaaaacauauuguucaguacuaacaggucaggagaccuggugcuaaguauaaacacaggcauguuauauuugauggacacacuacauuauaguacccaauuaaggagacuuaaggcauccaaaaauacuguuaauaaaacagaccuuacaaaacuaaauucugaaacaccaagugaaaugccuguguaaaaaccaauuuuaaaaagugagucaucuuggcugggcauggugcuggccgagugugguggccgacaucuguaauccuagcacuuugggaggucgaggucggcggaucgcuugagcccgggaguucaaaaccagccugggcaacauggugaaaccguuucuaccaaagacacaaaaacuuagcugggcaugguaacgcgcaucugugguccuagcuacuugggagcugauguggcugaggugggaggaucacuugaguuugggggcagagguugcagugaacucagaucacgucacagcagucuagucugggugacagagacuccauaucaaaauuuaaaaagucauauggaagaaauuaccucguuuuuuaaaaaaaguggggugggugggagggaggaauuaagguaacguaacaucaacuaacuacuaaaucauguugaauauuucaccuugugcauauguguucauucaagcuccaaauucuauaauaaaguucuaaagcaggacaugccaauuuuuaaaaaauuauggguaugaacacaaaaaugugucacacugacaagagaagggcaauccauuuuguuugcaacagagcuucaucaagaaucucauaaaggaggcugaguacaguggcucaugccuguaaucccaacacuucgggaggccgacgcgggcggaucaccugaggucaggaguucaagagcagucuggccaacauggugaaacccugucucuacaaaaauacaaaaauuugccaggcaugauggcaggugccuguaaucccagcuacucaggaggcugaggugggagaauugcuugaaccugggagguggagguugcagugagcagagaucgugccauugcacuccagccugggugacagagcgagacuccgucucaaaacaaacaaacaaaaaaccacacaccaaaaacacacacacacaaaaaaaacaaaaaagaacuucauaaaggaguccuuuaagaacuagugacaugugaucugugucaaugaagaaaauguuaaauaccaucaccaaaaugaaaaauacuuuauucaguuuuuuaaaaguuaaaucacaaagaacugcugaauuuaaggccagaaaacaaaaaguaccaucauaucauuacguauguaggcaccaaaaguguuggggauucuucauauauagaauguuuaauuaaaauguuaugguauuuguaacagaaaaauauuugcuaacaaccagguaucuuuuuuuauucuacacauggguagcagggugaaacucagcucugugaaaggaaaaaagagauacugaaauccagucuugguuguaacuugguuauguggauuuggccaauucauuuaaccucuugugccagagaagucuccaucaauauuagaguauuggauuaaaccaucugcaagguacuuuccaguucuaugaaucuguaacuguaaauaagauauaaccuacaccacauuacgauauuaagaaauauuaaguuuaggaaacagcacaaauaacuaggacauaagcuuauaagcucugcuuuucucacuaccauuucacucaauguacuucuaucuccacucacgcaguuaucuuuuugaaaagaaauauaaagcauuccuaaaaaaaaaaaaaaaaaagaacaggcaggguuaaugucucacugacuuuccuuauugcaugauaccucucaccaacuaaaaaauuuguugauaauuuccaagaguggccuaucagaaaaugcuaccaagguaucccccacugcucaugcuaccauaacaauaagagauuauaaaauaucugaauggcaguuagcuuagccuccacuuacauucuucuaucuuuaccaguugaaaaggacagcagagaaaaacuaaaaggacucaggaauguuccucauguacgcaccgacuugcagcucaaacaacuuuuacuaaaacgcucuaaaacaguuaaaacugaaagaguguuaagaacuucaguaaaucaaaggacugaagaccaugccaaaugcgguugaucuacaggaucaaguuaguuaaaaaaggaaaccauuaugacauuucaucucagucaaauacuuuaaucuagacagugaauuuaaucuucaauuacccguuuuauguucuuuuauuaucaagcuaugccacuaaauuauaauuuggucuuauccauaaacucguuuugacuugcuucucucauuauuccuaagaagucaaaaagaaaaugacucaaaaacccaaggagugcauguguuuaaguuacuaagguaaaaaucacugauaacugacaauguugguguucaucaguaacuaaggcacuauuuuaaggaccuaagauuuuuccaucaaaaaucagguuuuuaaagauugaagccaauuuuuaaaauuaaaaucacuuagccgggugcgguggcucacgccuguaaucccagcacuuugggaggccgagacgggcagaucacaaggucaagagaucaagaccauccuggcuaacacagugaaaccccgucucuacuaaaaauagaaaaaaauuagccaggcguaguggugggcgccuguagucccagcuacucgggaggcugaagcaggagaauggcgugaacccgggaggcagagcuugcagugagccgagaucgcgccacugcacuccagccugggcgacagagcgagacuccguuucaaaaaaaaaaaaaaaaaaaaaaaaaaaaaauuaaaaucacuuaacuaaaaaagaaaguauuaucuauaccaaucaguuauuugaggaaguaauuuuguauuuaagaccaaccaugcugacaauuguccuuccugaacuaguauaccuacauaaaaauaacaugaagagggugacaauauaucuuugguuuguccagaagaguaaggguuuacacuuguacugaaguaaucaguaauauggcucucccuuucacucucaaaagugucccaguuuagauaauucauauggucuccuuaguuauaaucagcacuaaagggaucauuggucaauaaaaaacaaaaguuguaguuaacacuuuuccuccuauagucaaggggagaucagaagggaccuuuugucauuccagaaaaaaauuuuaaacaucaaacacaaauacuuccuuucucccaggaaguaacauguucaucaucauggaaacgccauuagacucucaaauguuauaaaagcaaaccaaccuguaguugcaaaauuauugcaagaaauccaccaaucuauguaaugcaccaagugcucucugccuacagauuauuugucucacagauauguaggugcuacugugacuaaugaaauuaaacucuuggauugguggccaggcgcgguggcucaggccuguaaucccuguacuuugggaggccaaggcgggcggaucaccugaggucagggguucaagaccagcuuggccaacauggugaaacuccaucucuaguaaaaauacaaaaguuagccaggcgugguggcacgugccuguaaucccagcuacucgggaggcugaggcaggagaaccgcuugaacccaggaggcggagguugcagugagccaagaucgugccaccgcacuccagccugggcgacagagcaaaacucguccugcccuccuaaccaaaaaacaaacaaacaaacaaacaaacaaacaaaaaaaaccaaaaaaaaaaaacccuuguguuggaacauuaaaauauaagaaaaucuagagcaaaaauaccaacuauauaugucaggagaaaaaccacaaguucauaaauauauucccccaauugagguauauuuaaaaaauaccucaauuggccagucgcgguggcucacgucuguaaucccagcacuuugggaggccaaggugggcagaucacaaggucaggaguucgagaccagccuggccaauauggugaaaccccaucuuuacuaaaaauacaaaaauuagccaggcgugguggagagcgccuguacucccagcuacuugggaggcugagguaagagaauugcuugaaaccaggagguggagguugcagugagccgagagugcaccacugcauuccagccugggcgacagagugagacuccgucucaaaaaaauaaaaaaauaaaaaauaaauaaauaaaaauaccucaauugauaaaaagagaaaugaauugcuggauuaucugggaaacuuucauguuugaggcugagaaaaaaaaaugaaagaaaaauagauacagaaguguuauuacuuucuuauauuggacaucagaacuucaauuuauuauguaaacuagauacuuucugaaaucaaugggccauagguuuuagaaaucuuuguguuaaagaaaaaccuguccaguucuaggcaguggcacaaaauucuaggcccucauugguuuggguuugacagaagacuuuuuauucucuaauuugucauccacucuaugguaaaugaagagaacaggaggcuggcuggugauuugcucuauuucuaauccaccauggccauggaaaaauuaauguacauauaauauaauuccauaaaugcagaugccucauuugaccuacuacuauauuaaggcucacuacauguucacuaaccucaaagauauccaaccagccuaguauuuccagaucauuuaauuauuaagcuauuucuuaaaaucauuucugauuuuaaauuaaguuuaucaaaugauauacaaggagcuauccauuuaacaucuaucaaugagcccauccaauuacagggccugugaaauagaacaauaaauauguguaaacaugcauaauagcugaaacaggaacguaacagacgaaaaggggggauugcuggauaaccuuuaaguauuaacaaaaguuucugaugcaacauaaccuacagacuuuuuacuacaaccuuucauuuucauugcauuuccuaucuaauuagacagcaaucaaacccagaaguauaacgucagacaggccugggauaaaaugagggcuccaccacuuaaagcuauuuaacugaggacaaauuauacuuaaccucuuuggguuuuugguuuccucuauaaaaguuaacauucucaugaggcucuguugugagaauuauaaaauaaugcauauaaagcacauggccuagcaccacaggccuucagcagaaguugguuaugaauuuaggcuaaguauccaucccaguuugucggggacaaucaagguuugcaccugcuguccaggaauuauuaauguuccuuuuguucuuaaaagugucuugguuaggcaauaaauuaugugguuacccuaaugaugaugauaauaauaaugaaaggagucaauaucaauuaaaaguaucauguaucaauuaugaauuuuugaaucuuaaaggaaaaaaaucaaccaccacacacaaaguaacguaaaauuauacucucguaagcuauucugauauuucauuuaguuauccaaugaacauuuaaauguuauuuuacuuauacucaugccauuccaacaaugauauaagacaacaaauuuuuuguuguuguuguucuauacagguauugguaaacuucagacauuauuuuaaagagucaaauucacagauaaagcacuggugaguuccagguauccagaaacauuacccuuuuaauucccagugaaaaguacccauucuuaucaugaagaauacccaacaccaucuaacaucuaucaaugagcccauccaauuacagggccugcaaaauagaacaauaaauauuuguaaacaugcauucuacacauaaaucaucaggagacgcaacaaaaaauaaauuaccugacuguuaugacauaguauugaaauacaauaaacuggauuuuaguuuucuucacucugcucuagaaaaaaaaagaauccauuauucuuccucuuuaaaaagauacacauuuucuuugaauuagacacaaccuaaaaaaaaaaauacagacacaccauaacccaaccuaauucaauauuaguauuagggcauuuggggagagcaagaaggucagaggggaccaggaguuagauaaaagaugucuucuaagacugagagacaauuuacguuuuauuauaagcuugcuuaaaauaagccuuuccuuaucagaccaguaauuauuuucagauucugauagucacuuucaaggacuuaucuggcacauuacacuagccuaagguaggaacuaaaguauuaaaauucaucagaacaucauggacuaaaaaaaucuuuguaacauuuuucaguaaguggaguguguccuaaaaucaaguuuuaaaaaguggauuggucuuucuagcuaccuaagcuauauuucuacaguuuagaaaagucauggggggggagggguuauaauugugccaguccuccagggaagauacaauguacuuaauggggugauaaguaguuacucugucuauaaucacgaagaaugaaagaaaugauuaguagcaguagguuuauuauuucuucccccuuucaaucaguccaaaacacugcgguuaauucugauucaggaaaugcgggcuccuuacuucuggcaaaaaaucauuguggggucuugcaaauggaagaugacaaucugauacaacugcuuccucuugccccaaaaugaaaaaaaaaaugaccucaauaacaagacugcuaggccucagauucccagacuaaccuguggaauaaguauggugaaacugucuagggaaggaacguggcugucuccuccaucuugaaauuaaucagcauaagggaaaaagggaccgaguauucaggaagcagaagcccaaccgguuaauacuaguuacuaagcuauggcaugcguggcagguaccgucugcagaagcagagaccccccuaggcuuuuuuuuuuuuuuuuaaugggggagggauugaguuguugguggauuaaacacaaauuaacuugaaaauuuggcccaauuccaucccuuauccaggagaacacaacaaacaccuaacggcuuuucccucucuuuugcggggggauccuuccagugauaccuggcaaaggauaugccaggguuauucgagcaagggaguaaaccacauuugccucagauccucagggaagaugucaucgcggccccagggggcgccuaauugguaauacccugcagaagggcucaaaaugagguuuuggaaaucuaaaggcccaagaguugccagcaucucacuuggggcagccugauuuuuuacuucccuuuucccaaacccaagcccgccauggaaaacgcggggaggucagggaagccuccagagaacagagaagaaaaagccugagacguucuaagauucugacgccugaggccaaaacucaaaaacugccucccccgauuuccuaaggcuccggagggccugggcugcagcucgcgcggccaccgagaggaaguacuacccaccuccuuccccuucaaagagccugucgacuauaccacucaacuaaaauggcagcggcgacuacgccacggagccccccgcagcaacgggccugggguccggaggcggcgcugagccucugccacgacgcgucacucgggccauuuugagagaacgcggcagccgcggcuccgcugucuuccucucgcucuacaucauuucucacaggauucccaagucuucacuuacuagguuuuagggucaggauccgacucgguugguucggccgccgccgccgaggcugcuccgcaccucccuggccgccgcucucaagcccgccuccaaugaguagcugguugagacccgccucuagcccagcgccugcucggagacguugcucaggcagccauuaucuuccccauuguuaccaagcagcgacaggaaacgacugccc
